United States Patent 7,892,730 (COMPOSITIONS AND METHODS FOR CANCER) - sequence listing, part 6

SEQ ID NO: 467 - DNA, 5465 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaaggcaaaaactttcaacaagaatcttttgctcctgcttcagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagag

SEQ ID NO: 468 - protein, 339 aa, Homo sapiens [sequence omitted]

SEQ ID NO: 469 - DNA, 47745 bp, Mus musculus
  misc_feature (1)...(47745): n = A,T,C or G
tggcaacattgcttaaggcagtgggggggtgtcacaaaaattaagggaggttactatccctggtgatgtgagtaaggaagtaggcgtgcatcagaggctgtgtgtgtgactgaggcaaagggtgaaatgattaggagtccaggactgttagagacacataacctgctgctggtatagaaagatacttcagagatgggagcaactgaggtgagccatgtagtgtgtatacaattcaatgacaagtgataaaaagtaggttacaggcagggaaaacagcttaaagacactgaggtatgcttctctcaactgagctgtcagaaggaaggctttttacatcctgtcgcaacaagtccatgtgtttagattaaaattgataactgaaaaaatacataaaaactgcatcatagtttgaatgtaaagactgggaattaaaacttcatttggcaggtatgttacaatatgctcagatgtcaacattagaagatgggtagctgggacactaaatgtagggagaccattttttttctttttgtatgtgttatgctgagggctaagccttgagttcaagacaagaaggagctagatgagatggtaggatattcagaggaagaggtgataaaatatgaggacctatcatataaaaagagaatcttagaaagatgggctggcagattgtatctgtcacacagcactgccccagatagtctggttctatctatagcttagtgtatgaacatcttgtggcgaggcaaaggctgcaaactatacttcctcaattgtgttgcacatcttccgaactttatattttggatattaagatacttcttattacctttggacacacccagtgtgaatttttccccctccttgaaaagcagttagtaaatcaacggtgcctattctaattgatggcactgtgttatcaaggtttaacataaaacgcacattattactgtatttcagttttgccttaaaatagttattttaattgcaattaagaaaaacagtccagagtataaattacatttaaatattaaaaacaccatgaatattattcagcacgcacatacattgccctaagtaaataatcacaggagatgagtcagcctccagaggtctaagcaaattatgaatgcattcatcactacttcctgagatctctgataaatgtgtttctcttttaagtgctggaaggatacaaataaatgagaaaagggcaatctcttggaccggggatacgtgggcatacatggctggagttcagaaaaagacaggatggacacacttcatttgaataaggcagaatgtgatgaatcatggcaggtgttttggagtgtctgaggagagatgctcattgcttcttggggcatcaggtagaacttggagaaagataaagcatttaagatgagcctgggaggatgggtaccaatgtagataaaatggatgaattccagtatgagaggctgtgtgtgtaactggggcaaagggtgaattgtttagatgtccaggagtggtagaggcacattacctactcctggtataggaagatacttcagaggagggagtatctgaggtgagccacatatctttgtgttgtgtacataagtgagaaactggaaagaatccctgtgtgttcaggaacagaggcaggacagtgtcactggaaggaaggtcatgggtgatagtaactaccctgggaagcttggaggaattattattatcttactggacattgtgtgcgccacatgatgatatgcagcatcactggtcctgatgtagaagccaagctgagcacaataaagctcgggtcggctcaatgatgtagcttaatcagcagtgtaaggacctgtgttcctccctctggccttcctcattcctaagaaggcatgtgaaagggtacatgcacagggacatgtggctaggaaaggctataggccaaacggcagaggagttacaaaagatgtgaagaaatctgaacttaattctgcagctgaaaatgatgtaattttctgcacttgaaaaatcatgtgacctccccaccattgttagcgtactagaattataccataatggtcttagtaatatggtggcagggaaacttaggttgttgagtctagggaacctctgaacccttaattttattgtactgctttgcattgccaaagactcttctgcccatcattatttgatactcataataatgccgcatctctctctctattgagtatatgaagaaacatcccaaatgacaatggtcttgcaaaagtccttcaggtggtaggtggtgggacaagggaagtagtaactgttcagaagcctacataactgctgttatcttcttgttcttgagttcactggttttatctcatcaaatttctctttgctatcagtcatacaaatgggcatgcatatggcctagtttgctctggaaaaaatctccagtgcagaaaatggtgtccttattaagtgaagaaatgggccactctggctggccccttgatccctagtatctaaagtacaaggacatttcctagacttttcacaaacattttgcttctcccacctacgccctctgatttcaaagtcaaatttgtagcattgcttggttaaagaaaaagtgtcactcacatttttgcattgatcaccactcaccatgtattgtttgtaacatttcaatcccttccattatattttgagtcaatgtcctggcataccaggctatgccaggactgaagggcatgttccacttttaatgtcatcttgtctctaaagagtagtaatagatcgtatactatgctacatattaatcaaacatagtggctgaaaccaacagaaagtcagtctctgacagtctggaggctgcaagtctaaaatccagccactacttcactgtgattgaacagaattcttccatggctcttcctcgtttgtggtgatgagcatccaacctcagtgtttcttggtgtgcaagtacaaagcttcaacttcaaaatctgcttctgtggtcacattggattcttctctactgataaaatcattagacccattggactaaagcctattctaatgatgtcatcttatcatcataccatctacaaagacttattttaaatgtatccagtcttacagctattaagggttaggatttcagactttaaaaaaaaaactttatattttcactagagtcttaaagtcatgaggacaagggtcatatttcccatcttctcaagattagcacaattgttaggtaacagaattgtagcatagtttacttgttcactattggaatgtaaccttggctgtcctaggtcctagttgtgtacccttgagcaagtgggttagacacagcaaacttttctggaaaaggagcaatatagtactatccttgcagttagcatgagattaagaacatctggaagatgcctgcctcttgttatgagtattcaagtaggaaatgcttatagagttctgtagaaggagactgtgtgatgtactgagagttctaccactaaaccactgtctttggttttcacctgtaagtaaaaaatgttctgtgaggtgactctgaagtttcttctactctgcatcttgtaaatttattttcttgttcctttaagtgacagagggcaagggaatgagagtgagcaagtgagagattactgattgtatgtaattttggagattctaatacggattcatggaaagacacattgttagtttatgtctcatgcatagtactttgtgctatctctatttaacctactatttctagttattagaatctaagaactatttcttgttcctttaagtcaggctttgtattagctaaggaatgatagaaatgaatcaatatactgtttttcgttgtattgcatttaaatctcaaaacaaccgagattttatatctatttaaaattgtaaataggctagggtagaaataaaataaaggattctggttttcttagaagttaccttcttgcccatctgtagctccttctgctacgcacacacacacacacacacacttctagattatgaaaacaaaactggaggagctgacccacactccatcagtttctgtgtgctgaccctctttgctgattcacttaccatgttcaaagacatcctctacaggtggcagagtgactcccagcagcagatggggagcagattggagggaggactatttggagaactctaagggaaagcttcctgggagctggtccttttggatgtggtttaacatcttcctccatccaattgggttgaacccgtgcctctttagtttcatttgagctggcatttgaatggagagagaagacaagtgaactaggattgggggcaacaaccttgaggaacaaagaaggagtgcataagctccctacaggagctgccttctgtgcaggggacagaagagcggtcacaatgactggctgagaagatgtggcatgacgtagggtagctaccagaacaagcaggagcaggaagagtggactaatggggaaaccacccagacttcaccaaagtattttgttattccaagtgtcttatacaatttcagttcccaagcaggcctctagctttctaagaaagactttcccaattctgcagggttaactgcccacactcaagtgaaagggcaaggttatgtaaaaggtgagccttagagggagagacaggggaagaggaaagacccccatgccacttaagacactgacagcataatgtcctacagaactgtttctgccacaatctttttcacagctgaagcagggagaaatgagactggaactattatgaagtgctcagtgatgtttctctgtaataagcaagtggatggacatggaagaacatctatttttatacttgaagaagacagagttaacttaccagattacttcaagaagagttgatcttgataaggcctctgattaatttagggttctctagggtgattttatgattcacccatagctttgtgagcaagtgaactgaacatgaatatgttagaaaattgttttcttatttatatattgaaaatatggttcattattatttactttagggttaaagtttttcctctttgttgctttaataggtattaataactctggtcatatgcttggtgcttcatagtgtagtttcaaggagctttaatgagccacctctgttatttctcttccttgaactgtctactctctagagaaagcctttctctataattttaggttacctttttctgaagatgaacactctcttttggagaatggtatctaattcccattgattcagggaaaatggaaacgcccaaaccagtcactagaaccagctgataatggcattcaagatttggctcagtgagtaagagtggtggccacctttctagactactggaattcagatttcagcacccatgattggccattcaaaaccttcagttccaggagatttgacacctttttctggaacctgcataaaagcaagtgtacacatggactccagtgtataccccacacccctatatatcacatcttaatacaaatttaaaagaaatactaaaagcaactagataatctttatacttaaaaaagaaaataagtaattttctgaaatgaaatttaccttctgcagattcaaatacacaacagtccactttcacctatgtagctctgactcattacttatgtccagggagtcaaagaaaaaattttggtgcaaataaagaccaaggccaaaactttaaaagaaaaatgtgtaagtgaaccaacaaaatgaaactaaatgctatagtagtttataaatccaaacaaaccttgaacaaataatgtcaccaagccagaatgaaaaccaaatcaattgttgcagaaatctcttccatgtccatgtgaacgactagattttctaaaatttattttattttattttgagctaagaggcatggctcccagaaggaacaagcctgaatcaaaagtgggggtcaaagcatgtccaaacctcagaaatctcactgtgagattggcaggagtaggatcttgtcctctccccaccacccacccctaaccccccaaccctactccatacctgcatgtcttggtgcatgtagccctgtgcaggggtgggggtgagccctttgcctcacaagaggaagtcacttagctgggtaaacttcttttacccttataaggtcatatccagcagcacctggaattcctcctcatgcaagtgaggcattcccagcccccaaccccagccaatgatggccactcatgctgagagcccctattcacccccaaaggcttaagtagctcctctctaacaaactgaaacagttcttcaaagctgttggttccctgcacactcaccactgaagaccaagatcctgcctgcacccacctgcctggccatgcttccttccctccagtccagcctgctgtgcaatgagcctggttgcccagagggggaagcagacatggggtgacaaggaggagtgcagaaatgttacaagaactggctctaacagtactttgtgagtacatctgtttgagttaactacagggactgcacgttttctagctttacactctgggagggtgatgagagactctgctgcacatgtggacactgggtagttgacaggcaagttcatagggaacttaggttgtttcctttgaagggttcccttctgagttcttactacttaaaaccaaactcagcagtaatagctgattttgtatagtatgttaaacatagacgcttacgtctgttccttctaaatgccatgtttatatacgtggagactgagcatacatgaatcctatgtagagtgtgtgaatcagctcaggctgctggaaaatagacaaagcgtaacaagtcccatagtataggacgcaccattcactggttggctgtacacacaagacatttgtattttcaggatcctggaggcttccaagtccaagatcaaagtgcagaatgattcatctggaatatcctcctaccttcagacggctgctccctcgtgtcctcacgtggaaagagacatctctgatgtcttttagaaggatatacagtcccttagatcacggcgcagccctttgacctcatctaaccttgactacctctttatccaatagcagtctacactggaagttagggcattaacatattcacactgtgaaacacatattaatctgtattcttaaagcagagccaggattagaatctcgaagcctctgtcagaccagaggaatcaatattcttggtattttcatggacggttaggatggttaacaggttggccacagtttcttgaagaacttatcattccccctgttttctggactcagcacatcctgtttacctgcctctactaaatcttcccatgcccattagggtttacttcattcatactaaagatggatttctataaataaacaaaatgcttcattcatataagaagaatacttgccccaaacaatggaaagtaaatttttggaaaacgtggcacaggcttttaaagaattctgttcccacactcagattacccttgaaggaggaacaagataacccctctggaatacgatatgactctctctctctctctctcttctctctctgtgtgtgtgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactgtcgtgagtgtatctgactatgacccacatgtggtatttagatcttaaagagatgatctgaagaagtctgacgggcctctttagaaagtagaatgcagaaggaacgtcaaatctgtcctttctgtcctatggacactgaaggacacctcagacctgcatggtagacagattgagcagattgtctactgtatccccttctcacagtaatgaagaggctgagaggggatggaaggtaaatcctagaggggaaaaaagcccacaacttctaaaaacctacacagtcacacactgctgtaagtcaacaatttggtgtctgaaagcttcgttgtcattgaagatgagtcattttatcacagatgacactactgatcgggatattattcaaagtgtgtagtaagtggcacgatgcaggcctcaagaatcagaagagagacccgaaccatcatggttggccagttcgtaaatacattcatgggtgtggcctgactgatgtgtatgggcagggagcagatgtgcctttgtttttttttaatactagtggaatataaatgtaaatgtagttattgaaagagtcagcttgttaggtgcattttatggcatatagtgaaacatgcttccagtcaatcattaatgtctgcaatctacagactaatacctcataacactgaatttgtacagttactgttttcatctatagaacttggcttgattcaatgtttgcaagtattaacacatttacctgactgtaaaattcctagaggaaaaaaaatattgttaagctaccaaagttaccagcactttcttttgaattacacatatctgccccctagaaggatgtgtgcttgtaatctccaacttagattttatatgttttaagggacatcgtcttctttctattcttattcagttccaacagtaaggagtcatgctgtgttagagcgttaccgttctccgatccggcttcctcttttcattaattctgacgactttatgactcacacttggccagttctgcttgggttgaacccacttcgagttctagtgcacgcattccattctagctcggagcttttctaattcttgtaaactctagtagtgaccttccaaacgacttttacgtgcgtgtttgacttctgtgctatttaaaacttctcctttttatttttgctttgattctgccttttacgtactttcctgcttctgggtgaaacccgttatcttcaactacttgaaaaatacaaaatttaaaaaataaaaaaagcaactgttttcaagtccctccccccaccgtgatggcacactgccacaggaaccatcctgtgttatctcagcttgactacccccttctttcccactgctttcttcccccctaaagttgtaggtatgagtagccccagatacgaacaatgttctgcactaaatacgctgcctttccttcccctccccgttatgttcttataaagctgatgggtaattgcggtaagaataaagcggcataaaggcaattaggtgaatgtcaaacggctacagctctagggacagaatgcatttttgatgaactttaatgaggtagagggaggaacaccacaaggactttaccagagaacaacctggccagcacctgtgacatttacagccaaaagagtgagtgagggcacagtctgttaagtgcacgggggtgctaatattaaatgagcaaacgggtaggaagcaaatgagcgaacttgaacaaagttgttttcttttcttttctttctctggaaaattctgttttgagtacccgtagccatagagtatcaaactctatgttccggctgtttgagggaggaaaagtacactgatttttttctttttctttttttttttttaattgtagaaaaggaacgcaaggttctctcaggagcactggagagtaggagtgacctcctctataggctttgtgcaacagtgtctcaaaccacagcagtcacatgggttctgttggctttgctactttttcgactgcgagtcagagggctgtgcatttcgcttcctccctcctgcaaggccagggaaccatgtgttggcgggattaatctttgcccacaatgtctctgcaaaggtttctgcagcggcagggcagcaatggcaatttggagtactgtgctgactctgcctacggctcctactccgtcctcacgggccagctcacgatggaagacaaccgaaggattcaagtgctggcagacactgtagctactttgccccggggacgaaagcaggtaaggttgctgcgctgtctagagtattcatgtttgcctgacctctgctgaaagtggtacccgctcctgcgtgtctctgttaactttgactaccagccttattccccgtgcttaggagtcatttcagttcttattcaaaggagagttcttttccctgaggagaacctctgtctactacccaattaacttaggagttaatgactgagagtacatgtgaggggggaggtgacatgtctaccaaagatagtatcacagttgaaggatagaaaaacagtcacttttttttttaaaagtaagactcaaatatttatcttcatttaaagatgtgctcaggtaaaatgaaagttgttgagaacaacgaacgtgaaggtcgtttacaggtacacaacccacacgatcaacactcctccgtttgtgtgtctgttcattgtctccctctgggcttacctccaggccccgtcagttcacaatcgagagaagacttctccttgaacactacctctgtcagccaagtgaattcttcagtcctggagcaatgatagaaccttgggctattgggaagtaggacttttgcggggaggtgaacgttggttagaaacccagctgggctgcttggtagctgtggcatacagagcaagttggtagctgcccccctcacattatgtctttctgaaaaggaagctatcaaactaaactccattcacttgattaggtaacagcagaaacaacttccttgaaccctctgccctttaagtaaggaaatgtacagggcactctgcactcaataaaggctgttcgaaaatttttatgaaatgtctttagagatgaaaactcaactggaaaagtatgtgtctagtgaatttgttctgaatctttggtcttccatttgtaatacataagaatgaactatataccactttatgtattttgatcatatacttttctataaggtccaaggtgtgtatttgaatttatataaacagtcatgcacaagatgtttagaactgacttaaaacacagctttgtggcttactacattgtgcatattgtgttctcctctgagctcatctaacttcagcattacaaagttgaagcgtaggggagagtcaggacctgatgtggtgagtggattccttggcattttccacagtgatgaagctcatttgctagtagttgattgtcattctcaatccaacgtgtttttataatacaaagtttggtgaacatctgtatcgatttataaatgggcaacacaggaaacgccaacgggtttactcagattctaaacagagagcagtctgtttctctttctatttgctacaaagccattacaccaaattctgatcatttgctatcctactatttgttctcggcatatattacttaccaggaaaaatactgttaataactgcaccacggagggaatctttccagatcttgttctcagctcaggctttacacggtgccagtccctgccaggtaaatcaaactatatgtcagccctgagggctggagaagggttagcattaggggacagtttgagcaggtgtatatgtaatatgtctccataaactgtcttaggcttcctaagcatgggaatccctaatgtggggacacagactctggtgtgtcaggaaaatccagtgtgtgcctgtgagagttgagaggaggggcagcatgtggccagtttccttgagaaaatagtgcagttggttcttgctatccacagagcattggttccaaaactaccatctttgaaaatcaaagaccagagatgttggactccctgatataaaatggcagcatatttgcctataaactactaagaccatgtctaatacctaagacaatatcacttgctatgtgagtagctgtcacattatagcatttagatactgagggttgaaaagaaacatacacatgttcagtacagaacatgccatgtgtttcatttctatggagtattttcatcatcagatggttcaatagacagattcagaactatgatttgaccagcacctatagccattgaataattggtttgagatattgtggattttaggaagttcgttctagaaatgagacaagtaggtggaggaacttttactgtagttggtgaaggagtagacgaggcaatggagagaaacggtaaagacttggtgatcaacagcagtaagaaccaaggagatacagctggcttttaagcctgagtttagatagtacaaagtggaaaaggacagtaagaaggactggatgggtattaaaggggaccgtagagggatttatgaatataaaatgtgtgagcacacagacttgctatgccatccacttatgtacgggccctgttgtatttcttccctttctcctctcatacattcaaacacactgtgtgatgtacttcccctatccttgaaaccttttcttacttttctatttcccaaaggggaaaaaaacaaaacaaaaacaaaaagaaaccaaacattttgggcatagactcctataatccctttcagtgaatcttcacaaaggtatatgtcaagattttataatttcccacagggattattgcctcctattaattatttcttagaaaaacaaacagacaagcaaacaacaataacaaaaacagcagcccacccctctggccctgtgtgaatggtctgtaccaggatctcagtgaggcaattgcggtaacaggtgttcctctgtctgctgttattctcactactctgagggtgacgtcagtgttcatacttcttgttgtcgtggctttggcttctgcaaagctataactggctagcttgtagcttcagcttaattttcaggatccactggttgtttgcactcagagttgtttaaaaatagatctctctctctctctctctctctctctgtgtgtgtgtgtattatttcagtacctgcatttgtagaagtgccagacacaccaagaatgcttctaattttgaaacttggtttttttttttaaagtggggggggggcaaagtccctgcaatataaactcttgagggagggtgttgcgaggaaagggaagttttataaccatgccatgccctaggggtaggtattgtgcctgactgcctctcccaggagactgtactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcctagtacctcatcaataggcaacatcaatactgtggtgttatgtctgggttaatacccaaccattctttaagatgtatttatttgagttcatgagtacactgttgctgtcttcagagacagcaggagagggtaccacatcccatttcaggtggttgggagccaccatgtcattgttaggaatggaactcaggacctctggaagagcagtcagtgctcttaactgctgagccatctctccagcccttcaaccattctttaaaagaggtgcggggctgtgatcagaccttcctgtaagctgggacaacccatttacgggagtatgggtcagataagtgtgacgtcgactttactttcgttattttgttgtgtctttggatagtttgataatcctttctgtcttaatggtctgactttcaaaagtaggggagagctgtattcatgaaacagctgggagtaaaagtgagataagcaggcaactgggaagagtcaaggacataacttgaaacaaagtacttaaaaaaaaaaaaagaaaagaaaaaaaaaaaggaagagaaaaaaaggcccacttccgaatctgtaccctctccttaccacacctacattttgtgtgtgtgtgtgtgtgtgtgtgtgtgtgtgtgtgtggtggggggtggtgggggggtggcgggaagtgagttcacagaacccgggcgagaacataacagtctaacctagcaacaaaaatgacttcagtgttggtctctgagctgctctgtggcaggttatccatcaagctgtgtttccgatttccttctattttgcacactgacagctgctgtatttggtcttgattttgcactaaagagagacccgtgaatcacactgcatagcaggagacatggtgtgtggaatattaatgctttgtctcttaagttgtctcactgaaagcagaggaacttctctaagatcagccccagacaccaggctcctggctagtgagtagataaggagcctcctgtactgtagtcagagcccaatgtgtagctttcaagcctgccaaattgctaaacctagacttctcatattagataatgtgtaataaaagacagctgttgtcagcatatgctgtaaattgcacaccagttctccattcatgaatttgggggcggggtttggggcatcattacaactcagaagaactctggctgggagggcagtctggggcacacctactccatccaagtctacatctttaaatagggctggtgcatgctagggagagggagatggggaaagcttgattcagaagtcttgggcacactccgagtaagacaggcagtttagcaggcgagcaaggcagaagcttgagagtttcttttagctcatcccagataaaaattaagaggacactgtgtcaagatgtgcccgatccctgcctgggagtggtggcatatgcctttaattccagcacttgggaggcagaggcaggcagatttctgagttccaggccagcctggtctagagagtgagttccaggacagccaggactacacagagaagtcctgcctcaaaaacaaacaaacaagcaaacaaatgagcaagatgtaactgttccctcccacccccatcagagagtatgatggtagctattgtatttaaattgcttttttatttatatgttcattgcttaaaatagcctatttgctaatccataatggaaggtaatttataatctgatttagtttgaacttttgtgtcactgataacccaaacaaatgagtagcaggagtgctccaccgttgccttaatattcacttttagtcagagagctacacagaactgttaaaaagggggaagctaggggcaccctcttctgtatagagaaacctgtttggtggacctagaagattatagacttaaatctatgcaaaataaccagtcacttaagaggcacagtgaagaactcttgagacttccaacaattctataaatactgggcaaggaaaaggacttttaacattatggtagccagacattttattaattcttgccacctgtttgatttgtgaggactaattacatctctccaaaattcattcatttagcattagttttatttgttttccttagctctctttttatactacttgatttttgagtagtttcttaccatcctgttggtttcttttggtcttttctatactatattttagattttattttttttcttttaaaaaatcacccttggagctgggcatgatggcgaacgcctataatcccagcacttgggaggcagaggcaggcagatttctgagttcgaggtcagcctggtctacaaagtgagttccaggacagccagagctatacagagaaccctatctcaaaaaaccaaaaaaaaaaaaaaaaaaattacccttggattttttcccctaagaacatttagtttaacgaaggacaaagttagagagggatcttagcacatcacattgaactgaatgcctcaccgacagtcacttgcagatggcatctgaggcttagtctgtctgtctgttttactatttttaaagtcataatctacccttggcctctcgtgaagcactggggtggaaagtaaaagctgtgtatttccccagagtctcaaagcatacagatggctatctgcagaagtgaagcactccatcaaatacactctatgcccttcatatacatgccctcgtgtagacacatacacgcctctagatgaatgataagggaatgatgtacaaaccacaatagcaagagcaacgttttaaaaacataaagtccttagcggtggttataatgaacagaattaaagacagctgaaacaagtacctgaaaatatgtgaattagctgtgaaatacaaggaaatgccaataatgaaaacagattaagaaaatctgagcacacaatagggtgagatggacaatgcttgcaaatacaccttttaaaaagacctttcacaaggatggagccttcagatggagccttctgacttaactgaaagttcccactcttgttaatctctccccccgcccccctgtgtgtgtgtgtgtgtgggggggtacattcagtaatttaggcacaaaaccagattattgtaaaccattccaattgctgtaggtatcccataattagtccttataaatcaaaagccgaaacttattacgagccgagatgataattttaggtctgagcccttctgcttgagattccaggtataactgacaaaagaacacagagcaattgttacgtataaaatctgtggatgactacacttctccgatacgtatagtgactggtggctgaattcttaacactgaggcatcccagaaaattgtgcaattgttggcatttggtggctggcaattgagtaacacagatttctgtggaacttgtcctgtatgcattaatttctcctgtgtattttccatgtgtgcttttatccccacatcatttttatttatctgtaccaactgcccggatccactattttatttatttgcttatgaatgacaattgcaggaagttggcatttagacaccatggcttattggcagaaaagatggcccctcattaagatcacttgtgctcttgtagaagagctatattcaatttcccatgcgtttatggaagcttacaacaggtagcccttaatttggtaacctcttctgaccttgcagacatcagtcaccacataacatatgtgtgtgtgtgtaacaaaaccttttaaaatataattaggagcaaaagttatgtcttgagtccttggaacagtgtttaagaaaggactaattaatagctaacatctattaaatatttctttaacaaacctacaacattgttagaaattgaccgcagtccttacaactaaggtcttcccttttgctgaccccctctctttataagagtctggcttgaccctggaagcttatgcttatatgacttttcccaaaatgtgcagaagagtgaacgttatgttatttatagcattatgaagtttcttccctttcttggcaggaaatcttactatattcttccaaaactattgtgaaataagtcataatcgaaattgaggtttggagtccctcccttgcctttcctaatctattttttattttctaacctatttgtgcttgggtggtggtgttgggaactgagtgagtgtcactgtgtgtgtacgtgcatgcaatgctgtgcgtgaggaagtcagaggacaaactgcagtcggttctcccctctcaccaatcaaacctgggtagtatctttacccactgagccatcttgccagccatcttcaataatatttttatatgtaagctcgttctttacatattttcttagcctacaaagagtaacacactgaaccgttataaacataagcatttcatcagtgttttaaagagtatgggctgcatggttttcatattattctatgtaggtgtttcagtgtggttataaattgctaattttgagaagtagacataaatgcaacttaggtgtaaagtccttgctggacgtttgaggtctgcgacatgatatgaacccccaccaccctagtatcttactatttgatcttttcctcatcttctcaacagaatgtctggagtccctgttctctcagactctcctttgctgttaaaagagagtggacattactaatcttatctaaaagggtttccaggataatgagaaagaacgtcctttgtaatgcagagcagttgcacacatgtcttaaagaccttgctttttatatttttcagcttgcgttggccagatcaagctctttgggtgatttttcctggtctcaaaggtaaagagattcattttttccctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccttcccttcccttcccttcccttcccttcccttcccttcccttcccttccctttctctgcctgagataagtgcaacacacacacacacacacacacacatacacacactcactcacacattgctaacctatactacaattgtagaaatgaaagctaattttcattgtaacagttattgttaatattaaaatatgctaaatactatattttaatatctatgctctttatttatttttacttgcaggaaggttgttactgtggaaaagcaggacaatggaacatttggatttgaaattcaggtgggcagtttttaaacattttagatttatttccaaaggaaaaacaggcactaattccatcatgatatttgtaaggaacaatgaagtcagggtagggttaggatgacagtggagactagattttatttagtatgtggttgtttgttcagtgtgttgagtattatggggagagaaaatgttggagcttatatttctctagagatgcagcttgctccttatgcatcactctggtcttccttaaggagaactccaaacaaaggtgcttgatatttctggatcttaaataagaaagcaaaaggcatttacagaagtttattttcatataatcatattcttgtattgtatgtaaatcagattctaaacacttgagttgggcatggtggttcacagctttaatcccagcacttgggaggcagaggcagggagttccaggctagccaagactacactatgagaccctgtttcaaaacaaacaaacaaacaaacaaacaaatacttgccagatggtatatctgtgtatatagactccaataatgttacaattgagaccagtttttttttttggaggggggtatagtgagaaatttatcacacacacacacacacacacacacaccccataattacagtttattacttgaaaaccattggtgaaaattagtactggtcttcataggtttcaatgtagctgtccaagaatatctgttgcctgtcttttcgtaattatatttgagaagatggagtcacgtggactgtagtctgattgagtggaacaacttaagtctcatttcccccacattgtttctgcatttctttcccacgtgctttgcataatcgtattcttatgctgtatgtcagagtttaggtcttcgtcaatgaatgctgctttaagaaaactttgctatgatagcaaccccatgaaagggaacttggttgtattttaagagcaggagcaggaagctgctacattaaatgtgtttcatgagtaaagaaacaacatggaacgaacggggaagtagtgggggcagaggtttctgctttctgagctccattcctctaaaatgtggtgcaatctataatttaccataaaatcattgggacataattttttaccaaaagaaatgtgctaaatctatcagattttagaagtacaggcccctcacaagagagccatttgactttctctgaagataactgtatgtccactccagcctcttcaaggttgactagaggtagtaactgcatgcctatcactgatagcttctgtttctccctcaccacaagtgtgtgtgtgtgtgtgtgtgtgtgtgtgtgtgtgtgtagaatcaaagtgaaaaatcatctttactagaggacagaccacagaaccgtgaaaccttaggagttcagagagacctgatggcttcacctctgagctacagcgcctatatgtcatctcagggacgcttgagacaatttctttctgagccaacagaacacaaggatgggagatgtgggtgggtgatatggtcatattatttgaccaagtattcttttctgtgccttcatggcttctggtttcccccttttaactctaacccccaaattcacagctgctctgcaatgtgcagttgtacataaatcggagtgtttcttttgctctgtgctcactttgatacctaggcacgggaggtgggtttttctgttgatgtggattgctataacagtgacttctaaaaggttttcagtcagttttcggctcttgcggcacatgaattaaattggcttctatttctacaaggagctgagctctggtctgaggcaagaaattatcacaaaaggtttctgattcaggtggaacacatgttataggccacttaaagttcctcttcctttcaaatagaagattctaaatgtactacgtctgagtagaaatcagcatttaacagaatccagtgactagctctgggaatatctgtgtgtgactgatcatcctgtctcaggtgtggagtcctctagaagaaagcagcactctgatgtagctcagcttttagcagtcagatttgaaaggataactcgaaacactgattttttttttcagagttacaaaatttttatacagagcaaatgtttccctagtgtttttatacacttcgaagtaaaaaccaaaaacaccaacaatagaactcactgaattatttgtgtcaaactgagacatctggggaagcatctctctctctctctctctctctctctctctctctctaattcatttagttggatggttgaagaactgatgagagagaattcagggcaggaggggtctgtgtgctcagaagtgaaattgactgagtcaattagaacaaacctagggcagattgtcattatttgcagaactctgatttaatataattactgttggcccatctccctgctgggtattttctatctcatactctctcccccaatgcctgttttagcctggaacacccacaaggatcgttttcttccacttggctatggttgtttcatcccttttagaattaagactcttaattttttttcttaataaatgcacagtgaaatcatcaggtggtctcttaggcttgtaaacagaacatcttgagacactcacatcccactttctttctcataccggatgttttatgaatggagttggctgttgatgatctggtgggattgcaaaattggtaacttccattcagtgtatgtcgagaaaagcttttctaaagttgtcctttgccctaacctatcatgccatggttttaggttttgaccaatatttgttgaccttttggaaaagttactatgtatccacttatattttatagacctacagactccagaaccagaacatctgttcctcagaagtgtgcactatgatctgcaaagtgcaggaagacagccccgctcactgtgctggcctgcaagttggtaatgtagctccgctcatactagacgtcattaaatacctaaagcctctttgatagcgaaggttaggaagcagttgctgctttggattttcttgagtgacactgtggtttgggagcgtgcttgttttccctcatttccatgttgtggggattgtttacgtagctaataaaacattcatttctctgggcatcccacaggtgacatctttgcaaatgtcaatggtgtgagcacagaaggctttactcacaaacaagtggttgacctgatccgatcatcaggaaatctgctaacgtaaatatccacttagttgctgtggggtttcaaagatgttttggtgtctgggaatacctgacaagtgggtggcttgtctggttttgtagacattatttgtctgtggtgcacaagaatgcagcatacacagcggtggggtatggacatttttattggcccctttgtttcccagggtttcatgagtcaacatctgaagtcaggagacactagacaaaagtccttgtgggagggacatcaattgctaatgtatttttaatgtcaattcaataaaactggcacacatttctttggaccaagagaaattggtcctattctcacagttcatgaaatctttgagctacaatgttttttcccctctctcatatgcctcaaacctcttgatttttttccctctgtcactgttttataagagataatgaaatgttcccaccttggagcatatatagtcatagacactaatattcaatttatcagaaggacattggtcttcccagctactcaaagggtttaatctttgagactgatcttaacaatctcaagaaagtatatctacaaacacacccagtattatccacaaagtgataactatctaagaaaatagacaccatcggatttccttcactgtgtactaaggacccaacaggaccttaataatcagttgtagggcaattcattattgcataaaaatcatatgtactgagcaaatattaaatttttaaatctctgtgtgtattctaagaaggcaacaaaaaacactgtagaactctaaaaaccatagaagatttctaagaaaagcctgaaatttcaaaaattacagttattgataaccactataggaaaagtagatagtgtcacaggggagtctactgaggaagacagtagccagttgagctgagatgttcaaggtgctccattcactctgaggaagtactgttggagctgagaccagagggaaggaatggccatttgaactcctcgtgggaacatggacgtaaagaaaaatatctttgaggcctggaaatggatttggcatatcctaaggatgaactgaaccaggctggtggattagcgagactgtatgagtggtgaagtcaccgttggccaagcatcagattatgagatgcattgctgttccagggtgtttggatttagtccagagttgggtggtttcaacattacctaataaatttttcttcacagactctttgtcagtccaggtttattcctttatatagatgaagtacctggggctaaagaggggttagttgaattcagcccggtagtgagtgacactgggacccagtctgctgaggatgtcaggactggctttttccagttacagctgtgcatagtgagctgccagtagaatctactagaatctttcttcatgggtacttcaaaggaagtgttaggtgggtgattgaaatgaggcagattttaaatgccctttgaggtttaaggcataaaagttaggaaagctttgtctcaaagaaaccatgttaaatccaagagataacattattggttagagtcagaaaaatatgtcccatgtaaatgaagcaagaagaccatgtgtcaataagggtagaaatggtccttagaaacccacagaggggtaaaatatgagacaaggtgacaaaatactgaagggtctctcatctcaacacttgtgcacatcattggttagacagcttagaacaacaccatgagtctaatgcgaattcttagtgaggctattgtccaaaactaacatcatctcaatcagaaatcacacagcttttgctgtactgtcatcttattatgttgggtctgagactggaagaaaagagaaaatgtgatttcacatttagaactcctaccatatctttaaatttttctcatgctttcataaatataactataatttagttgtcaaaaaatttagaacaaatactttgaaatgtttaagaatatgatttccaaggtgaaattaactaccatcctcaggtggaagatttgtagtcaaaacaatgctcaaaacaaaccgactccaaagagaataaaccttctatttttagaaaactatgatgtagaaagagaagaacattgttaaaccagttattctagatggccatttgtaaactaaactatttcatttgatgaaatagccatacattattgcagaaaatcttccctgtttcaagaaataacacatcgagttcactgttgctgaaatcctgtgtactgtttgttttttattgacatacaacctggcttatagtagattcccagtgaatgtttaccaaataactgagattgttgagcctgtccaggcaagagtagattctggtggatagcaacatagtgtcttagtgccatagtgccatagtgccattagcacacagtgccttctagaaaatgagctatggtttataactagccaggatctttccctccacacttggccaggcttctttccccctttcttattccccactgttgttcagaaatttggcataggttcagatactcaagtatccacactccatagtcaagagcctcagaaagggtgacatttatgctgcatttctggtatagactactctccacttgcagggcttcttaaggatggtacctgtttgaaggatagttctgttgtttaccccacctttcccttctcttcaaacaggatagagactcttaatggaacaatgattcacagaagagcagaacttgaagcaaaactgcagactttaaaggtaacttgacttaacacagcacgtcagttttcatccatgaatgtgtgagtagaataatgatctatcttgaaaactgagatagcccttgaaggggaaatgtcaggatgcatctaagctaccgacgggtcaaggaccacagaattacctttgtaggaatatctaagactgtgaaaatgtgtaaatcaccctcttccttccccattcagagtctatggggctcagaaagccagcgggacggcatattacctgaagagctagtcattgacgcacctgtgatcactcttgatttacattttgttgaaggagcaaaacagaggaagaggtagccttgagtgctgcagagagctggcgggcccacacttctgctttcccagtctcctttgcctcttttccttctgcgccattctgaaaatggactatctaccactaacactgtggctgtccttgaatccgctttcatgggcaaacacattactaccttgaaagggaaggaaaaggtcactagggacagtgcctaaagctcaggatgaattctctggcatgcctctttgaaggttttcaaaatttcagttctctatgttggtgagccttccaggctatgcactccagacacttctggagtgagtttgaaggtgctctgactcctcccagtttccagtactgtcccctgcaggacaatgaagctgccagctactcggagatagcttgactacaggcaagcaacttacttgtatttggtaacagtctgaattcattactttttctcatgaaatacactcataaattactgatttcaagaggacaattcactgtatttacattttatcaagaacctttccctcctaccatatttattcactagcaagcctcactaatattacctttgatacttttgacatagtgcccattccccatgatttttaatttctatttaaaataaaatcattaagaatcccttctatccaaactttgataggaattaaagtttgtttataagataagtgagaacagttgaaatctttgtggctctcatttgaatatgtttttcatttttatttagcacttcatatactctagaataattttcttcatgtgttttcgaatacattctctagctaaagaaggataatcctttttattttaagttttgccttttagctcagttattcatctaatttacttttcttctcttatagcattggctaggatcttcagtctattgtaaactgttgtattactcgtgacttaaaggactgcttctgaaatctatataaaatttcaatatctatattctcttctagaatataagtaggtccttagtatactttgaatgtctacttaagaactcatcttctcgactcttatttactacagagcatttcatcaattaaaacatatataacaagagatgttattataaacaacaagaaacaaaaacatatactaatgtggtccactgatgtgtgtgcattgccccttcattcaactctcctctgtgggcctttgttattactgcataatatttcattaaatgatgataactaaatctttccagaatagtccttatatttctttgctacttttgaagaagtgtcttctaggtaattgaaagtattttggtttatgggatccaagttttgtttccctacttttgtggagactttttatttatttgtttataaaagaacttctaaatatgggtcagttgtcagtcatctacattaaaacatttttcctaaaaatttagtttttttcctttttcatattgaagtctttaactcatccagagatattcttgtcatatactataaagtatgggataatttgagttttgtccatgcgcacaggcaattctcccagtataatttcttttgtgctttgcctttctccgcacctgacttgctgtgaaactcttattttaacaaagtctccatgtaagtccacatttgatctcagactctctaatatggccattttgatttttatctccaactcagtttgcaatagagagtgatacctaactgagcaatgttcttagtctgttgatcatctgtcaaattgtcaagttccatgagaaaatgcaagaggtttgattgacatttcattttatatagataactcagtgcctcaggtattaaatattacatggtatttcattttcttgctgctaggttttcttaaccatttttgctgttgttcttttcatctttcacaaaacctgataatttacacatacaggtcatattgggtttttttgttgtattgtcctttgtactttagcattttattatagttttttttctagagaaatatattttatggttagagaatagatattcatagattgtttgtatgctgttgataatagtcaagcactttgttaaaccacataatatctaccaagttgtttgtatgttatttggagtgctctactaggataataactggacaaaatggatctagttcccttctctgctgggccgtcttggtgaggactgtgcttaaggtgagggaaataatcttgcacccttactttgtcctttagtgggtctttaggctctttcactttctgaggcactgccagactgagttccagagtggttgtaccagtttgcaatcccaccaacaatagaggagtgttcctctttctccacatcctcaccagcatctgctgtcacctgagtttttgatcttagccattctgattggtgtgaggtggaatctcagggtcgttttgatttgcatttctctgatgactaaggacttaaggactttgaacatttctttaatggacatatgagattcttctgttctgaattctctgtttagttctgtaccctattttttaaattgctttatttattttttatttttttatttttggagtttaacttcttgagttctttatgtactttggatattagccctctgtcagatgcagggttagtaagggtttttttccccccagttttgtccattttgtcccattgagtgtccttgccttacagaagcttttcactttcatgaggttccatttatcaattgttgatcttagagcctgggctgttggtgttctgttcagaaactatgagttcaaggctttttcctactttctcttctattagattcagtgtatctgattttatgttgaagtccttgacccacttggacttgagttttgtgcaaggtgataaatatggctctattttcatcagtctacatacagaccagcagttagaccagtaccatttgttgaagatgctttcttttttatactgtatgttttttacttctttgtcaaagatcaagtgtccataggtgtgtgaaaatagccttgaatgacctacatatttgtttctaaggctcccttttaggtttagtgttaagtatatgacatgagctaggttgttcctctttttaaaactctggtagaatttttgtaataccatctgaatcatcaggacttggggttctttctggggggaatattttcaaaccatggctttagttctttattattagtaaagctactcagatgactttctggagcagttttagtaagttctgtgtctgtcaataaagtattctaattttcaaatatatttatataattgcctgattgcctgtaaaacttccattcttaaactttaatctcttctatagctgtcattttaatccttgttttaacttattctgttcatgctttctttttaccttcctgttgactttctaactacattatcctccctccatggtgtgtgtgtgtgtgtgtgtgtgtgtgtgtgtgtgtgtgcactcacgagcgtgcaagtgcgtatttatgtacatgcctgtgtgtctttccctctgtttcctgactactttttactacaacttaataaggtccagactcatacctcaattcatactgtctagatttggctctgatctttatatctatagacatgtgactctggctctgtgtactgtctttattacttcccacattatcttgtggacttccattagaaatatgttagggacttttgatttgccttccttaataatgacttcagtggcatccttgttacctgtattccatatagaatgtgttctttctaatgagcttttaaatgtgatttatactttattgacaagaggctcttttttgtaactgtctgttcatatttctctaaacatttttgtgcttatgaatattggtttttatctttccatcagaacttattgcactcttattttggtgcctgttttggattctttttgtctctgtgttgctgggagagatctatgccttgattagcagctcactgtctttcctgtcactgagcacctgaggatgctgtggacttgaaagttagcttcatctccatgggatggctgtgcagagccctccacacagggcatcaaagcttcccctccaggtccaggtccagcagcttggctgcctttctcagagagcaaatgcccagtgtggctcaggtcctgaagcattgctgtgcttctgtttgccaagatgcctccagctataagcagcttttatccgtctacttttcttagtacctgttattcagtcagggtttatttctcaacaaggacatttagctgagttcttagtattaaatagacaatttgaagacacgtattacctcagactctaaattcctaactaacacttgatgcttcaacatgacagctcttgaagttccattctgtttaccacctcatatttatgtctgacaagcagtcttggaattatgggataagtacttaatccctcagggcagaaatgactaggtctggcctaaaggcaggttgatttcccttttgcgtgatgacatttattttgcatcctatatatgtgagcattctattcacaaagatgcaaagactgtgcagagccccaatctctttgctggaggaattttgtcctttctgactacaggatttcctttatcttggcctatgcttcagatgctcagcacagatagtgaactcgttgaaagagctacttttaaatgtatctctgttacttgataggcctattatatactttgagaagtatttcatttcaatgaaattttattttctaacctataacaaagttatgaaaattagatgacatattatccgtaagagcaaaataaaaagattaagtgctggtatacttgctatttgtcttatgtagaatgaaaatcctggagccatacctggaaccaattcaccatgttacagcttagggttgtttaaagaagccgttttttgtgtactcatttaacaatattcaatcattccttcaactgccatgcaagcgtccatgtgtcatgtctagtgtcagtgtggtatcatgaagccagatacacatatgcttttaactctcatctgatatagaacatttagatgtgactaaatgtttaacaaccctgaataaaacaggaaaaaaaatctcagatttttaaacagtcactttgttacctctgctctttacactcaagtttccttagtataagtcatatcacacttaggtgactaggctagactagaaaatcagggatcataaaaccttcagtcacaaatgtgaactatttgaaaagctctgtccatgaacttttgaaagccaaattcagcaagataatattttttgtctttgtgtctttagttttgactaacatcttacctgtttcctttactccattctactggaggagataagtatcttgagcaaagaagaaatgtgtaggtccgtatgcgacctacacaggcttctgttcttggttttcccataactataaagttataggagaataagaggagtcactgacgcagccactcatcctataactactctaaagtgatattacagttcaggaaaacaaaaacaaaaacaaaacaaaataacaacaacaacaaaaaaaaaacctacccagaaaaacaaaacaccgacaactagaaaatgagctgagctaagcttttcactgctttcattgtttgattgaatattggcagccacagaaaggcttcagatactgctgtgagcatcctaagtgttctgcaggataaggaatgatctccactcctcctcatattcattcaatgatgttcttgagattttattttcttccccttcttccattttcttccattaaatgcacataaagaggattgcttttttttttccaactaggccatctttcttatgaataaatgtccttggcaagcctgagctgtggccacatggtggccttgctaccgggacctaaaatagcaaaggcaaggtgaagcagggggcaggaagccggaaggagagcgaacatagaacacctgcctttccagatggcttcttctcacttggctttgacttccattgacttggctagcctgtgggctggaccaggccaggccttctgtgctgagtgactgttcttatagtcaattctttttcatgctggtcacattcttttcgtttgtcacattcttttcgtttgctacagtagccaagggaagaagcagttttgaagtcaaggggtgaactggaggtacagctcagttggtagagttcttgcttgacatgcatcatgtcttgggattgctcccagaacctcataaatgacatggtggagcatgtacctgggaattagaagtgggagaatccaaagttcgatatcatcttcaactgcatagtgagatcaagagtctggcttagcctgagctacataagaggacatttcaaataagcaaagaaacaaagttaggacacttaagtattttctagatagatgtcaaataaaattttgtttcagagcccagacttattggttggtgatatttactaagcatttacaaacttctagttactggtccaaaatttttcatctggtaacttatctagccctaaaactctagggtttcatacgtaataaaaataataataataaaaaaaaaaactctagggtttctatccaacactatctgtatcactcatgggcaaagtgcttatggctagtaaacactttcaaacataaaacaacatgaacttcatcagttttcttctttttcaagagaagacttgtgggtccgtgagaaatcagtattcctaatatcctctataattcaaccgaagtctctcgagaagaggagtggggctgtcagggctgtcagtctcccctgccttgcccccttggatttcctaagactcagaacctttctcccttatctttctcacagcaaaccttgaagaaaaaatgggtggagctcaggtctctgcacttacaggaacagcgcctgttgcatggtaagctcaatttcctggcaggaaaccgcattctcgtcacaccctctcagcatttctgcctccaaatattttcagaccatcactattagagtaaaagtttgcttagcaccagtgaaggctactggtctgcgctttgctgggatgaatactggagtgactgtgcttggagcaggctgagtcatgctacactctcttttctatacacactacatatgcctttgaaaacatgcatggacttgggaattacacatttggaagaggtaaccaaagattgcagaggagccagaggaaacattgcctgccatttgtaccccatcagccaatgagttatattcctgaaaatgattctggctggagctattttaatgaaaatggctgtgtactttataggtagagcatcaaccattttccaaattccattagttatatatgcagagaatcttaggaccaaatcagacagacaagattattatgttaagatgtatttgtactctcttgttttgaagcaaggagttgaatctagttgttagtttgctcttttgctgtgtcacttgaggtcagtccagacagtgtcctgctatatggccctgcctattctgatgctcactaagtagtccaagggaaacttatacgttagcctcccaagcactgaaatgtcaggcatgcatcaccatagctggcaggagggaacactgtgcacaaataatttactggagtcattagctgtgtgggttggaatgtaggttatctcatctaacctctatctagaaattggaatatttgttcaaatggtaactacttggcggaaaaagattcaacttaaaaataatttaaaatcgagtcataaaaccattaaaaactgtacaaattcatgactatcattacatgtgtgtgtgtgtgtgtgtgtgtgtgtatgatgtgatgtggccaaaataaatttgctccttagacatttatttatttatctatttatttactttggtggtaaaagcttttacaatatcttccttttagattttggaagtcacagtagacttgtgagctgtagtcaccctaccatgtaacacaccacactcttatctaattgtaaccagtgcccatggattacggtttcaggaaacctctctcctcgctactcagcctctggtaaccaccgttctatccccaataaccatcagaacattgctagattctgcccgtaatgagatgatgtcatatttgtgttccttgtgcttttttcatttaacacatgccatgttcatacatgccatcacaaatatgaatttttttccttttgttgtgtgtgaatggaattcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagatagagagagagagagagagagagattattttttaattaattaattaattaatttttaattgggtatttatttcatttacatttccaatgctatcccaaaagtcccccacatgctcccccacccactcccacttcttggccctggcattcccctgtactgaggcagataaagtttgcacgaccaatgggccagagagagagattcttgaaaccttattcaacttcctgcttttcatagacgtggagtgtttcagaagcctttgctgaactactgaaggtttctgaacagcccagcatacagttttcacatggacaggaatagtcttaagtagatctaatatcaggagctacattggtacacattttttgagggactagaggtcttcattcatctgctttttcctagaactagaggaagtactcaggacacgggggtctataaagcaattgctcttccatccggatttatcagcagcgaaagacaaaacaacccagttgtagcagaaaggaagcatgatgtagatgtaaactggctgtgcttggcttcatagatcaaatggaggcagaacagtctctttctacattgtcaaccaaagccacaggagaacagagtaaagagaactaacacaggatgccttttggaggacttggcaacctgtaccttttttttttttttaaatagactcacattctcagttatggttttctgagcacactagctgtccaagcaatgagaaacaggtgggcaggagagaatgtgactcatacttccgtttggggaacccatttgtgggttataaagcactgacaggaaaacttggccaagcagctagaattctgaggagagaggtgctttctaagcacagcagcatcctaaaacattcagccattctcagaggaaatttgggatattgagactggaaggtataattggttccataaaccttttataagcacatgttctggtttgtagctgttttccccatataagttagatagctttataataagcttccgattctttacagagacagatcgtaagaaccagagaagaactttctgagcatctattttgacctcccttctgtgagcattttcataaaagtttccggggttacacaatttaagacattagcacttggaggttcacagagtcacactgtctcagtgtcatttgcattgaactgatttcaagtcaagtacagtcctctctgccactaagataagtcagcttacaaaaaataaaagttttatttgattcagtgttcaaaggtttcagtccataataaactggcttgggcctgtgatagtacatcgtggcagaaacactcagcagactaaaattgctgttagtggctagagagtgagggaaaacggagcaagaaacagaagttttaatccaagactaaattttcccgggaggtagcaacttttaaaattttcaccatctcccagtagcatctccatgcaaaccttctggagtacattctagatccaagctatgggcatggattatcttgcttaaatgtattctaagttataattttcatgaccttcttatagctagtccatgggtgctagcttggttaaccctcctaactttatttgtgcaagtgaaaacttgggccagagaatatgtccttcctctcttgagttctttgaagttgggtgtgctttcttgtagggactgctggttgaattcaactcacaatagactcttctctgtattgtaggagacacagcaaactccccaaatttggaaaacatggacctcgacgagtcgtccttgtttggaaatctgctggggccgagtccagccctcctggaccggcatcgactgtccagtgagagcagttgtaagagttggctgagctccctcacagtggacagtgaggacggctaccggagcagtatgtctgaggactccatccggggtgccttcagccggcagaccagcaccgacgatgagtgctttcactctaaggatggagacgagattctgcggaatgcttcttccaggagaaaccggagcatcagtgtcactagtagtgggtccttttctcccttgtgggagagcaattactcaagcgtgtttgggaccctgccccggaaaagcagacggggtagtgtccggaaacaaattttgaaattcatccctggccttcatcgtgcagtggaagaggaagagagtcgcttttgatgggctgctgcagaccttttgaattggcttgtttcacaatcctctctctacccgccaagatgaacccctggcttagtgggaaagtacagatagactgtgaagctcacatcccatctcacagcagcagtgacctttaagttcttatattgttatttttggggtcttatatcagaggtttgtttttgttcgtttgtttgtttcaatcagtagtgttcaacttctaaacagacatcacaagaggaaagtaataggttaaataatgtaataatatgtctgctcattctaatgctggccaggaaagtacaaaaatatttattatactgaccatgcatgtaaaaagtggagaattcttagatcaagtaagaatatagaccgacagaatataattattgggttgcttttaatatgttaatttgatagactacaaaacctcctatttgcttcatttactctgtagcctctgggagcttgcccaagagagaattaaaattgttttcaaaccattaaaggatcataaaacatagcatcatacgcatcttctcacttcagcagtgacagtgaggcgggagagatgcctagtattggtgcagaggagagctcttggtgctgggatcctatgccactccccactccatctctaaacagagtgagtgagactctcattattttcgcccatttcaatttttattttctgcctgaacattcatgccaaggccagaaatctcaggatcaaatctatagatctgtgattgtattttctgcaaatgtctaaaattctaaaaatgagaatggggaaggaacatttcttctgtatgtttatctcctgctacacctcattaaacattccacataggtatcacctcagctcgaagttccttgttagctgtgcttgtattgtactctcacctgtcaatcatgctctatgttatttcaacatccattaaactctgttctggtgatacagctgttctttacctgtatgctcaagtaaataaccatgtgataaagacttaggttgattccaagcacactctctccctccaccctttcggggtgtgtgtgtgtgtgtgtgtgtgtgtgtgtgtgtgtgtgtatgtgtttgtgtgtcttcaacagagctgatacatttaagtgaattttctagttggtctatagaaagcaattttgatttttaaaaaagtgaagtaaagtctgtaggataataagtagtaaaatttatctaagtgggacctgctgcctataaactctttgaactaagacacatgttttttttgttttgttttgtttttttctgtgtgtgttattcggcacacttctcaggtataccagcagtgctgtctcccaaatatggagtgtaaggcagtctaaaagcaccttagaacaactggagacaggatacaaaaaaaaaaaaaaagaaagaaagaaagaaggaaagatagaggggaggggagaagagagagagagagagagagagagagagagagagagagagagagagagagagagagagagaggagagagagagagagagaaagagagagagagagagagagagagagagagagagagagagagagagagatcagggatgcagagcctatggtcatggcttgtcagtgttgtcctggctagaagtgaaagccatttcttcttggatgtagccaatactcttggcttctttaggaatcgttactcttttgctggttctggtggagttatattagaacaactggagctttctcatcagggttgtgtatgatacagggacttaaaatgtctgaaactcaactctcaccaaaaaaatcaacagtggcttttgagttgtctcagatgaatagtaatggcacagactcatgtgggagtaaaactaacaagctttattgtggaaagatggggaaaggtgacaaatcaaaggggaaactcctgaaaacaggaggggttcccaagaatgaaaaagccctgaaaatatctgtctagaagtgtttttttttttcatttttgtttataggatttacaacagaaattgacaaagactgtgatcatttctattgagatggatcagttctctagggtatcatggcccatgctaatagaggaacaacacactctgagcatatcttactgcttcaatcacgggaatgatcatgccctgtttgcatgctgcccactctatccagagtacttgcagagttccagctttgttcatctctgagttctgttagttagctactggccttgatttctgtctgttagctgatagccctctcgtcgttgatatcatagttatattgccagctgttaattaaattgtggcctctatatgatcagtttgcactttaatcatttcagagggaaaactcaatcaaagctacaaaggtgtagctgcgactgtccttattacttcatgttaggtctttgcttatggggcagtctcctttctgaattagatggacacttcttattagaagatgtactacctacattttagtctgtcacagttgaaatacaagcaagactatagggaaggacaactgccttgtttatgttcctgcagtgctgcaacctgcaagggattgacctgactcggacactggaatgatgtaacaacagacataggaacagaaaagctggatagagtaggtcacgtgctttgatgaagatgttccagcatccagcaaactcagcatgcttgtgacatagcttaacaaaggtgtgggttagctaatcttggtaagaggtctctttgtagaggaacagtctaaggctgcaggtatcccagaggagaaagccatacttgatactttcacacactgtcaccatctatattctgaccaggggaaggccttgccatttctgtgggtctgagacactggggtcttttgacatggtagcactcatgtcaacatacacatcatctctagactttatccattcccccaggacattggctgtcgggcctgctagtcctgaccttactagccagtctatgttccttgtgtctagtcaatgtggttgtttcatattcaactccctgctctctccatctttcttgtcatttttgaccacattgttttaaccccaacctttttatttttaaccccagtgtctgttttgaccttcccctttgtgatcaacaaggaatcgtcaccatgagccccttccccttcctacctgcagagtgatagcaacagcctcagctcgatgaacttcccactgtaatacttttaattcacctgccagaaaatattaaaatataaattgttgagccaatagcgaaatatctcgtggtctctggagagtaggacaccaacaatttagggtgattcttttcttagctttcattagcaagctttcaaatacagtacataagtacttagatgctacaacacattacattttctttacaatacattaattaattgcaatacattaatgtttccttaagagttttaaaacagttatcattgagctagcacagcattttcttttcctctttttaggactatcatgctaaagatcagcttacatgaatacagcatcttgatctccgcccatgacgtatggggaagagatgtgcgtttatatgggtcaaagtttcccgaaagtgagaacctgttgcagagccacttcagatcatctgagaaagcagagcataggtcaccggcttctcttgcaaacgtctgttagtaaatgtcaaatgcaaagtggggaccaggaagggatggagccagtaccaagttcatttgtgttgagaagaattagcatcaaaaggtagacctgtgttcttggggttggaggagaggaagcaaaactggttaaccagagcacaggaaggaaggctatgccatgtgcttagtgttcacaagcagtttaatgtaaatgtaggggaatttcacaccatgttttagtctgtgtctgacctgagtgggaccttagaagaagctcctgtggcactgtggctcacttggatgtaatttatggggaaaataccttaaaagccgttttactttttttttttaattttttgaattctgaagttgtcaggtatgtaattttggtgcattgcactaattgacaaatcgttatgaaactactgttttctagaacggtgtctgataaaccaattctgagtcatgccgattctgaactgcataatcactgagctcaaagactagggcacgaaacaagtaggagagaaaagagttttctctttttgatactttatgtgtctgagtgctgtacctgcatccatgtgtgtaccgtgtgctggcagagatcagaatgcatcagagtcctatagaacaagaattacagatggttgttagcctcggcgtagatggtttgaactgtgtctggtcctctgcaatggcatagccactgagccatccctccagtcccagaaaacagttttttaaaaaaattaacaactttaactcaaaacattctacttttaatacttttatatcttatgtgcatgacacaaatggtaacagaaacatcaatttgaatcaaagagactgaacttaaatctagtttatgtgcactcttgatgaagtgtgcttctgcatgtagacaaagtagagtaactaatatgttactaggctgagtccttcaggttacaaacactgttgcttgctgtctacttgcatacagaattgtggactcccaaatgaaagtatttatgttctgaaataaagaatgcttttttggctatcagcacttccttctcttttgtcttgtccttccctattggaagtgaaaagtttcttttctttgtctttctttctttctttctttctttctttctttctttctttctttcttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacatggtatgcactcactgataagtggatattagcccaaagctcggaatacccaaggatacaattcacaggcaacatgaagctcaagaagaagaaagtcgaaagtgtaggtgctttggtccttcttagacaggataacaaaatacaggagcaaatatggagataaagtgtggagcagagacggaaggaaaggccatccagagactgccccacttggggatccatactatatacagtcatcaaatgcagacactattgtggatgccaagaagtgcatgctgacaggagcctgatatagctgtctcctgagagacactgccagagcctgacatatacagaggtagatgctcgcagccaaccattagactgagcatggggtccccaatagacaagttagagaaaggactgaaggaactgaatggttttgcaacaccataggaagaacaacaatatcaaccaaccagaacccccaagactcctagggtctaaaccaccaaccaaggagtacacatggaaagacccatggctccaactgtatacataagaaagggtagccttgtctgacatcaatgggagaagatgctcttggtcccatgaaggaaaagtttcttttaaaggcagatttaaaaatctgcatgactgcttgagacatgtgtgataccatggtgctagggatataaatcaggggggagggttgttgcctaatatgcacaaggttctatgttcaatcttacttctgcaactaactaaatccaaccaaatgttacctacttttttgaggccttacagtcattaattttttaccatgactcaataaattatggcaaatgtggagaatgagcaggatcacatgaccaggcacaagtgtgggtctgcttagtgtctcaaaaccatacaaataagttgctgttcaggttccaattctcctctgaactcgtagagtgagaattcacttgtaaactcctagttattgtcagagtattgtctttattgccatgaggtttcagtcatcttatttcttcaaagccatcaatggaaagggagggagaggccacaagccgggcagtatcttaagtaactcagtttaatcgtgggtgatatactataatctttgttgtgtaacacaaccactgaaatgtcttcccatgcttttttctagacagtgtaagatgagagtggaatcttgaccctggcaatgtgtgtcagaatataatcatggaaccccattctatcaaagtgtgtgcattagaagcaagacatgggattcaccttctagaattgattctgtctaaaggaaacacagggacaaagattggagcagagactgaaggagaggccatccagagactgttccacccatggatccatcccatatgcaaccagcaaagccagacactaatgctgatgccaggaagtgcttgctgacaggagcctgatatatctgtctcctgagaggctctgctagagcctgaccaatatagatgtacatgcttgtagtcaactatcagactgagcagagggactccaatggaggagttaggggaaggactgaagaagccgaagggattgcaatcccataagaagaacaaccaaccagacttccagggactaaaccaccaacgaaagaatacacattgaggtacccatgtctccaactgcatatgtagcagacacatatgcatctggcaccaatgagaggggaggcacttggttctgtaaaggctcgatgctccaccataggggaatgctagggtggtgaggtaggagtgggtgagtgggtgggggagcaccctcttagaggcagggggatagggattttcagaggggaaaccaggaaggaggataacatttgaagtgtaaagaaataaaataaccaataaaaaacaaaaataagagaattttagaaatagagaactagtcagaatgctgaataggagtctgtggccaactctgttgttgacctcttagtctttgatatgtatgaaatgacaggagaatgtatgagaggctatagagaagtaggggctttgctttagatctgacttacacaatttatctgagttcagtgacaggtgtgtctttaagcttataggacagtagggagtcatagacatgtaatcaaatcatgtactatcaaaattataaggcagaaaacaaaatgaacaaggatgaacgaaagtcgggagacaagatgggtacatacctgtcagcctaacacttgggaggccgaggtagaaggattgcctcaggcttgagttgagcctctgcattatgttgagaaccaggccaaccaggtctttgcaataaacccaattttaaaagggggatatgagtgagactggatcaggaaataccacaaatgaattctgtgtcaatagaaattcagtgggtaagaaggaagactcagtagttttaagttgtcacctgcttttaaattaatctatagctttgtatcacctcaattaaatgccaataaacttcttgtggacatgtgtaaagttattcttaaatttatatggaaagttacccagtaaaatatttcagaaaaggactaaagtagggaaaactagaatgttctcttttcagttataaagctctagtgttcgagacaacgtgctacttatatagatcttccccgatcccataagtcaccattccccagtgtagacttacttccagagacctctttgcaaatactatggcatagaaaatggggaaaataataattctgaactatagtaacctgatgaactttatttcagctggatggtcaatataaaaatcaatataggttatgttgaccatattcttccttgatatcatgtagtgagacgcacacttcacttctatggtacacctcccccaagcccacagacccatgaaactcacaagaaatacttaggcaaatcccaagtcagacactgtaaaccaacaaaccagactctctaaaagctatcataaaaacaactcaagtctgaaactcaaccattctaagagagcctgagacacaatgaccagatgtaatgtagccctctggaagagagggagagggaggtattaggtaagaacttctggataaagtgcaaacttcagttaatgtagattggttgattgctaattttgacaaaatgttgccagcacacatgtgtggctattcctccaaactcacacacccttttctagagggaggaggctcattgaggttcaacaaatacaagctggagagaggctcagtggttcacagcacttgttgctcttccagatgattaagttctcagaattcacatcaggtggtgctcaaccatctgtaactccggccgcagggaatcttctgtgtgctcatatgcacacatacacatatataaataatgaataaattcttataaaaatggtcaggaagaaaaattataaaatgaggctgagtgatgcacacaattcaaacatcccaggaaacttctgaaacaagtgttacaaggcctctccctaaggttatagaagtaacaaccatcacaatgggttgatattcagcagccatcagagctctagtagattgcacaaagagatacagggatgcagctttcatgagctgccactcacggtagagtgggtgcttttctcttttgttgttcatgcagctccctttgagtcacccatgctcatttaagtaacccttaccacatgctgtaataagtagttccaataaattcactgattcactaaggcagacttgggtgtgatgatttctttggtcagttcttagcagcctatccaagtacatgcttgtgcacatcaccccaggaaaagtcacacaccactgctatcacaatacaagatgaaaacatctggagaaactgcgtgcaaagtctatgaggtaatggcacattgtcatcaatcatttgttgtcaatgtaatattttaaaagtgtagtaaaataagtacatttaaattagtgattaatgattgaatgaatgaagggtagccacgttagaagactacaatgggaaaattgatgaggaaggttcaaataaatgtaaatctatttaattttgagaacaactgcagatcaatgatttttagaacaaatttcaaggaacttgggaggcatagctatcaccccaacaaatgaaaagttggaaaaacaagctaaacatcaactgcttttaggtatatcatacactaaggtcacagggcaaagcacggcctctaagtttgagaaagaaattaatatacaacgagtcagggctcaatagagcttgtgtctacagagaaacagtgcacatacaagaacctaaactgtaactgacaagttcctgaggctcagatggacatatctgagagttaacaatgtcagggccatagttattgttagaagaaaagcctccgcctttcgtaagtagtgattctcacggtatctatagcagataacacctgggtatcctgttctaaaggagttttacagaaatagttttacatatcttttttttttttttgatttggagattacgtgttggatatttaatctttttttcccacttctagttttcttttggagcatagttgacctggatgaaggaaaacacccaacagtcatctatttagttattcagtcccacctaaggagaggagggcagatatgcacccaccccacaaaagaaacccacaacacagagacaaagctctctgaaataatgagacctaagaagctgtagcatgcttcctatccttgaaccacatctctatcttaaggaacgtctatttatagtaattctttttatgcagtatttcattttgagtgatgaagacgtcattacaagacacatgagtatatagttttaagagaaagatgaagccttagaatgagaaccagacatggcagagatgttgtaattgcaagcttggagacataacaaccaaggttgatagcataaggcctatcatgtataaagtaggcaatatttaaaaatatatgggtagtataaccagaaaagtggaaattttaagaaaatataaaaaagatttttttaaaaaaagataataacaaaggaatttaagagtacatcacaaaagatcattcaacacaattaagaccttactgcttctatttaagggtgattctaagtacaaagattgactaagattcacattaatggaatatagagctaaagttgtatgtagaaaaatagctggatctaataatagttgtaatagaataaagaataagataaaattatctcaatataattaagaccatatgtgaacaattcatagctgatatactctgtggttgtggtggtttcaatatgcttggccaatggaaggagctactattagaaggtgtggcctgttagaggaaatatgccactgtgtaggtgggctttgagggctcctagtgttcaagctccccccgtgtggaagcctcagttctctcctggctgccttcaggtcaataggtagaactctcatctcctccagcaccctgtctgcctggattctgccatgcttccgagatgatgataatggacggaacctctgaaactgtaagccagtcccaattaaatgttattctttataaaggttgctttggtcatagtgtctcttcatattaatgaaatcctaactaagacaggagtgaaggtaatcaaagctaagtgactaataattagcagacagtgaaggtcaacaactaacaaaactcagc

SEQ ID NO: 470 - DNA, 2408 bp, Mus musculus
gtgcaacagtgtctcaaaccacagcagtcacatgggttctgttggctttgctactttttcgactgcgagtcagagggctgtgcatttcgcttcctccctcctgcaaggccagggaaccatgtgttggcgggattaatctttgcccacaatgtctctgcaaaggtttctgcagcggcagggcagcaatggcaatttggagtactgtgctgactctgcctacggctcctactccgtcctcacgggccagctcacgatggaagacaaccgaaggattcaagtgctggcagacactgtagctactttgccccggggacgaaagcagacctacagactccagaaccagaacatctgttcctcagaagtgtgcactatgatctgcaaagtgcaggaagacagccccgctcactgtgctggcctgcaagttggtgacatctttgcaaatgtcaatggtgtgagcacagaaggctttactcacaaacaagtggttgacctgatccgatcatcaggaaatctgctaacgatagagactcttaatggaacaatgattcacagaagagcagaacttgaagcaaaactgcagactttaaagagtctatggggctcagaaagccagcgggacggcatattacctgaagagctagtcattgacgcacctgtgatcactcttgatttacattttgttgaaggagcaaaacagaggaagagagaagacttgtgggtccgtgagaaatcagtattcctaatatcctctataattcaaccgaagtctctcgagaagaggagtggggctgtcagggctcaaaccttgaagaaaaaatgggtggagctcaggtctctgcacttacaggaacagcgcctgttgcatggagacacagcaaactccccaaatttggaaaacatggacctcgacgagtcgtccttgtttggaaatctgctggggccgagtccagccctcctggaccggcatcgactgtccagtgagagcagttgtaagagttggctgagctccctcacagtggacagtgaggacggctaccggagcagtatgtctgaggactccatccggggtgccttcagccggcagaccagcaccgacgatgagtgctttcactctaaggatggagacgagattctgcggaatgcttcttccaggagaaaccggagcatcagtgtcactagtagtgggtccttttctcccttgtgggagagcaattactcaagcgtgtttgggaccctgccccggaaaagcagacggggtagtgtccggaaacaaattttgaaattcatccctggccttcatcgtgcagtggaagaggaagagagtcgcttttgatgggctgctgcagaccttttgaattggcttgtttcacaatcctctctctacccgccaagatgaacccctggcttagtgggaaagtacagatagactgtgaagctcacatcccatctcacagcagcagtgacctttaagttcttatattgttatttttggggtcttatatcagaggtttgtttttgttcgtttgtttgtttcaatcagtagtgttcaacttctaaacagacatcacaagaggaaagtaataggttaaataatgtaataatatgtctgctcattctaatgctggccaggaaagtacaaaaatatttattatactgaccatgcatgtaaaaagtggagaattcttagatcaagtaagaatatagaccgacagaatataattattgggttgcttttaatatgttaatttgatagactacaaaacctcctatttgcttcatttactctgtagcctctgggagcttgcccaagagagaattaaaattgttttcaaaccattaaaggatcataaaacatagcatcatacgcatcttctcacttcagcagtgacagtgaggcgggagagatgcctagtattggtgcagaggagagctcttggtgctgggatcctatgccactccccactccatctctaaacagagtgagtgagactctcattattttcgcccatttcaatttttattttctgcctgaacattcatgccaaggccagaaatctcaggatcaaatctatagatctgtgattgtattttctgcaaatgtctaaaattctaaaaatgagaatggggaaggaacatttcttctgtatgtttatctcctgctacacctcattaaacattccacataggtatcacctcagctcgaagttccttgttagctgtgcttgtattgtactctcacctgtcaatcatgctctatgttatttcaacatccattaaactctgttctggtgatacagctgttctttacctgtatgctcaagtaaataaccatgtgataaagacttaggttgattccaagcacactctctccctccaccctttcggggtgtgtgtgtgtgtgtgtgtgt

SEQ ID NO: 471 - protein, 398 aa, Mus musculus
SLPTMSLQRFLQRQGSNGNLEYCADSAYGSYSVLTGQLTMEDNRRIQVLADTVATLPRGRKQTYRLQNQNICSSEVCTMICKVQEDSPAHCAGLQVGDIFANVNGVSTEGFTHKQVVDLIRSSGNLLTIETLNGTMIHRRAELEAKLQTLKSLWGSESQRDGILPEELVIDAPVITLDLHFVEGAKQRKREDLWVREKSVFLISSIIQPKSLEKRSGAVRAQTLKKKWVELRSLHLQEQRLLHGDTANSPNLENMDLDESSLFGNLLGPSPALLDRHRLSSESSCKSWLSSLTVDSEDGYRSSMSEDSIRGAFSRQTSTDDECFHSKDGDEILRNASSRRNRSISVTSSGSFSPLWESNYSSVFGTLPRKSRRGSVRKQILKFIPGLHRAVEEEESRF

SEQ ID NO: 472 - DNA, 49004 bp, Homo sapiens
  misc_feature (1)...(49004): n = A,T,C or G
cttcctattggcctttctctgccgatccacttaccattctcaaagacaagtcccctatagggggcagagcgaatccaggcagctccagaaggtaagcagagtggaggagtgtctatttggggaacactaaggtgaaagttctccctagagctcgtccatccacatctggatgtgacttatcacctttattcaatgggttgagttgggacctccctagtcggtaatatttgaactgggatttggagagagagagagagaagacaaatgaaacaggccaaggggaacagtgttttgggcagaagaagcagtgagtgcaaaagccctcaggaggaactgcttcctgctggaggaacagaaggaaggccagcgtgaccagggtgatatgaagttgtaggatctgctggaacatgcaggaccttgaaggatagggtaaggagtctggattttatttgaagccctggggaaaatcacctagatttcatgctggtgttttgttgttccaagtattacacaaaattccagtccccaaacaggtttcttgctttctaagaagttactttctacagccctgaagcccttgccgattctgtggggctgcctgtccacgcccattgggcaggagttaagattaagtaaaagccaagccctgagtgtgacgcaggatgctaagtaagggaagaggaaggaactctgtcacttgtttaccttgaattttgacagaagatttggatttcgaaatggaactgtgtgtgtggtagggaagggtgggggtaataagtgaattagacactagaaaactgccactttagaaacagtggatttcaaaagaacacaccaatgccctttaccatcacaaaaattaatggctactctctgctactacattattttgtggagacttcagtagatctttttgaggaggaaaaaaaaaagacaaagaaatatgaaagaattgcctaaaagaatgaaaacaaaatcacattaagcaaaataaaatcttagcctgtaaaccaacaccaaacagccagtgggtaaaccaataattctcattggtaagcataaacagaggtatgaggacctttaaaaccataagacattatgaactaaatgtgatttgctttttaaaattctttgtgaattgttgatatttttaaagttgaccaaataatatatgaatgcgtacttactataaaagattcaagccatatatggcatacactttgaactttcctacccatcttctcccacaatggttcaagaagtaaccactattctattaacaggctggtatatatcttactagtcttttttttaatgtctgtacatgttagtgtacatatatgtatgtgaactttaagaaaaaagtataaatgagatcacaccatacctattattctaccgttttctccactttgtcttaaaactctttatcagcatatgaatgtttattgtatacttttcaataggtgcacagtattccattgaattaaattaccataaattatttaaccagttccctattaatgtaaatttaaaactccggttttttgcaatcacaaacaatgccacaagagtcattcttgaattgttttttgcacatatggaagtatttccatagggtcaattctctctcttttttttttttttttcttgagacagggtcttgctccatcacccaggctggagtgcagtggctccaccatggctcactgcaacctctgcctcctggtccaaaccattctcctgcctcagcctcccgagtagctgggattacaggcacctgccaccacgcctggctcatttttgtatttttagtggaaatggggtttcaccatgttggcaaagctggtctcgaacttgtgacctcaggtgatccacccaactcggcctcccaaagtgctgggattacaggcgtgaggccctgcaccctgccctaagggtcaattcttaaaagaagattcactaccattaactgtcaaaagtgtaacacattacatgttgcacatttaaaatttggatactgtcaaattaccccactgttattatgtctttattgatttgtattcctaccaaaagtgtttaagtgctcacttacttgcaattttgccaatactggatttcactaacctttattatttttgtttatttggtgagcaaaaagtagtatctatttcagtttttgctttcctgattactaattagggtgagttcctttaataaatctatcgacaatttgtatttcacctgtaaattatctgttcctagcctttgctatttaaaaatactttgttgagaagtataattttaagaactctattacaaccattgagcaattttctgtcacaaataatttcttgctatctttcacttagctttcacctgtgaacattatagctttcattgaacagaagtttttcatctttacattgctaatgctttctgggctcttatgtattgttaggaaaagcattcccaacctaattatattaaatattctatattttctgctattcttttatagattttaaattatttttacttttctaactccttaagctgcctggaaattactattatattatcataaaaagctaagatttaatttttttcaaatgggttccagtcttatttattggaagatatattcttttcctaatacattgaaataacttcttggaaatataaatttctacatatgcatgtgtatgtttggggagtctctattctttgataatattgtatttatagacattctttttattgacctttcctgtttgacaatacagttctaacccatataatattaaagacagatttcccaatgcccatccttacctccatctcttacctcttttattttcagatttttcttggctagtcttgtgcactttctctttcagatgagtgtgagaatgtgtgtcaaactttataaacaaacaagcaagcaaacacacaaaacctacagagattttgacttgcagtgaactattttagaacatttggggataataaacgtctttacaagatgggctcttctcatatgagaacatggcatacctttccttagtccggactctagaattttcttcataacatcttaagaatgcttgctaaattcatttctgttttatgactttttggctattttgatgtgtctttctcccattcttataagttcttttgtaataagataatattatagtataatatattaacaaatatataacataactgttattgtataagaagcttgtttctttatatttgtatgttgtcttttgaatgctatacttcagaaaaattctcaccaggtttttgttcttcatgaattgtcctggataatctagttatgaagccatataatcaacaaacttgacagtttcattgtgtttctttataaattcaatatcttttgtttgtgatatactgtaaaattgtgaagagtgatgatggttatggtcatcgtggtctgcctttttacaataatgaaaacatttacatttcaatattaaggttaatgttgggtgggtatttctggtagatactcttcattatggtaaggtatttttccttctatccccagcttacttggaatttttaaaagcaaaaatcaatcttaatagctgcgacatctattacattgaatttaatttctttttaatgcagaaatttagtgattttattttattgcctaaggtcatactctttgcctcaaatagatttgaatgaactcatttcagtaaattattcctgccaggcgcagtggctcacacctgtaatcccagcactttgggaggccgaggcgggtggattacaaggtcaggagatcgagaccatcctggctaacaaggtgaaatcccgtctctactaaaaatacaaaaaaattagctgggcgtggtggcgggcgcctgtaatcccagctactcgggaggctgaggcaggagaatggcgtgaacctgggaggcggagcttgcagtgagccgagatcgcaccattgccctccagcctcggcgacagagcaagactccgtctcaaataaataaataaataaataaaataaaataaaataaattattcctatattcaaatagaaacagccctcttcactgaagccaatttctattgggtgtggtgaatacaattcatttatttcatggttgttatggcagcaagataaagatatatatgcatcaggttaaaaataaaactaaatgaaaattatctatccatctctctatatagacaggtggtctatatgcctctatatcttgatcttgacgtttatacttgattggacatattcttaaatattttattaatcaagtaactttaaaataaaaatagctactttttaaaaaatacaatagtcctcaaagaaggaaaatactccgggtaataagtggtcaaccaattatatatttctcttaaagctttaatctttcttggaaagacatcttcatattatagaacaattcccttagtacaaaaatgttgttcattccggttgagttaaaccctctctacctttgtcttaataggttaatgaacaaaagtttgttttgaatgaattttaaacaaatccagaattagggttcctttaactattggttatcctggttactttgtgtttctttttaaagggatttttgctgttagggctttatctctccaaaaaggtgatagtctgtagaaattggggaactcattagagggctgacgcttttttttttttttacagagtgattcaatagtctactgttcttcacactctatgtgaagagtcttttctgttttctataagcctgtattttcattcagttttatttttaacccgattaaattatgtggtatgaatgggaacacaatataaagcaaagcaattacaactacaatggttgatgtcagggctgaaagtctcagaatcccccctctcatacctttctctttttcttcttcttcccttatttcccaggacattcaaaggatctccttacattttcatgagtacagttttaaaatcattgcatagactacctcttaagactcaaacaacccgcattcacagagcattttgtatagatatatggataagtccacaggagaagctgccttttaaaacctatgcacatcctgactgcttccaggtggccccaatactactgtgtaccttcagcatggacccttcaacatgaagccatctctgccatatgcccaacatgctcaaagtactccccctaaacctgaaatagataaagttgcaaaaggaatatttaaaagtgcagttaatgatgtttctaggtgataagtgcaccaaatgaatgtgtctacttttatatctaaaagagtgttgaaattatcttactgagttatttcatgaaacactgatctagataatctatttaaagccccaattgaatttagtggcttaatcccttgaatgatattgcaatctacccatagcttcatgatttgattgaattaaacttgaataaatcagaaaattgtttccttgcacttgtattaaaaacatagtagatttgatgtattgctagctattatttatattaggtttaaagtttttctttgtgttgttttaaatatgcatgtcacaactctaagccaatatttggcttatatcacactaggatttctaatatagggtctttatgacctttgtttctgttattttcctttcctgagctgcctatttttcagggcttgtcctagttacaaatttttagtttatccttttctgaagaaggctattactctctggggagtagtgttcataattccagtgatccacactgagttggatgaggacatctgtctacccagctccatcactcaaataaggtgatacataggacagagcagttttcacagttagtggatcctcatatatgagagtaactttactaaatcaaatttaccttatataaattcaaaggcacaatattcaaatattgtctatatgactttaacacatctcctacatcattccagagacccaaataaaaacttcccttccaaatgaaggcaaaaggccaaaataaaacaaattagcaaaccaaaccacaacaaaacaaaatcctgtgatgttccaggaagccagataaaatcttcttgtgcaaataaaggcaaatagcaaaaataaaacaaacaaaaaactcaacagctatcttaagatcagaaaggcatagaggaagtctcattttttaagcaaccagttactcttcttctgtgtcttacaataatccagaaatttcacacattggctctgatgatggttttcaaacacatcttgatattcgatggtaaggaattcacatgtattgtgtagcctttagacttcttcagggtgacaagggcatccttgctgcacatagaggcacttagtaatgaatagggctattcatatagaattcatgttatatccttttttagcttttccttttgaaggcttgttacttaaagcaaaattcagtagatatagcttactttataccatgtgctattcatgggctattctgtctattttttcctgcaaatttttgttttagatatgtgaacactaaagtttagagagtgtattagtcagttcaagccaccataaccaataccatagcataacaaataccatagactgggtggctttaaacaatagaaatttattttctcacagttttagatgctgggaagtccaagattgaggtgctggcagattcagttcctggtgagggatctcttcctggcttgcaggaggctgccttcttgctgtgtcctcatatggtggagagagagtcctctgccacctcttcctatgagggcactaatcttatcagatctgagccttacccttatgacttcgtttaaccttaaatgattcattaacctccttataggccctatctctaaatacagacacattgaagctcagggctttaatgtatgaattttggggggatacaactcagtccatagtctttaaagcagcagagctaggacttgaatctaagtagtgtgacactggaaccctgttgtcaaccctcttacagctgcctaagattttcatggatgattgtaaggttggctcagtttgtcttgcaaacctttccacctttctttctctgttccgtgctttaggtatattcctctcacctgactctaccaaatctccatgttgtaggccctcagtgttcatctcatttgtactaaagattaattccttccaagggtatttgcatatttatgaacaaaatgttccaaataagagctttgccccacataacaaatattagcttttagagcataaaggcagatgagacgtatttttaagagactctgtcctcatctctcagatcaccccttagtgaaaattgtagcactttggaatatgggcttgtagtacatacatttcctaccaaattaatttttttccttattaataccacagaacactattgtttaatcattttgtttaatatctacctttctctttttattaacatttattgaacaatttttgtatgtaggacataaagtatacatttaaagataaaagatgttccttgctttcaaggaaattggacattagcagagaaacagatttgtatacaattaactattgccctaactagaatatattaagtctcaaaagaagaatctaaaaaaatgatatgacatttcagagaatgaaatcagataatataaaataatttttattttattttatttttttgtgaacagtgagatactcctgaaatcttttgagtacctaggtagcttgatccaattcatttccagaatcacctctctaaaataaatgggaggctgaaggggaagagagtctggtctattataattttcctaaggtaaatcctaaaagaaaagagatgttctaaacagtagaacacctttgtaagtcaaggatttgttgtttggaagtcacattccccttaaaagattactgtttctccaccctttatcacaagggacacttttgatcatgatattagtgactggcatgacacaggcactgacagaacagggaaatgaccaataaaaatagactaggtcaaaaatttgtaattaacaggtgtgaccacattgatatgggctggctggatgtcagaggtacttttgacccttgttttgtatccaggtatcccattatttgaaaaattttacttaacacatttcatgagttaagtaataagtattttccagtttcttaattgaatgatgatctatgatttacatcagcttaaggtcagtattacaatgaattggtacaattttagtagtcatttataaaaatgggtgagtcagttggcctgagtgggtggccttatattaagcaaatgtataatttccatttggcattttaaaatattaagaataaaaattaaaaatatttacctaactttatcagattcctagggtacagtggactgctgtcatccattaatagtgatgatttaatttatgtgcctcttagcctgaaaatgtttttaaaatcaatctctctctctgtcttcctaatacacacacacacacacacacacacacacacacacacacaccccacatatacctgtatacatatctgtacatatctataaatatagattttacgtgaatatctttataattgatgtattctttagttgccaaggtatttaccactcccttttgccttacacatttatgttacttacctggcttctgaaaacgtatgtgtttttaattcctgatttagaccgttatatgtttgtggtgatatcactttgtccatgtcaaaattcaattccagtataatgagtcatgctgtgatagagtttttaaaatctataattggcttcaacttttgaagcactattaattcagattttactatttatatttggcaatttctacttgagttgaattcatcttcacttccagtacacacacatttcattttagttcaaagatttgctaactctttcaaatgctagtattgatcttcagagattttaaaaagcacatttgactttttgtgccatataaaacttctctttttgacttttgtttcgattcttccttttacttgcctcccctactcctccactgaaaccagttctctcaaaactacctgcccccaacctcagccaaaggaaaaaaaaaaaaagcatctgtgatcttgagtacttggtgatggtgcccttgacccatatgcacatgcagggaccaacaggcaatgttcttggtgccaccttggtttgcctgttaccttcctgcccactcctttcctcccctgggaccacttgctgatgctgccgcaaagtctcgtctaagaaatggcaacattgtgccctaaatgtgctggctttcccttcccattgtactttgtaaagatcatgggtaatttttgtaaggacaaagtagtaaaaggacaaccagaagaatgctgaatggttacaacctcagtggcagatataatgtctttttgatgaacattaatgatctagggtatacttcagggaaagtacagtattacaaggacttcgagagagaacattatgaccggcacctgtaattcttgcccatattcacaagaactgaatgtcctcgtgtgctgacttctgcattgcattgctaatgttaagtaagagaatggatgggaaacaaatggtagcacttggggacatttttctttcttctctaaagaaaaaaatggcaaatggtggtgtgaatgcaacttgccacagaacataaaagcgtaagaattctggctgtttgaggtgaaaaaataagttgatttttctttaaattgtaaaaattagctccaggttctctcaggagcttaaagaaaaaaagctttgagaaatgggagtgaatagcaagatagggtttgtgtaacaagttcctcaaaccacagaggtcacatgggctctttctgctttgctacttttgattacttgtcacagttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcaggtatgattgctattttgtaccctttagagtgttcacattctcttgagggcagagtgatatgtttgtctgacttcatactaatggtgatattttagaggctttggaattactggctgattattatgggtgaaggaggtgagatgctcagggagctaggtgaaccagtccaaagatttgagaccacaatcaaacttttttttcaaggcaaaaattaagattgtttttcttatttgaagaagtgctcaggtaaaataaacatcattaagcataaaaaacttgaagatggtttatatagatacaaccagtatgagaattaattctcttttccccattgtgtctccactgattctttcccttccatccttacttgcagtccttgatggtcatttcagttcataatcaaataagaaatactttttctgaggacaaattttgttgactaattatcttcagctctgggttgctggcacatacctcaggctattggaaagtaagattttttttttttggatagatgagtgccagattgaatatcagctcaccacttagtgtctgtgggatcttgagcaagccacttgcctctctaagcttcagttttgttttttctaaaatggagttaataatagaaccacccttattgggttcttatgttggttaaataaggaactgtgcagtgcctaacacagtgactggcattcagtgtgtgtttattaaatgctagattatgccattttaatatttttattgcaaagtttgtctctagggatgaaaactcatttggaaaaatctatgtctaactgaatttattttgattttttcgttcttcaatttctaacatgtaaaaatttttttttaaccataatacctcttcaggattttttttaaacaacttgctctaaatccccaggtacatatttgaatttcgatgtagcatttctacagaaaatatttagaattgccctagagcaagaatttttgcgcttaagtcttgcatgtacaatcatgtgcttctcgtaagccttctaaattcaggattagagaggtatggcatagtgggagagacatgatcttttttcagtgatgtataatagctgattccttggtatttttcagagtgaagataagggcacaattttccatgatttggattattgattgttctcaatctaaagtgcttttatgatacaaagtttaatgtaatgatgaacattttatcaatctacaacctgtctgaagataaagcaacatgagaaatgctgacatcttttttcagttttcagatataaagcagtcagattttctttatatttgccatgacactatcacaccaactatggttcacttgattaggctatgattttttttttttttttgctggagactgtgggtactttttcaatcagggtgggaactttccaccctctatgtcctccatacctgcaaccttactcatttgatctactctctagcccatgcaattcaatgcaacagatggtttctgagcacctacaaggagacagacatcatgctaagtgtaggaggtaaaaagacgagaagggaatgtttcctacccatatactgtttacaattcagtaagcagaaagaatgggttttctgcaaagtaaaacaacatgaatactctcatcgaagtgaaacatctgtaaatatagccttggaaatagatattcgagatattgaagggtattccagatattgaagggtattccagagcaagggagaaattgaagctgaggcatagatcctggtgcctggaggacttttttgtgtaacaacacaatattaagtgtgtcaggagaacctggttagtgtgtaggaggtgagaggagatctcagcgctgggctgctttacagaacacttggacaacttcccctgaaaaagccggcacgagggccactgaacgtgtttgagaagtagaggatttcaggaaccttattgtagaaatgtagtggattagtgagtagagactagtggtgagggaggaacttttgcagtagttggagaaagaggaaatgggggaacagaaaggagactgaaaggctttaatatgaaagggactgaagacggaggagtcacatctggttttaagccagagtgaagatagcgtgaactgaaagaaggcaatcagtaggagaggctgattatcagaggaggataaagagagggattttggcatatgaaatacacgtgtgtgtgtgtgtgtgtgtgtgtgtgtgtgtgtgtatgtgcatatatacatgtacacatatgcacacaggcacacacacatccccatactaattaatttatgcagatgttctcatcttttctaggtcttctcattccccttctctcaaattctttcatgtggtagactttccatattcaaacagctttttcttactgttgtgagaattgctttaaaaaatagcaaaacaaaacttcttgtacatgatagttctgattccgtacaattatcatcaatgagacttgatgcaagtttatcccaacatttcacaatcttccaaatggatgttcatttcctttaactggtttttagagaataatcacccatttggcactgactaaattgcaggcaacaagatccttgtgaggcaatcacatgagcaggtgtttctctgcctactgttattttcaacactttcagggctgacgtcaacagctcatacttcttgttgttgttggctttggtttctgcaaagctatatctggttagcttgtagtttcaaattagtcttcagaatcaattgggtgtttacattcagaattatttaaagatagatttctctgtgtgcatattatctcactacctgtactgataggaagtgtcagacaccccagtatggcttctacttgtgaacacagttttaggacaaaaaaaaaaaatctttgcaatggaaagctcggtaggaaggagacaggaggaattaaggacagtctctatcaatgatgtcaaagaagtagtgattgtcttaccacccactctcataaatgtagtacgttgcttttggaaagcagtttttacagaatgctatagtgagaaccagggacctgacaaacaagtccacaaacttcagtggtaccacagactgactctcttttcctaattttcttttagttatcacattattgctaaataggcaacttctggcaggctgatttcatctataagttcagatagggaatgtgtgctctgctctgggatgtgtacactgctgggctgggctctgccctgcaggagctttcacggtgtgtccggcagcacacccatcaggtgccgtaactcccaattgtcctgaactacaccaaaggattttaatcacctcatgacaattttaggtagaaaactgtgctaatttcactagaaaagactttgaaaattattctttaatctgtattgtggcatgcatggtcaatatccaataatttttcttgaagagtctgtgagcccaccatcagaccttacttggaaatggcggtattgtatttcggtttctccgggcacttaacgtcaggaaattaagttcagctccattattttgttgcatctttgaatagtctgtggagcgttgatatcctaatgctccttatttaaaagtgggtgggagttgcatggaagaattggggagtgaggcaggggactggaaagggagcagagcacataattttggggcctttgaaacaagtaacagtgacaaaaaacctcactctggaatcagtaacctctcccccgcaccctccccaacactttcaggagatgagtatatagagtggggaccaggaggaagtaacctctgtaacccagaagtggctaaagtgttgaactttgagcttctctaaggagagctggctatctggctgagctgccaagtactcctgtctttcagaaattgacagctgaagtatttggtcttggtttcccactgaagaggaatgtgtagaatcactgcagagcagaagaaattaaattttgaatattaatgcctgatcttttaagttatctgactaaaaacagaagagtgatcgtaagcccaaccctaggtatcagtgtattatggctagcaaggagttaagaagctttgtctattcagcagtcataattgaatgtgtagtttgcaagcctgccaaattgctaaacctagatttctcatattagataatgtgtaataaaagacagctgttgccagcatatgctgtgaattgcacaccagttcctcattcatgatttttggcgccatcactacaacccttagaaaaggctctgactggagggctgtctggggaacatagaccccactggtcagatccttgaataaggctgctcgccctagggaaagcggggcaggaaagactttttttttttttcaaagtgcaaaacccttgataagaccttagacacacttcatttcactttaggcaggtagtttggtgtgtgagctagtttcgaaccctgggaacattcctttccacatcgcctgagtctgacagcccggatcaaaaacaagcaggctttgtgtcaagacgtggcacgtgtcagagaatttgacggtacttaatttatttaaattgttttttgtttaagtgttagatgcttgaaacagcctcttagctaataccgaatggaaactaatttgtaatttgacttaatctgacttttggtgttgctgataacccaaattagtcagtccacaggaactgaaaatctgctatgcttctcatgttgtgctagacaaatattttcatctttaactagtcaattagctagatagaaaggttagaagtagagtggtgggggaaatatctatagaggcttcaggtctgtcctgtggtttaaaagattttacatttgaatctatccagaatgacttttgattcaaaagaccgattggatgaaatcttgaagttcctaatagatgcactgatttccggcatactaaaagggtatttaaaattgacaaggctcaaaattttactaataatttattaattcttgccaccattcatccacttagcagctatgtactaaggcactactatctttgttttctgttagtactttttctgcatttcttgtttcggattgaatttttttttttgttcttgtctgttttctttcatttaaaattttttggtttttaaaatttgtatttattcagttgatatataatcatacatactcatggtatacatagtgatgttttgatacgtggaatgtacagtgatcagatcagagtaattagcatatccatcacctccctcacacaatgatcatttcttcattttgggactgttgaatatcctccttctaactatttgaaactagtacatgatatactattgttaactatagttagcctacagtatagagcactagaacttattcttcctatctagctgtaattttttatcctttaacaagtgtgtccctatccatttcttcccccaacccttcccagcctctagtatcctctgttctactttttacttctatgagatcaactttttttagcttccacatatgagtgagaacatgtggtgtttaactttctattcctggcttatctcacttaacataatgtcttccagttcaatccatgttgctgtgaatgacaggatttcattcttttttatggctgaattgtattccatggtgtatatataccacattttctttatccattcatctgttgttggacacctaggctgatgccatctcttggctattgtgaatagtgctgtaataaacatgggagtgcagatgtctcttcgatataatgatttcctttcctttggatgaattcccagtagtgggattgcgggatcatatggtagttctatttgtagttgtttgagggacctccatactgttctccatagtggctgtactaatttacattcccactaacagtgtatgaaagttcccttttctccttatcctcaccagcatttattatttattgtcattttgatcatagctatcctaactggtgtgagatgatacctcattgtggttttaatttccattaccccaatgatgagtgatattgagcattttttcatatatttgttagccatttgtatgtcttctttttcttcctttcttttttttttttcttttttttttttgagatggagtctcactctgtcgccaggctggagtgcaatggcatgatctcagctcactgcaacctccgccgcccgggttgaagcgattcttccaactcagcttccctagtatctgggattacaggcacctgccatcatgcctggctaatttttgtatttttgtagagacggggttttaccatgttggccaggctgatcttgaactcctgagctcagttgatccaccctccttggcctcccaaagtgctgggattacaggtgtgagccaccatgcccagtcttgtatagcttcctttgaggaacgtctgttcagatcatttgcccatttttaaatttttttttttctgttgaggtattttagttcattatatattctggatatataaatgagtagtttgcaaatatttccttccattccacaggtagtcttttcactctgttaattgtttgctgtgcagaatctttttagtttaatataaccccattagtttatttttgcttttgttgcctgttttttgaaggtcttattcataaaattttttcccaatccaatatgctaaagcatttcccctatgttttattccagtagttttattgtctcaggttttacatgaaggttttgatccatttacttattttcagttgatttctgtatagagtgagaggtatggtctagtttctttcttctgcatatggatatacagttgtctgttttctttcatttttaaatcttgctacatatttaagatttttaaattttactttatgtattttagtgattatccttgagtttttcctatgatattgaatttaataaaggacaatgttgaagactatctttacatatttctcctgaacgtgaatatttaatgtggctcttcaaccatctcagttgcttccattttcgtttagtagtttatttatttttatctatttctccatttttaagtttccattctattccaggccctgtgttgggcattggggcagaaagtaaaacaaataacattccccaagaggtccaaatcacacagatgattatgtacagatgtgaagtatttgatccagtatgcatttcatataaatatatacatatatgtatacatatatatatagctctctctatatggatatatgaataatatgatgaatactgatagcaagagtaataccttaaaaatataagcccttatttatagaggtataagaaacttttataaaaagaataaaaaagccctagttatcattacgtaatttggcttaagggcggaaaacaagcagctgaagataataaaaatagattaagaaaatatgagtacaatataagggagagactgagaatgcttggaaatatcaagtttgtggctctcttctgcaaggaagcccactaacatagatgaatagtccctatccttggtaacggtacatacgaggtacaaaatcaggttacaacaaaccataccaatccttgtaggcattccacagttagtgcttataaattgaaaagagatactttttagcaagactagagaatctttttgggtctgagcaatttatttcagtctccattgcgatataagtgagttgaagcccagaactaacaaaagaggaaaatataattaatttacagcaaattggtaagaagagaccacctctccattacgttaagtttatggactggtggctgaattcttaacactggtccattccaggaaatttgtgaaaatgctggcatttggtacctggtaattcaaaattcctacagtgatgtaggcttcactcctaatgaatgtcttaataagcatttcatttgtgtaacttgtcacataagcattaatatctcctacatattttcccccttctagttttcatcctttacttattttattttgctttgtctggactgactatgcattgatctcttgatattttatgtgttcatttatatatgacaaccatttcaggttgacaattaaaaaccatgggttagctagtagcttatgttttgggcccttgaagcaacatttgagaatagggctaataaacatttcctgaacaaagaaacaaaccgaccaaaaaaacacaaaaacctgctgcaattttcctaaaaaataagttgtcaccttttgttgatgctgcttctgtttacagtggtagaatgtgtcctgaaagcttatgtttatatgatcttttccaaaagtgcagaggaatgaaggtgatattatttataccattgatactattctgaggtttctttcctttcttggctggaaatttcacgttagtcttccaaaactattacaaaaataaatcataagcagaaatgaggttttgagttcctggttttacctgaattgtgtgtgtgagttggttgtttagagattattttatcctactaaaaacagtaacgtattgaattattatagtaaacactgtcatttcatcatcatctccaaaaactataaagtatttgggtttcatatgccattctaagtatgctatttttctttggatttcagtgtgattacaaattgctatggttaatctttcagaggctgttttaaatacagaccagagaggaagttctctttggaagctttggagttttgccacattattttaactcttttgccacattgtattactatctaaacctctttcaatcttttaactggaatgcctagaatcctgtctccctactctcctctgctatcactagagaatgtagagaatggaaatggctgcctttatgcaacaatttcccaggagctgggccaaagaaggtggtaaagaacaggttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacttttcctggtctcaaaggtaaagagattgaattattttgtgtctctcccaaaatatttaggaacatagctctccagactgttttttcctctctcttcctctctctctctctctctctctctatgcatagacacagacgcacacacacagacacacacacagaatcttacatactacaatttacataaatgtcagttatttttaattgtgacagttatttttaatgatagatctgtgccaaatgtgatactttaattttcatgcagtttcttttttaaacatttttattacagaaagcttgttactgtggagaagcaggataatgaaacatttggatttgaaattcaggtgggcaattttcacattttctagacttccaaggaagaaagtggcaccggtagtgtcatgttatgtgcaaagaaaaaatgaagttaggattagagaatgatggagcctatgacttttattcagtgtgtggctgtttgggggtagtttttcagtgtgttgagtactattaaggaaagaaaacattgaagatgataacaaaacctctgcgatatgctcagcagtttgtgcttagttgcttcagtcttcccttaagtcccagactgatcagctaggttggtatcagctaggtcttagataagagagtgaaatacattttacagatgtgtacttgatatatttgcatgtgttttgtataatcatattgttatactgtgtatcagattttaagtatttactttggcattcaagagacactcgaaagactatacatctgtgtatatagaatgcatatattcatggatagctcctggtatgttttgcaactagagttcatattgtacataatgagcaatttgtagctttttttcctaatgacaatgctttataattgttatttgaaacacttgagaacatttggctctacttgcagattgcctcatgctgtaggaaatttttaagtctttataagtttcagcataattgcctaagaatttcattgcttattagctgtctgctttttcatgagcacatttgtaaaatgggtgaggtaggtcaaatgaagtctaacccaattaagtgcaacagtagtagcttaagcatttctgttttttttttccatagtacgtttgcatgtcttttggatgtgttttgcataatcatattcttacactctatatcagattttagatcttagctttactgctgctttcagaaaactctggtgtgatatcagccccacaattggaaagtcagtgtttattttaagattaggaacaggaaactgctaagaaaaacatgttttatgagtaaagaaacaaaatggaactttagctgcaatgaagacagagaaggcactttgaaaagaggatcacttctactttcctaactcctgtacttttaaatttggaggaatctgtaattcaccacagtaactggtgaaatctataggttttagaagcatagtgctccctcttactccccggtcatatgaactactccctattctgttgtagagacactgctttttgtcactgcttctttttaaaggaaaattatcctcaaggatgtgcagcagtggctactgaaaactggataaacgactactcacctttctttatttttcttatactgccataataatgtcactactttcttaagtttttctcccataccataaacacttactctccgtggagcaagagtcaaaactatgtcaggccacaacaccactgaacttttgtagatcaacatgaactaatggcacctctaaatggcagcatgtaggtgttatctcagtgatgcaggaacccacactcctgtaaattccctctggtatatgctctccattgtcaaatacacaccataatctattccctagtactcatcagatttgcagcagttaacaaataggagacatgcttctgggaactttttgaaaatcagatagaacctcatgtacccatattgtgcatgcagtgtgagtacatgtttgggatgtggcctactagaggaatgacactttggaagagaccagatccatggttctccatgggagctagttttatgctgcttatcagaatcgtgcagcccaataggaatgcagactttggactcatgcacacctgaattcatatcctcctaatgccttatggggtccttaggagttttaaatgaaataatacatgcaatgtacctagtgatgtgccttaccaatagaagatccacaaatgacaggtgttagaatgaatgtcactgggcatgagaaaggacaatgagatctttgtgtctctaagaaatgcaggtgatcattgtgtcactgatcccttaatgggagctagaagactgggtaagagaaaaaagcatccaattaatactttctgtagctttggggtttctgtttttttctatttctaactaccatattttacacccaatgtgaacatatatggaggtgccagctacataaatcaacatgtttctactgcactgtacttactttgatctctgggaatggagggtagagtctcactgctaatgagaattgttagaacagtggtttcccaaaggagtgtcagttgtatattttattcatgtaccacatgaactagatcagtctttcatctccagaagggtctaggctatactgagaagacccctggcaggaaagctgtcaatgaagtttctgacatagatgggaacatagtgcatgatcttttaaagtcccttctacctttaagatatggggattctaagtgccttatagattagatagaagtcctttagaggtgaacagacccaagtttctagaagttgcttgcatgtggctgacttgtgatgcctcagggattattgaataagaaagaatgaacatcagacatcaattttttcacaaggaagtactactttaatgtagcttaattttaggaatcagatgtttaaaagacgtactctactcagaacactgattttgcttctaagtggaactagacttcataatttaaatgtgtgaaaaaaagaaaattatatttgttataggtcattgggacactatatctagcaaacatttattcagtgttttggtataattaaaaataaaaaaacccaccaccaccaaactacttgtgcctaattgaggcaagagttgaagcttaactttttctaatttagttgggtgactaatgaaccggtgaggattcaggacaggcataccagagggtgctcagaaatgaaggtaattgagtcaattatagtacttttgaataaatgcagggcagattgtcattatgtgcagaactctgatttaaaataatcattgttggcatgtctccttgctgcatgtgtacaatttcatactcctataatgagtgttttagcttgggagaaccacttagggatttttctcattgcacttggccatcgttgttttatcccattgggaaatgagaaactcaatttttaaaaataaatcgtgatagcatcaggtgatatcttgggcttgaaaatataaaatcttgagccactctcatttcactttctttctcatgacagatgtctttatgaatggagttggctacagattgtctggtagaattgcaaaattgataccttgatttagtttatagtggaaatcctttgtcctttgaacttacctattatactgcttaatgataattgacatcattttaaattttggcaaatagatgttgaggttgttaaatagtaactatatatcatcttaatttttacagtcttacaggccccagaatcagaatgcctgctcctcggaaatgttcactttgatatgcaaaatacaggaggacagcccagctcactgtgctggcctgcaagctggtaacttaaatttttgctcatgttaggaatcatttaaatggaaagaaaataaaatgttttgagagtgaaggtcaggatgtatttgttgctttgagttttcttggctcctttatgtttttaagacttggagctgcttgtttcatttgcatgtcaggagggattatttaactaaccaacataacactcatttttcttggcatctcccaggtgatgtccttgcaaatatcaatggtgtgagcacagaaggttttacctacaaacaagtcgttgacctgatcagatcgtccggaaacctgctaacgtaactatctgtctagttcccgtggggcttcaaaatgttatgttttctcataaagcctgatgagtgaataaataggccttttgttcagcattacaagacggagtgaggcagtgcaccggagctttagagtggggtacaaacattatcagttccttttgtttctcaagattcctcacacttgaacatactgtcaacatctgaagtcagaggacatcaatagcccaaacgtctgtgtgggaaggatggcctttacaaatgtatttttttaatgtcaaattcaattaaactggcacacattctctttaaactgggaagaactgatccaattttcatggttgatataatcctgtagctaaaacaaatcaaaggtcagaagggctgagtttttcctcttatgtgacaagccacctgttttcctcttctagtgttccatttggaaggaagaatagtctgttcaaccctccccaccctgaaacacacatactcacaccacatgttccaaatgttccaaacttcttttttttttttttttttttgagacggagtctcgctctgtcgccctggatggagtgcagtggcgcgatcttggctcactgcaagctctgcctcccaggttcacgccattctcctgcctcagcctccctagtagctgggactacaggcgcccaccaccatgcccggctaattttttgtatttttagtagagacggggtttcatcgtgttagccaggatggtctcaatctcctgacctcatgatccacccgcctctgcctcccaaagtgctgggattacaggcatgagccaccgcccctggccccaaacttcttaatagaacactggctttcccaattagaggtttgactgatttttctaccataacaatactagcacctaataaaatcttattaggatagttaaatgatgaaattcgctcattcattaaaatcatatttattgagcaaatactatgtttccagctctgtgataggctcaggagagacgaagataaagactctcttagtacgttaatagttatggaaggaaatggctcagaaaagcctgaaatttaagtaatgtgtatatttcagttattgataactactatgagaaaagtgcaaaacagcaatggcctgtcatgctaggtaagaaggctgctagtttggcttagatgtgtaaagtggtcttttctagggaggcgatatttgagttgagatctaaatgaagagaaggatggtcaaatgaactcctcgtaagagcacttcaggcaaagagagaggtctctgagtgctcacaatgggcttggcatgtacaagggaaagagaaaaagacagtataattggtatttgatggattagagagggtataataagaaatgaagccagagagttggcctgggggcagaccatggatctctttggacatgccaacaagtttgggttttattctgattgaggtgggtcatatattgtgtcatttattcttcacagccacccatgaggttaattttattcctatttatagatgaagtgcctgaagcttagagggggcttagttaaggtcacataactggtaagtgatagggctggggtttgaccacctgctctggatgccaggatctgtccttttcagctacagctgctccttggaagctgccagtagaaaatctgctggatgcttttcagtgattctggtgtaaaacttcaaaggatgctttgggtgtttgtgagagcagatttgaaagatggtggtggtaacaaattgggtccaactctataggtcctgtgagttcagggtaaaggatgaggtgcttttgctctagagaaccctggatccaaaggagaggaaccgtgcagagtctgaggggaactgctggtagttagagtcagaaagcatgttccacatgggtgaagagggtagaccacaggtaaataggggttgtagatggaggtaactgttggaaatccgggaaaatgggagacagtctgtacaaatactgaggaaaatggccaaatcaatggttgcagttttgcccatacacatctattgcttcagcaggtcaaactgacattcaatcccaatgaaacagattcatatggattcccactatttctcagagagtcaagatcaccttaaggagaaaacagacagtatatagcttgctaccacctgattattcctggcatgatgctattagaagtagaagactgatctccacatttaatgcttttaccatgccttgaaaaattccttgcatctttatagagaggtacagcttaattacaagaaggaacttgaaccaacactttaaaaattggtgtgtgattcacaaatgaaatttttaaatcatattcagattgatggtttagtagtcaaaataaaagcctttaacttgaacacacagaacaaatcaaatcactcagaatagaacaagtattttatttttagaaatgtgtgtggtgtgggaagaacagaacactggtaagttgataattctaggattagagtttgtaaactgaatgttttgagataaagaatcatatgaaggttattatgtcatagtagttgtacttctgtttcttctagtaccaaaattataaggagatttacagaggtaaaggctcctagaatcctatggaggaaaggatttctccctctttcaagaagtagcatgttaattccatggttgtgaaagcccctagagcctattatttctgttgttgtgccccttgtgttcagcatggtttctagaatctggtacatagtagatgcccaataaatatttaccaaatgagtgaggtcattcagcccatccccacaagaacagattctagtagagagcagccatcattgtcacatagtgacttctataaaataagctatagtttacaaattaactaggatcctttcttttagccaccttctcaaggggagttttcccccattttctttctctgttatcagaagatttggctttggtccagctactcgaagtgccatgagaactgtaacatttatatttcgtttttagtatagtatgtgctcaaagtgtagtactctgtagtatggtacttatttaaacgaatcactcatgttactcactccccaccttcctcttcttttttttttccttaaaacaggatagagactcttaatggaacaatgattctgaaaagaacggagcttgaagcaaagctgcaggttttaaaggtaatttaatttaatgcagtgaggcacatttttcatccttgaatgtgtgagtggtaaaataaagatctatttgaggaactgagatagcccttgaaaaagaaatgtcgtggtgaatctaaactgctgaattatcaagagccgcacaattacctctggaggaatatcaaattctgcaaaccagtgtaaatcactttcttccttcctccttctgtgtgtctatgaggctcagaaaggcaacaggaaggcatgccacttgaagaactcttcattagtgcacctgtgatctctattgatttacattttgtttggaattaaaacaaaaaaggtcattattttcccaagtgtgttggagggcctgggtttttcactttttccgtgtcctcttttggtgtccttctcttctgcctcatccttaaaacgaaaaccttatccgtctaatcctgtgactgtccttgaatctgctttcattggcaaatacactagcaaattcaaaggaggaagaaattagcgtccaagagatagtaaataatgcaggaggtccattgaaaattccctgggatggtcttttgaggcttttaaaaatctcagttttctgggctgatgagggtctcctaagccatgaagtccagaccctcactcatgcatctgagtcatagttctaaagacctctctgtttgtctcagtgacctctgcatcccaatctcccccttgcagagcaaccaggtagccaatctgagcagagattgtagtttactttaagcaggttgcttactttggctttatttagaaatagctgccatttgttagttttcttcatgaaatatgagcttattaattattgagcccaagagagtggattttattttgtatctttttcttcctccacatccaactcatcaacaagtcttgctttctttgtcaacattggtttggatactcttgccactgtgcttatctctgtgctttgttaaatcaatttataaaattccttgaaaaaacctctgctcaaattttgacaggaattgaattgtatttatgaaataaatgagagcaattaaaatctttatggctttcacttttctcactttgaattcaggatctcaatctttttattcagatcttttatggacttaaaaaatattttgtaattatcttcctatatttttacatatcatttattatattcattcttgtttacttcctcattgttcttgctatattaatcttttaattttcagccacttattgctaatgattttgtttaaatttaaaaaatccagttttgttgaactccctttattctaataataatttttatagatttccttatattttctatatagatttcttatcatttgcagataataaaattttttgcccctttagctcaattattgaaactaatttatttttcctctcctatagcattggctaggatcatcaatatactgtaaataatggtaatcttatggttgactttaaagaaaacatttctaacatttttgttgctacatttttatgaggggtaaacagtggttcatattgtacttgaatttaaagttaatttgtttttgcaaaagaaagataatcttagtgaacatctttttaaaaaagtttaactttttcaccttttcttagaaaaaagaaatattgaaaacaagaatgaaaaatagggctatattctatggaataaagtactaacttgcacaaatcattatttgatgcctttaagcaatttctattctttgcatgtttttgccttaagttttaatgtacatacttaccaatgtatgaatttttcagtatctccatcctcttccagaacatcatgagcaccatacaatgtttaaaatgcccattgaagaccctatattccttattatacttactttagaggatttgtatcaatttttttaaagtacaaaatacagatttttgttctatagctggtagtgaagaaatacaccaacttgttcgttttgatatgtttgctgttgtttgttgcattgtactccttacctctaggtttactttctttcttgctatagtccttccttctgtggggataagtagatttttgtgtaaaaatgtttttatttcactgctactattggaagagagttttgataggtaattgaattattctaagtaggtgtttagctcccttagcactttgaatatattactcctttaatatttttgtctatgagagagctcctaattatttttggcaggtaatctatattttctgctaaagctttttaacatttttcctttttcctttaagtccttaattcatccagaataaatttttatatatattatgaggtatggggaaaattccaatttaatttttttccatatgaataaccagttcttccagtaccatttattttgtagtccccctttccccttcaactgacttgcagtaaaacctctatttttaagcaagttccacatatgcatggatttgcttataggctttctaatatgatccgtgggtcaatttgtttatcccaaactatttataatgaatcttgatatcacattgggcacagttattcttggtcctttgatcatctatataaattataaaagcagattatatgtaaataaatgttggtgttttgattgatttcaaattttatttatctatttttggagacagggtctcactctattgcccttgctggagtgcagcaacgtgatcatagcttactatagtctcaaactctgggctcaagcagttctcctatctcagcctcctgaattcctgggattacaggcttgagccaccattcctggctctgattgcacattatatatatatatatcaatttgaggaaacaacatcatatggtattctgtttttttattgatagatgatcttaccattttttgttgttttctttaaagtctttctaataaagttataattttatgcatataggtcttatacatcttctgttagacttagtcctctgtaccttatgttttttgttcttattatcgtttctttacaaaaactaatgctttgattgacgttaatagacatgtgaaataaatttttctgtgctgtgactatattcaaacactttgctaaattatagaatagtaatatctattctaataactctaatgaattatctgtagattattttggatttactgtagagataataactatctgttatgaatgagttttggttctttttcttactttgcttcacagcttaggcgctaccatacaacaatgaatagaaattatggttgtaggcatccttgttttattcttgattttaaaggaaattcttcctaatttcttttccactaggaatgagctatctttcagattaaggagactcccttctatacgaagtttgctggtagtgtttatagtgcttgtccattaaactttatcaaatactttttttatgcatctgttaagctggtcttctcatttattcatttgaaaaaattctgtcaatatgtgaatgaaatttaaatatattctaatataaagctaccatttcatttctatgataaacccaagctggcttattcttgaaatttataatttgtaaatgtaattacaggttcgatttgctaatattgtatttaggattttgaaagagtttcatttttcaggtagactggcctgtaattttattttcttagattatctttttaagttttggtatcaagtttactagactcttagcatgacctggggactgttttcctcttcttattttctggcagaattttaataataccatctgaatcattttgttttaggattcttttttgatgggaatactgttaatgtactgtttcaattactttattagttgtgagactactcaggatttctggttttttttaaagacagttttagcgacttatgtttttgttaacaaagtttttaaatttattaactgagttgacagtaaaatattattctgatgttttaaatttttgtcaaaaattgagtgtgcccccatttttttcttgcagtttgtaccactttttatgcttctttttttttcttgataactctttctctacgggattttctatttttggatcttctagaaaaccagtatttgtggccatctttaatcctttttctggttgctttaagatattcttttgtccttattgatctacggttttactacaatgcaattagttctggattcatttctaaatttataccgtgtagatcttatagtgctctttctgtttaaagactttctttagctttggaaaactatcaactcaatctttttggaatataccttctacaccactcttgtattatcttctggaattcatgttaggcatagtttcttgatttatctttcatgcttcctaatgactatttcataggtctttatttatatttttgtgttatattctttctgaattctttagtaacatctccagaaatgttcttgctagctgttctgtacagaatgtgttatttctattgagttataaaaattactttcttattatcttgtagttctttttcatgtctatctgttcttgttttgtcatttcaaatttcttgttcttataaacattgatctctcagaggattatatctctcagaggattataaaaattcttattttaaagtcttttttggacacttttctttttttttttttttttgagacagagtttcgcccttgtcacccaggctggagtgcagtggcatgatctcggctcactgcaacctccacctcccgggttcaagggattctcctgcctcagcctcctgagtagctgggattacaggcacctgccaccacgcctggctaactttttgtatttttagtagagacaggattttcaccatgttgggcaggctggtcgcgaactcctgccctcaggtgatccgctcgcttaggcctcccaaagtgctgggattacaggtgtgagtcaccgcacctggccttgaacacttttctattttcattttgtttagagacaatctatgcacaaattatcaattttattatcttttttatcattaaacatctgtgtttggaggtttagattgcctacttctcttgcatggcatatagcctctcccttcagcacaatgtgataattggatgcttgcccccacttggcacttcaaggctatcaatccagagccaggtctgggggcttccgtgcctttcctgaagactcagtgagctgtttggctcaggtcacgaggctgtgtttaggtattcctgcctttcaacatacaagctctacatgagccatagccagcagcatcagcttttctcagcctcctttcccagtgatggagcttcagccaatgtttttttcttaagcggaaaacctgtctcagacctgtgtttcagataggtgtatttaaaccatatattgccatagaatttatttctgcttctccatatccagaagactttaagtttcattctgttttctatcttgcatgtctgtcctgtttctaatcttgaaattatgagattccgtttaactcttgagccaaaaatgtcttggtctgacccatagccaaggtcaggctggtttcccctccacacagtgacatttattttgtgcatcctgtgtaagtcagcattctttccctcaaagactcttcattgcaccaggggctcttctttagaaacagtggtcctttctgatccacattttcagggattccctttcttctgacctatgattcaaatgttcaacatgaaaacagcacatccaatgggctagctgggaaagctagtttgtaatctacttctgctatttactgggtttatattgcttgggaaatattttgttacattgaatattcattttcgaatctgtaactttttagggaagttatgaaaattaaatatcatgttatcagtgaaaacacaattgaagtactaaagtgccatggaaatgttcagctgtatgtctcctgtagattgaaagcattggaaacttctttggaacaaatgtgtgatagctgagagttgttttaggaagccattattttcacgtattcattcaaccattatttactgagtagctgctatgtagctggcactgaactaggcacagtgaggtgatgctgcccagtggggttagatctcacttgtgctttagttctcatccaatgagagctcagatatgtctaaataaacaattgtgatgtcagtaacacaggcagaaacagacccaaaggaaaatagggaagcttggttacagttgaaaaacccttagtcactttgacacatctgctctttacactggtattttcttggtttaagtgacgacatactgaaatgactgggtcaaatcaacaaatcagatattgcaaaaccagtatttttccaaaaattgactgtatatataaagtcagccagtgctgacttcgtatttttagatagtaagtgcagaaatataacttcctcttctttctgtctctagtttttactgttgacctatccctatgctcctcaactggacgctagtctcttgtaggaaataaatctctttaagaaagatgaaagaggttggtatgtatgccaggcacttgctagccttatactccctacgtccctaattttgaccttcatataaccacagatttacacagttaaaagctgggaataaggcagcatagcagtcctttttttttttttttttttttttttttgtggcagggtcttaccctattgcccatgctggagtgcagtagcatgatcatagctcactgtaacctcaacctcccaggcttaagtgatccttctacatcagcctcttttttaaaaaaattatttatttatttttgagacaaagttttgctcttgttgcctggggtggagtacaattgtgccatctcagctcaccacaacctctgcctcccaggttcaagtgattatcctgcctcagcctcccgagtacctgagattacagatgcctgccatcacacccagctaatttttgtatttttagtagagatggggtttcgccatgttggccagtctggtcttgaactcctgacctcaggcgatccacctgcttcagcctcccaaagtattgggattacaggcgtgagccactgtgcccagcctcctcggcctcttaagaactggtgtgcaccaccatacccagctaattagaaaaaaaaatttgtagagataaggtctcactatgttgcccaggcttgtttcaaactcctggtctcaagcaatcctcccacttcaacctcctaaagtgctgagattacaggcgtaagccactgccctcagccctcaaagcagtattaaagctagtctagactatattatggtacagaaagaacaagaagttgattgagtcaagcatttgattgatttattgctcgattttatattggcaaccataagggttgctgttaattgttactagtatcaaagtttggaaaattctgcccagttattgttcaatctttgaagactgaggaacaagccatgttcctcttaagcatttaatgacgttcttgcaattttattattttctttcctttaatccttctccaaatatacattttttgcctcttcctttttagccttcatctactccttgcagattgctttgtggcaaggattgcttgtttcaactaggctgtctttcctttggcctaagagtccacaggcaaacctgagctgtgcccacttgctaggcttgctatagggacctgaatttgcaaaggaaggggaacagtagagaataaataatgggagacagtgagcctatggctatgtcttttcagatgccttctgcctggtttgttttagattgccattgcctcagtcccctctgtgggataggccaagacttgtgtgctgtcttgacccatgtggcagctacttaattcccactgtgggtctcagctctcgtgtgctggggcagccaagaagggaggcagttaagaagttagggtgcttagcagtgttctaagtttagcccgctaaggaagcatttcagatagttctgttctccttttttgtgtggaaaataaatagctgtccaagccaggcacggtgcctcacgcctgtaatccctttgggaagctgaggtaggcagatcacgaggtcaggagttcgagatcagcctggccagcgtggtgaaaccccgtcgctactaaaaagacagaaatttggccgggcatggtggggcgtgcctgtaatcccagctacttgggaggctgaggcagaagaattgcttgaacccgggaggtggaggtctttgggcttgtatgttgatggtgatatttgtagagcattaactaagttctagtcactgttctaaaaattttacatctatgcactcatctaatcctcataacatttctggggtttaggctctattattgtcttcatcctacagatgtgggaatcctagagtataaatccttgcctaaacagcaagtacgttttcacaaacccaaataatcttattaaaataattgtttaaataaaagtatattttattgtttttcttgttttttaaaagaaagcttgttggtactactagattattttttgagggcatagtattctcaatatcctccttttatacagcaaaaatattttaaatggatgagatggaatggtagtactagaaagaaaggtaaaaaatttaatgacaaatctcaacacctagaattaaattgctagcttcactggggtttcctaataataaaaacttttttttttttttttttaatctcacagcaaactttgaaacaaaaatgggtggagtacagatctctgcagttacaggaacatcgtctgcttcatggtaaatgcaatttcctgttcagaaaccacactaacattacttctttcagtatttctgcctcaaagttggtttaagattatcatcattataagaaaaatttgtctagtgctggtcaaggaaatgggtctgtgtttctttggcatgagctttggaatggctgtatttggaggaggggtaaggcaagtcagatccactactgcgtatcatgacgcagatgcacatgcacacagatgcacatgctcgaaaacaggcacctggagattttagaaaatcattggggaagattgcctaactttccttctacttcagtgaatgaattacatttctgaaaacaatcacggctaaggggctgtatagtttttagaagctattaaagctggaatggttgcacacttattgggtagagctcctgtcttttgtttaaattgcataagttgcatttatgcagagaaattctttttcatggcccccaagacaaagacataaatgcgtaagatgaatacaacagtaaatgcatagctcttgccattgagtgcatttttaagggaagggttgagtttaaaatgtgttaattcgctatttgttgtatgatagatgtaaccaaaggaatgaacttttgtgtacaaataattcactgaaaccactacgtgggtgtgaaatatagcttatctcttctttaaatagcaccaagcttaagtctgtaacctagaatatctgttaaaagtgataatcaatttgtttaccaaaaaagataacaatttaatccttaactagtcactaatttatggcttagagttctggtatgaacttctgtttttttttttttaaattgaagtgtttgaaacttatgtacaagttacttctcttttttatgtcttcatttaatatttttaaaaaattcataatagttcttttgggtagtgaagtttgttagagaggcagaaatatttaatacaaaaacttctttatggccttgtaaattcagccacctccttgctttctttagacatgagggctttttagcctcatttccacttctggagcatcctgaatggcccagtgaatataaattcttgctgttctatagaaacagccttgtatagacaacattgttaggtcaggatcctcataaagtcattgttgtacatattttttgagcaattgaaggagttctgctttttctagatgtatagtaaacatccagggcatgtgattctataaggcaattgctctccaatcaaaagaaattcatcacttattgcaagatgaaatgaagtaggttgtattagcaaaaaggaaagcattatgactagtcaccatggggctggctgtactcaaccttgcaaatcatctgaaagaacagtttctttttatattgtcaaccgaggacaaaagacagcagcagtggagataatcagtacaaaataaaaccattttagagtgtacagtattctattattttttctgaagcatagtcacttactgattacgtttttccaaggctggtattacaagttctctctctctctctctctctctctcacacacacacacacacaagataccaaccaactcagttagtgtggaagcagggagggtcatattggtatgtgattaacattagagtttgaagagccagatgtacgttgttaaggatcaatgaaaaaaatttagccaagcagataaaattcaatttcttcaaataaattattacttacttgaggacaaggatgatttctgggtacagtatcattccagagaatttaagtattccaaaacgaaactgggaatattgaggttggaagatacatttgatttcacaaatcctttctctaagaaacacttttgaattacctgttccataactgttttctatttacttcaaatggttttataataattttagaattatttttaaaagacagtacctaagaatcagagaaactaagtggagaaaatcatgatagtatttccccaagtgtattctatggaaccccatttctgtgagaattttaataaaaggtttcagggttatttaaatttaagaaatgatcattttggaggttcagatgccacactggtagactgtcaattgggctgaactgttctcatatgaaacatcttgtttaaatttattctaatattataatttttgtgaccatggaaccttggtctatgaacaatagttcaggaaaccctactataaggtttatcaaatggtctcataaacagttacttattcaagcacgccaaagctcagtgaaaagtatttttcacccttactctttctcgtgtcattcaaagagaagttttgatgtagtgtatttatttgtagggagtaatgaacagatccatttcacagtagactttgtgctctaggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgggtggggatgtcgtgttttttgcccaattcagcttttgttctgcctgaacattaatggcaagtctagaactctccgaatcctacagctttgtaattttttttctacaaatgtctaacatccaaaactgagggttgggaaaaggacttccctcctgtagtttttttcatattacttctcactttatatcttatattctaaatagctatcacctcagcagtcttttgcctattggttatgttagtatcacattacttctagcctttcaattactccatgttttatttaatatccattgaagtctatgaattctctgttctggtggcacagctattcataacctatattctagagtagacaatctggactatgtaataaatagtctgctgattttaagttctctctctctctctctctctctgtgcgtgtgtgtgtgtgtttgggagaaatagaaacacttcaatttaagtagagctgctaaatttaattaaacttctgcttaagaaatgagttattttgagataaaagagggtagggtaaggaagcatctaagatgagaaagaaatgataaagtatgaaaagatttctagttgggacttgccttctattaactctttgaactgagaaacatccagtggcctgtgcatgacagtcactcatatgaaaggcagggtgtcacacctttcacagaaatgatagcaatactgtctaccatttactgagtacctagttggctaaagacactttacgtatgatcctcacaattactatatagtaggtgttaggcatacagataacaagtcaggaatttggaaatgttctcagggtcacaaggctagtcagtggcagggctaaaattggaagccagttcttccttgctctagtctattccagatatcttttactcttttggttctgtttagtgatcatcacagtactttttattccacccaacaggaatacttaaaatgtacaattatagatgctgcacagataagagcatttctttgggtaaataggaaaacaaacatttctctgttcctcatacacaagtttcagacataggttctttaataactacatgattagcagtgcatttattttcaacaagagcttgcaaaccagttatgattcaactggtattgcttatttctcatcatagtctagaatcatcctgttaaaggtctacttatatgaattcagcatttcttgttatcctatttcacaaagtccaggggaaggaaacaccacatttatttgaggaaagatgactttgaaatcttctacaaggtgaaaaaatgctttgagaactacacagaatgacataggtcatacgggaaagcagaccatagatcatttgcttttcttgtgactttaatacagaagtgtaacactgctgtatgacagtagacctcaaatgcaaaaaaggggcagggaagggacggagcaagcatcactttagtttgcggtaagaattagagtcgaggtatgttctgagaataaagaaaaaagtactggttaaccaaagtacaggaaggaagggtatgtcatgttctatatttcacaagctgtaagaaaattagcttttgtttagtagaaatgtgggtaaatttctcacagtataactttcagactaatttatgacttcagtcaggctttagaagaaacttctggtgcatagtgattcattctgatataatttactaggaaaaaaattgaaaagtgtttttttaacttgaaagttctcaaatatgtattactggtgaattccattaattgacaacctgttatgaaaatgcatttttctagaagggcatttgataaaccaaatttgaatcaagtagattgggaattactttatcatgtggctgaagaacacaaccatgacaaacagattagtaatatatttttggaagtgaacttttatttatgactttctaccttgtaataattttatatcttaagatacagatagcatttaaaatcccagtttgcgctgaatagatcaaacttggaaatagtatgtgtgtcttgatcaccaaagtacagacatttttgaatgtatacatactaaaaatagtaagtaatacataactatattgagcccctcagatcataaaagtattgttattttatatccatttccttacatacctatgggctacaaaatcaaaatttgatgcctttatgaaataaagaatgctatttttcagtgtcaggactttctctctctttctctgtctctctctctctccctacatttctctctaccataaagaaataattgtcttaaaagcagactttttaaaaaacctgggtgattctcaacatttacttctttgaggaccttaaaagacactacttacttaattgagactttgcactattagcttttttattgctatttaacaaattactgccaggcatggtggttcacacctgtaatcccagcactttgggaggccgaggtgggtggatcacctgaggtcaggagtttgagaccagcctgaccaagatgatgaaaccccgtctatactaaaaatacaaaaattagccgggtgtagtggtgcatgcctgtaatcccagctactccgtaggctgaggcaggagaatcgcttgaatccgggaggtggagattgcagtgagccgagatcacaccattgccctccagcctgggcaagaaaagtgaaactccatctcaaaaaataataataataataaaataaaaataaataaataataaccacaaacttagaagcctaaaatatatttattatctcaaagcttctgtgggccaggagtctgggcacaggttagctggatctgctcaggatctcacaaacctgcaatttactgcaattttggtgttgttatctggaggcttgattggagaaggatcaacctttaagctccttcaggttgctgtcagaatcattacctggtggccatacaattcatggcagcttgattcttaaaggctggtaatgaagaggaaaaagggagaggctacaaacaagacagagtcttaaataatacaatgttatcgcctttgccatgtaacataacctcttaagtgacttcccgtcacctcgcctaataatgtaacattaagatgggaatagtatcctatcaactgtaccatgttctgtttgttagaaacatgtcacaggcccacccacactcaagaagcagggattacacaatcatgaatattaggagttagggatcaggggaccaccttagtctgtttgtaacaccattcaaggagttcacagacttgataatataagggtattgagctgtctctaaatctccttgagtaaaaattagtgactgtcataataatttccacataaagaaatggaagcattagtgaattttggaatgaaataacctggtcaagattgcataactagccaaaaagttgattaagaaactttctggcctcctgactttgtctccttggtgcgtgaagtgataaaagaagatttaaaaagaataagaaagaatgaactagttacttgctttcaaattttacttgaatctgaatgcatttaagtgaatagtgattggcatactgaagtttgccacttctaggcaggcgcatcttcataagcagatgatagtaggaacttttacacagaaaagtaaacaaaacacttatcaaaactacaaagcacaaaaggaaatgatcagccatgagcaaaagttagacgatatcacaaaattatcagaacttgagggaaaaaaagaagtttgaaagaataaaaaatgtatatcttagaaataaaagataacttcctcagcttgataaagaacatctacaaaaagcctacagctaatattataatggtggcaaactggacactttccttaagatcagttacaaagcaaatacattttctctcacttctcctttctacattgtatgaaaaatcttcgctagtgcaataaggcaaggaaaagcaataaaagatacacaaattaggaaggaagaaaagaaactctttatgatgatatgttgtttatgtgaaaagtctcaaagaatcaacagtgcaacaaaaaatcctggcactactaagtgagtatagcaaggtcatgggatacaaggttaacatacaatagtcaattgctttcttacatatcaacaatgaacaactggaatttgaaaaaggaaaaacaatatgttgacagcatacaaaaataaaatacttagatataaatctaacaaaacattacaggatctcaatatggtaaactataaccctaaatagagagtcagtgttcatggattggaagactccatagttttacaattcagttcttcccaacttaatctgtagattcagtgtaatctcaatcaaaattctagcaagctattttgtagacatcaacaaattaattctaaagtttatacggaacggcaaaagacatataatggccaagaaaatactgaagaacaacaaagttggaggaattacaatatccttttaaagacttaatataaaatatagtcatcattacagcatggtattggcaaaagaatagacagataaatcagtggaacagaacagagtgcctagaaatagacacacacaaatatagtaattatctttgacacagaagtaaagtcaattaaatgtagaaaggatagtgttttcaacaaatggttctgtccaatatgcaagctcttatatgtttcacaaaaattgactcaaaatggatcatagacataggtataaaacacaaaactataatacttctataagatagcataggagaaattctagatttcctttggtgtcgtaatgagtttttggatacatcaaaaggatgatttatgaaagaaaaagttgatacattagactttataaaaattaaaacttctgctttgtgaatggcactgttcagagaatcaaaagacaagtcataggctgtgagaaaatatggatatacaaacggttacatctataagatgcaatattattcagctacaaagaaataatctatcaagtcattaaaagacactatgaatcttaaatgcatgttgttaggtaaaagaaactagtttgagaagactaatactgtatgtttccatttatatgacatggtggaagaggcaatactatagcaatagtaaagatatgagtggttttaaggagttagggctgggaagaaggcatggagatggttgaataggaggaagactggtgagttttatatagtgatgaaactcttctgtgcgatattgtaatcttggatacatgactctgcatttgccaaaacccatagcactttacagaatgaagagttatccttaaagcatgcaaattatcaaaaaatccacttaggtggttgggggatcccaggatagaatgaagaatgtgacaaaaacaatctaactgtatcaaaaatgtataaaacaacttaagagcgtggaaaaaaaagatgctgagctaagtagctctggaaatgattggagtttataaaatgaaagacaaaataaaacacacaaaaacattctgctctaacagaaaaacttaacagaaaaacttgctttccacatgaatacaattaataactctgacagtgctacatatgtatactgcaattgaagagttaataaattcttatggctgataatgggagtcagatttcttactgttggattcaaagttcacagataagtaagggagaatgctagattagacatccgtatgcactcaatattagcttaataaaagtatggatgattacatacataaatatttatagatatctgtgtatgcatgaattagtttatacacacttatttccttgctctgtcagctgagaggtcaaggaagtaatgacactttagcagcaatgaacacacatagcaccaagatcttggcttctaataccattccccaataaaataaaccagagttacgtggagaaatggcttattctaggtctggggcagggaatgaacaagaagggcctgcagcatcttgtaatgtcagaaagtaataaaatatttttaaaaaaccttataaagattgagatatgtcaaagggaaatagaagtcaatcagaagggctcctaatggccaaagatgaaacacttggagcaacaaataaaacagtattaaattataacccaaaatataaaataagtatacattcatgtgtccatagcgatataaataaatgactgagtaaataataaatggagtgaagagacaaacctcctgtatggaaaaatttcccgttacttatgtagatactccaccctcaaggaagaggagcagaactcctcattccttaagtgtgggctgaatatgatgacctttttccaaagggtatggtatggaaaaaggggaaaagtaatttaacagtagtgaaacctgacaaacactactccagccaggtgatcgagatcaacatcaattgccataggtttatgttgctaatatgtgtccttgatattatatagtgagaatgacactttgtctcagtggtcctcttgcccagtacccatagcttcagtctaatcatgagaaaaacaccaaacaaattccaattaagagatactctataaaatatccgccagcacttcccaaaactgtcaagatcattaaaaatgagtagagtgagagaatctgtcatagccaagaaaagcctaaggagacatgatgactaaatagaacatggtatcctggagaacaacctggagcagaaaaggacactaggtaaaaaggaattctgaataaagtttaaactttagttaataatgtgccaatattggttcagtacttgtaacaaatataccataatcacattagatgtgaataataggaaactgggtacaaagtatttttgcgctcagtctcccctattcacatctaatattgggaaccctgtgctatcttcacaatttttctgtaaatataaaattgttctaaaaaataaagtttactaaaaaataagcacattttaattaactaaaaagagtaaaacgaataaataaaaaccacagtggaataataaagtatttgaattaattgagaaaatttaaatacttttttaaattttatgtaaaatttaacataaaatgtaaacaaaattttattttaaaaacattggccgacttgggccgggcgcagtggctcacgtctgtaatcccagcactttgggaggccgaggcgggtggatcactaggtcaggagatcgagaccatcctggctagcacggtgaaaccccgtatctactaaaaatataaaaaattagccgggcatggtggctggcacctgtagtcccagctactcgggaggctgaggcaggagaatggcgtgaacccgggagttggaggttgcagtgagccgagatcgcaccactgcactccatccagggcgacagagcgagactccgtctaaaaaaaaaaaaaaaaattggcagacttgtggcttctggtcgggcatgtaacgaagttggaagtcacaactctgtcttaacagcaagtaaaaaacttaacagccgggcgcagtggctcatgcctgtaatcccagcactttgggaggccgatgctggtggatcacgaggtcaggagtttaagaccagcctggccaagatggtgaaaccccgtctctactaaaaatacaaaaattagccaggcctggtggtaggcgcctgtaatcccagctatttgggaggctgaggcagagaatggtttgaacccgggagggagaggttgcagtgagccgagattgcaccactgcactccagcctgggcaacagactgaaactatgtcttaaaaaaaaaaaaaaaaaggaaagaaagaaagaaaaaaaaaacttaactgaaaaatcaacagctctttttagatgcatcaaagaagtgaggtcacagggcaaatcactgtcccgttaattgcagacaggcacatgcaaagaatcatgatggactagggcaggaacccacagcagaaacttatatatctctttatagagaaataaatatgttgtgtacatgaaatccactttaaatatagaatttaaaagtatatgatggaaaagtacataccatgttgtcactactttaaagaaagtgggagtatctgtattaatttcaaacagaagagacttcagagcaaagaaaattatcagggataaagaggaacattatataatgataaagggaccaattctgcaagaagacatagcaatttttaatgcatatgtgcctagcaaagcagcaaaacacatgaaatgaaaactaactgtagtctgttagtttaatccactattacagttggagaattcaacaccctctaccagaaatggacaaatatagcaggcagaaaatctgcaaggacatagctgaaatcaataacatcatcaatcaactgaatatagctgatatctatcaactactttattctaaaacagaaaaatacacattcttcctcaactcacatggattattcatcaacatagaccacatactggaccataaaatataccttaacaaatttaagagaacataaatcttccaatgtctgctctcagatcacaatagatctaaagaagtaaattagctagaaaattcctcaaatacttggagattaaacaacacacttctaaataacacagaggtcaatgaagaaatatcaagaggaattaaaaaatattttaaaataaataaaaataaaaacaacatatcaaaaattgtggtatgcagcaaaagcagtgcttactgggaaattcagaacatttaatgcatgtattagaaaggggaaaagatctaaaatcaataatataagcttccacctttggaaatttaaaagaaatgcaaattaaatccaaaatatatagaataatataattaacaacaattagaacataaatcaataaaatagaaactagaaattcagtagagaaaatcatgaaaccagagctagttccctgagaacattaacaaaattgaaaagcctttagcaaggctaacttaaaaaaaagagagagagaaccataaaaaccctagaagaaaacctagacattaccattcaggacataggcatggtcaaggacttcatgtctaaaacaccaaaagcaatggcaacaaaagccaaaattgacaaatgggatctaattaaactaaagagcttctgcacatcaaaacaaactaccatcagagagaacaggcatgggagaaaatttttgcaatcatctactcatctgacaaagggctaatatccagaatctgcaaagaactcaaacaaatttacaagaaaaaaaacaaacaaccccatcaacaagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcagggaacaacaggtgctggagaggatgtgaagcaatcctcttttacactagaaacacttttacactgttggtgggactgtaaactagttcagctattgtggaagtcagtgtggtgattcctcaagtatctagaactagaaataccatttgacccagcaatcccattactgggtatatacccaaaggattataaatcatgctgctataaagacatatgcacacgtatgtttattgtggcactattcacaatagcaaagacttggaacaaacccaaatgtccagcaatgatagactggattaagaaaatgtggcacatatacaccatggaatactatgcagccttaaaaaatgatgagttcatgtcctttgtagggacatggatgaagctggaaaccatcattctcagcaaactattgcaaggacaaaaaaccaaacacctcatgttctcactcataggtgggaattgaacaatgagaacacatggacacaggaaggggaacatcacacactggggcctgttgtggggtggggggaggggggagg

SEQ ID NO: 473 - DNA, 1773 bp, Homo sapiens
ggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcaggtatgattgctattttgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgg

SEQ ID NO: 474 - protein, 291 aa, Homo sapiens
DFSWSQRKLVTVEKQDNETFGFEIQSYRPQNQNACSSEMFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGDAANCPSLENMDLDELSLFGPLPGPGPALVDRNRLSSESSCKSWLSSMTMDSEDGYQTCVSEDSSRGAFSRQTSTDDECFIPKEGDDFLRRSSSRRNRSISNTSSGSMSPLWEGNLSSMFGTLPRKSRKGSVRKQLLKFIPGLHRAVEEEESRF

SEQ ID NO: 475 - DNA, 42514 bp, Mus musculus
  misc_feature (1)...(42514): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaggctaaaaacgctgaagacaggatcagaacaaggttaaaactctactcctttggttttcccaccagccaggccacatttcttcattggccttctctttcactttgccagcagggttgttgttggacacgtgaagttgtttaataatgtttgatcttgggcgccttttggaaaggaaaaatgtttaaatttacgaaattccttgctgataatagcgatttttttgagagtggtggtggggttagagaaagggtttctctgtgtagccctggctgctctggaacttgctctgtagaccaggctggacataaactccaagatccacctgcttctgcctcccaagtgctggaattaaaggggtggtgtcgtcacacacaaccagcttatatctatcatttttacttttagcacaggaaattgaagcttcctccatcgagaacccaccaagcccccacctcttatgtcaaattgaacggtgctctagactgcattatgcatagagggcaaatataaagagctcttgtagattccctcagcagctgactgagggagaagttcccgtctcatgagggcctctcagctccactgaagaagcatgaatgaatctttgtatcaggggtgatccacagggagtgttagtgctgcttgcgattttgctggcatctctatactcttcgtgtgtggcagcctaagaccgcaagcagaagaacttgccagaactttgccagcactaacccagcgcttctcaacttcctaaggttgcgacccttcaacatagcgcctcatgttgtggtgccctgctaccataatttttccattgctacttcataactgtaatttttttgctgctgttatgagttgtaaggtaaactatctgatatgcgacccccaaaagggtcacgacccacaggctgagaaccgctgccttagccagccttgagggagggatgatgttgtttcctcggtcagaaaaaaaaaggacaactcatcgcaagattaagactctgtaatctcaacagatctgaaataaagaatgagcatccgttttctagttatattcagaaggacggcttagtcaaccactttgcacttccaaaatgccttccctctcttcagagtgtctctcagagcacatggaccttcctcattggtcagattttctgtcagtaccaccaataattgctattggtccattttgaagattctcccgccttcttttacctaattggttcattcgaaaaggcggtcttttattcgaataaaagacgatctacgattggttactgcaaacagagccaatgagagcgagtcggtgattggtttctctgatttgggcgggctagataaaggttcaaatgaaactagggaagctctcctaaccgacaagcgtctgtgaggggagcgtccaggtcccgcgtcgcgcgtcgcgggtcgcccagcgtttcccgctggttttgtcgctttccggattctcgagcctcttcaggacggtcaccatggagttgtcaccgctgcaggtacagctcgcggatggggccgggtagtagagcctttacgtggcctctgcgttcatggctgacggcgagagttgaggttccagggccgagcgctggccggcgaccggctggatccggtcagccccatcttctgggccttgaggggtcgtggactgggtgaagctctttccgaaatgatatctataatccaatctgggttcttgagtgttgtgtttttattgtttgtgggagcaggttcaactcgtcctgcgatcggtctgtagtctaatggcttctgtgtgacttccagccggcttatactcgaattcagtggccctcttcccttccctgggtgatttgaataactcatcacggaaggtgcagagcatggcagttcccattgaggagctggccgaccgagtggctcaaaaaaagtccagtttcgggatgtgaatgtagccaagggtttgcattgctagcatcccaactgctacgggtggataccatctgtaatcggcacgagcctatgtcggcactcagtaaatattttcccattagatggaagaagttgagtgtagtttatcgatgacataaaaaatattactcaaggcagaaatgtccatacttgcagaactaaaatacctatttaaacgggcatctgtagccagacctagtggggcaggcctgaaatggcagctgctccagagactgaggcaagaggatgccttaagctatttaatgggactctcaaaaacagcaacagggggtgaaaaaaatggtctgggaattttgctcagtggtcagagcatttgcctagcatgtgcatgcaagggggggtggggggaccttgggttccatccccagcatcacgaatactcaaaccacagaacctaatcacaaggattttaattgacttgttcgttcaaaactatgtaaactctaccagtacctacaagcaggggatagatggtgatagagtgtatggactttatcattgttgcagatattttgttgaccacttctgataaacttgtggctaaaattaagtttatttttaattcccctaatggctagcctgtaaatgaaaatatgctaatgaacaaaaagaagaatgaagatggcaagaaaagattgtctattgaaagaatctatcagaaaaaaacacaactggaacatatactgctccgcccagatacctacattggctctgtggagttagtgacccaggtaaaaccaaactagcaaagtgcgcttgctttattgtcatggcatactttgtcaggattttttttttttttttttacttatttactgtcattggaactgatccatcattcatgtatatactgcaggcgtgtgtgtgtgtgtgtgtgtatgtgtgtgtgtgtgtgtttcaacattctagaagaccactcctggttgtgttggtgcacgcctttgatcccaacactcaggagtcagaggcaggtggatctctgaggccagcctggtctgtgtagccagtttctggccagtcagtgctacatagtgagacactgtctcaaaaaagaaaaggctaagagtgttaatgacaaaacaataaatagatagatagagagataaaaataactttctttgccttttctagcaaatgtgggtttacgatgaagatgttggcattaactacagggaagtcacttttgttcctggtttgtataaaatctttgatgagattctaggtaagtaaatattttgatataaagatctactggttaagtcctaggtatcattcatagcaaaccttctgtagatatagctgctgtcatttcaagtagttagtggtcagaagtgagacagtcgggctgcacgcggcagctcacacctttaatccctgcacaggtgggtaaatgtctggattgaaagtcggcttgatctacataatgagttctggggcagttagaccctacctcaaaaagaaaaaagaaaaagaaagaagcagtccaataaagtccagaaaattcactttttctctggaaatagtactgtgaacagaagttgctataataagccagcaaggtgttaattccaatgctgaggagatagatgcaggaagatcaagagctcaaggttgttctttgccatgtagcaagttcaaagtcagcatgaaatgcttgtggttctgtctcaataaagactgctgtaaactaaggccttgttaatggcattttttttttgttacttgtgaatctaatgtgttttaaagcactttaatgtcttctaagtgtatattttattttcttacagttaatgctgctgataacaaacaaagggacccaaaaatgtcttgtattagagtcacaattgatccgtaagtggaagctgtttgctgaagctcatatttattgttgtacttgctttgattactagtgaagatagcttcttttaaattaaggtttcctgctggtcatggtagcacacacttttaatttcagcagttttgggaggaagagaggcaggctgatctcctgagttcaaggccagcttgctctgtaaagctaagtccagggaagccagggttatataaggaaaccttgtctcaaaaaaaaagtgaagtttgaattagtgcagaaagactggagtctaaaatgagtagcctgtgggtacccaacaattacacctagtattgtttcttttcctttgatgacttatttatttatttgctcgtttgtttgttagttggcagacagggtctcactgtgtagctctagctaatgtagaacttgctatgtagcttgagaatgccggccaaactcaggaatctgcatacctctgctatggttaaaagtcagcactaccacacctaatcaagttttctagttgggtctggtggtataggcctgtaatcctaactgcttgggttgaggcaggaatatgacaagctgagagccagcctgagcaatgtactgagaccatgtcccaaaataaaagttttatattaaaaaaaggactgagaggtctggagaggtggctcagcagttaagagcactggctgctcttccagaggtcctgagttcaagccccagcaaccacatagtggctgatgatcccaaataagatctggtgccctcttctggtctgcaggcaaacatggatgcaaaatactatacatacatacatacatgtttttgttttttttaaaaaggtctggagagatggctcttcagttaagagcactgactcctcttccataggtcctgagttcaaatcccagcaaccacatggggctcacaaccacccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatctatcccagagatgttcctgcctgtctcccaactgctaagattaaaggtgtgcaccaccactctcaacaaagggaagaactttctttttttaaaaaaaaaacttaatttttttgtaaagatttaagtgttttatgtatgtggggtcgagaccagacaagggctacataatgagactgactcaaaatgagaaagaaggctgggtgtgatgatatacacctttagtcactttaagcacttgtgaggcagaggcaggtggcaccatgaaaagccaacctggtctatagagcaagtcttaagacagccaggactgactatatagaggaaaccctgtctcaaaaacaaaaggaaaaaggagagaaaggagaaaattgattagtaaataaagtaaactatatttaatagctttgccagaaataaagaaagttgaagaacttggagaaatgactctgcagttagcatttgccagagtcaatccccagtaccaagatgctgcttcacaactatgtgtgactccagtcctagccgatcagacaccctttctgcggtctgcatatgcaggcaacacacacacacacctcaaaatattaaagctgtgttagctcaggaactacagctcagtagtagattgctgcctgccatgagcaaagtcgtgttcccattctactattcaaaaagaaaataaacataaggaaaaaaatttaaatggtcattaccaaggcttttagaatgcagtttctcatttgctgtggacatgaccataaagaaaaattccaatgaggtttttcatatgctacttgactagcagttaacctgttgggaacacgtgttgatgaacagcacatctttacccagttactaatgatacatggatggttctagaatgctcatctgattcctcccatgttcttatgcagggctggatgacatttgagaacggtaacctggatggacagcaaaggaatcaaatcccttaaataagaatttatttgacttaatttataaaaataaataattatatatagttaaaaaaaaagaaccttttatatagtttgtatgaagtcagcatgtattttgggtctggagtttctagtgttttatttcaatttgtacttggttgaatgaggctagctcctgctcttccttcctcttgctttgttttctcttctctttgctgtttcaccccagctaactgcctgtgtaacctgtaagagagatttgtggaattaggctggtgcatgtagcaaaataataaaagcaagtgaatgaaaaaaaaagaaaaaaatttagttgagtaatagtaaaatagtgttatatatttatttgcccaggtggtcgaaatggctatggagctaaactgtgtaacatattcagcaccaaatttactgtggaaacagccagtagagagtacaagaaaatgttcaaacaggtaaagtaaagcttgtggtttgctaaactgtagaatcgtcatttataatatcattaatgtttggctaaattgaacaatttttaagctacataaaattattttctgatacctacatacttacattattttcctctagtttgtttgtgaaatgaattgtcttttcatctttcctgttctttactgccatagacgtggatggataacatggggagagctggtgacatggaactcaagccctttagtggagaagattatacatgtatcaccttccagcctgacttatctaagtttaaaatgcaaagcctggacaaagatattgttgcactgatggtcagaagagcatatgatatcgctggctccactaaagatgtcaaagtctttcttaatggaaatagtctgccagtgagtatttttctgggaatatgggctgcaaaggaattcatgatcatcactgtcaactgcacaatttgttttccacccacatttttcttattcccagataaggtggggaaaaaaaaagactatctcattttaatcttagtgaagggaatctgttttgttttttagataggctgtcactgtatagctctggttaacctacaattccactatgtagaccaggctagccttttttcttttttttctagacagggtttctctgtgtagtcctggctgtcctggaactccctctgtagaccaggctggcctcaaactcagagattcgcctgcctctgtctcccgagtgctgggattaaaggtgtgcgctaccacttcccagcatgagacttttttataaatttatttgtgtgtacatgtgatagcacatactacatgccatagcaagtgtgtggaggtcgggacagttttgtacacatcagtcctctaccatgtgggtcccagggattgaacctgaccacctgagttccagtctctggaacatatattggtaggaatgactgaatcctgaaatttcctcacctctgtgcataccatggcacatgcgtaccctcttttcttctccctgcgttccctctttcacatacacagaagctaaagttaaaaaaaaaagattgcaacctcattctctttattttatatgtgtgaatataaactcaaaattgacttgcacatatgtatgtgcattccatgagaatgcccgggaaggtcagaagaagtcatcagattcctagttgtagtcttctgtatgggtgaggacacctaaatgctggtcctattcaagactaacaagtactttttaaaccatctcttctgtcacctcacagttgattattggtcttattttccattgtttgtttgcttaagtttcccattaatttattttaacactcccttctttaatttctgtacaggtgaaaggattccgcagttacgtggatttgtatttgaaggataaggtagatgaaactgggaattcactgaaggtgatacatgaacaggtcaatccccggtgggaagtgtgcttaacaatgagcgagagaggcttccagcagattagcttcgtcaacagcattgcgacttctaaggnnnnnnnnnnnnnnnnnnnnggcggggttgcagtgaaggctcatcaggtgtgtacctatcaactttcccttttctaaacgtgggaaggtgaaaggggctgcatgtagcttagtataggaacttgcttcacatacacaaggacataaaagatatttccgtgactatctcgtcttttattacaggtgaaaaatcacatgtggatttttgtaaatgccttaattgaaaacccaacctttgactctcaaacaaaagaaaacatgactttacaagccaagagctttggatcaacatgtcaattaagtgaaaagttcatcaaagctgtgagtacttacttacatggaaattaaaatagaaatgtcttgtctttcattatcctctgccctatagaagcaaagattgcctgctgaagtatacttcttcagaacttctgtcttattttgttattgctgtgaagagacaccatgaccacattaactttttctccaaaaaagccatggtcaggcctgtcacaggaatttcgtgctcctggtaccaacttgttaggtttctggtgctcagacaaaacaccatgaccaaaaagcaagttggggaggaaagggttaattcagctcacacttccaggtcatagtcagatctcagggtccagcttcatagcccatactgcactctaactcaaagctctcctaccttggaccgcactatgcctgtgcctgatctgacaggttcaccaatcttacccagcttgcctgcagtcccccaaaacacaaattaaactagttatccaacactcattctcttcaaggaaccctactccccatcaaacaaaactgatagtttatgagagcactgtctccttttctaaaggtcctaagttcaattcccagcaaccacatggtggctcacaaccatctgttacggggcccaatgacctcttctagtatgtctgaagacagcgacagtgtactcaaatatataaaataaatttttaaaaaaagtcttactctagatttttagtctgcagagatggctcagcagttaagagcactgactgctcttctagcagtcctgagttcaattcccagcaatcacatggtggctcacagctatctgtatgatgcccttttctggtgtgtctgaaaacagtgacaatgtactcacatatgtagaataaatctgttaaaaaaaaaaaaaaagcactgataaaaacgtaagcgcttcttcctctttgtttccttccctccattctagccaggaaggagcatctgtctctagcgtcccactattaacctcttcttccgatactggagcagctccttaaccttcctgttgctacagtcttcccccacgaggctcgtgaatgacatttctggttttatccttgaaatgcttcaatgtcttccactcaggaaaaatccaacttccttgcttattgaaagtctttacattcttctttctttcagctaaattagttccagtatgatattgaacttactttattactacatagcaaacttcttaatcataactcatcacaattgtgatttcttagtattttttattgttttgttccccgcccacccaggcagggcttctctgtctagccttggctgttctggaacttgctctataggccagaggctggccttgtaagcacagaagtcttccagcctctgcctcccaggagctggggttaaaggcgtgcagcacttgtagtttcttatcttccatgttataccttcaaatacatgaagacacatacatggattgtttgcttctctgttttcatgtgcatgtagtttgcatatgtgtgtacatgtgttgtttctttaggcacatacatgtgtgtgagagatgtgcatggatgtggacacctgggacttgggacttattctggaccactcttccacataattcatgaggcagggtctctcagtcaaacttcgagctggccaatgtggctagtgtcacagttggcactggagatcgactatctcctttcccaaggctgggatcagaggtagactgccatagctctctggtatttacttgggttctatacagtaaagccttatacttatatccacaagctatctcctttgtcctaatttaaccactgtatcaccaacaagtagctcagtgccagacacagcataaggtcattggaaatattgagtgagccgagaggaaccagtttccttacggtaacagctaaaatggaaagagccagggctacttatatcacacacaccacacccagtctagaaatgctgcagttttttgagttttgttttgctttgtggtttggttgtttttgaaatatatttattgtatatgagtacactatcactgtcttcagacacaccagaagagggcatcagatctcattacagatggttgtgagccacgatgtggttgctgggaattttaaactcaggactgctggaaaagcagtcagtgctcttaactgctgaagccatcttcagcccccttttaggtatcttgttttcctgtgaacttatgtattctgtatttgactgaattcatgtgaatgtttctgttttgaaggcaattggttgtggtattgtggaaagcatactaaactgggtgaagttcaaggctcaaatccaactgaacaagaagtgttcagctgtaaaacataccaaaatcaagggaatccccaaacttgatgatgccaacgatgcaggtacgcacttaacattgttttcaataacaacagcataccatggatgttttctctttacacctacaatgttggacagaatagtttcctttttaaaaaaaccaactaaacaatttctaattgaatattttggttactttaaatttgtggcattttaagtaatattgagaagactttatagagaatacagtgatctacctaacaggtatttataatatattaaatgaatatccacagcagcataaatattatgaggcattagtttaggacattaagatgttaggcctgagggtggtggaagtgcacgcctttaatcctgacacttgggagacagaggcaggtggatttctgagttcaaggccagcctggtctacagaatgagttccaggacagccagggctacacagagaaaccctgtctcgggggtaatgaggttacaatactccattatttgtatggggatgtattcctaaagcctcggtgaattccagaaactatggataataccaacccctattgtaccatgtttttcttatacttatgataaaagcacagtgattgcagctgatagaacagttaaagcaatgtgcactataataactgtgagtctttctgtactatgaagattctgggaaatgctatatcatgagaaagattaagttcatacatggtttatatgcttttctccccagcacagccaggcagttctctgtgttcaaggccagccacagctacataatgagatgaataacataagcgttgtgacgttatatttatttactacattaatgattacttgaatttgcattcaagtactgtggtgccacgataaatgattggatgtggatcctctgccaagataatttgttatatactattgtgctttattatagttttttgacagtgtttaaatgattatgtttcaaattgagtcaaatgtgctaaaattaattattttagggagccgaaactctactgaatgcacacttatcctgactgagggagactcagcaaaaactctagccgtttcaggccttggagtggttggaagagacaaatatggggtgttccctcttagaggaaagatactcaatgtgcgagaagcctctcataaacaggtaagtgatgacactgttctgagcatctgaatctagagcacaccgagagtgtaactcaggggtgcagcacttgtctggatgcatgaggccttgtgactaatccatagcactacaaaagtgctggtagagggaacagaatttaaagctagtttgtagtgcaggctccgtacttctttattccctcactcactggcatcttagcagacctgatttattaaagtgtaaagtaatgattcaaaatactgagacataaacactcaaggaaaacatggttatatctctttattcctttcacacgtgtttcagatcatggaaaatgctgaaattaacaatatcatcaagattgtgggtctccagtacaaggaaaaactatgaagaatgaaggattcattgaaaactcttcgttatgggaagatcatgattatgacaggatcaggtcagattgtcagatttttaaactggtgtcaaatgtgtgggcttagctatgcacctcccacggcccacagagcagtgggaactacaagcaggtcttactattacactagttccctgccgtggaaagatatcactagaagctttgcctgttatctctagcaaacatcctgtcagaaaagctgacatcataatatatcacatgtacaagataagtaagtttacttttgaatagtctttgtttttaatttgcatagaagaacttttgagaaattgcccatcagtgataattttatttctaaacagttctttgtgctttggcttttgaaatatttgtaggaccaagatggttcccacatcaaaggcttgctgatcaattttatccatcacaattggccatctcttctgcgacatcgttttctagaagaatttatcactcccattgtaaaggtataaatgttcaagatgcaaaaacattctaaggctcatgcttaatactggctgtgtctgaaactctggctatgctaagtcagggagtcgacaatgtgcaaagccacagagctgtgttctttaccataggtgtccaaaaataagcaagaaatagcattctatagtcttcccgagtttgaagaatggaaaagttcgactccgaatcataaaaagtggaaagtcaaatactacaaaggtttgtaaggaaacccacatagaaattttcagctttttatgtaaggctctactggggaactaatctgttttgtatgtttgttggcttctataggtttgggcaccagcacatcaaaggaagctaaggaatattttgcagatatgaaacgacatcgtattcagttcaaatactctggccctgaagatgatgctgcgatcagcctggtgagtgagagtcgtattgtacatgtgcgttcttctttcagaggtcactctcagtgtgctcagttacagcagttaaactcctagaaaacagtgtgctcaatttcagtagttaagttcccatagaggagttctttgtgaaataaaatgtttctggtaagcatatcctagtgacagaactagatactttagaaaacaggacttgtgatgtttctctttagctagaaccagtaagtatcagtgatgtctttcccacctcctaatttgcaggcctttagtaaaaaacaagttgatgatcgaaaggaatggttaactaattttatggaagacagaagacagcggaagttacttggccttcctgaggtaagagttgtaaatatattccataaaatgtgcttttgggggggattttgtttttttgtttttttttccagactgggtttctctgtgtagctctgactgtcctggaactcactctgtagaccaggctggcctcgaactcagaaatctgcctgcctctgcctcctgagtgctgggatcaaaggtgtgctccaccacaccggcaaaatatgctatttaattgactttataattgatgttacaccaaataaaattactaaatagtattctcagtaaaaagtttgatgtaataactatagtatataacactagaccgatgagattatgaaggcattgagaaaaatattgtcatctttttttgtttttggcttttgggttgtttagttttgttttgttttccttcagacaggtttttttctgggtagccctgccctggctgcctggaattagcttagtagaccagactggctttgaactcacgcagatctgtctgcctctgcttcccagtattgggatcaaaggcaagactaccacctggcaatatatatatatagtcttaaagttaagtggcaagacatttctcacacgtttatgctgatgctgctataaacagttatcatgtggtcagttatctgcaagtatgtgccattgaatgtagtatgaagaatttatgtgacaagcagccaggacaggctgggctagagaataagtttaaaaaaacaaaaaacaacaccaggaaactttaaaaggctggagctacagctgagattgagtgcttgcctggtgtgggaaaccttgagtttaattttttttttttttttaatttttttggtttttcgacacagggtttctctgtatagccttgagaccaggctggcctcgaactcagaaatctgcctgcctctacctcccgagtgctgggattaaaggtgtgtacataccaccacacctggcgagtttaattctttttttagatttatttatttattatatgtaagtacactgtagctgtcctcagatactccagaagagggcatcagatttcgttacggatggttgtgtgccaccatgtggttgctgggatttgaacttgggaccttcgtaagagcagtcggcgctcttaaccactgagccatctcaccagcccgagtttaattcttaatactactcctcttcccagacaaaaaagtttaatgttttacacactgcaatgactgcagtgttaggcagcagcaacctcatatacctactgtttttaatttttgatcatttgtttatttctatctttgtttttctctgtttgttcctggctgttctaaaacttgctctgtagaccaggctggccttgaactcagaagagatctacctgtcttctgcctcccaagcactgggattaaaggggtatgccaccactttctggctcacctattgttttttgtttttaattatggaatataaactagtgcaataaagaatgtgttcaatgtaaataagcaaattacaaaaagacagaaggaagcatcaactcagatgcttctcagtttattcttgatggtttgagcattttgtggaggaattcacttatttctgtacagatggaatttaaaccaagttctaacaaatcctggcagcattttgaaaaggagttgtcaaaagaatactcaaacaacaaatgaaggaagaaatatgtggttataggggttctaatctctaatgaatgaaaaaaattatggacggctagctaaatgggcggatctagaggagacttcagacaacctactgcaattgtcccttctgcagaacactatggcaattaatggttttgtgccaactcaaggacagaagaaatgataattctggcaaatgatagttctgagtgtttttatttagtagtttattttccaccagatcctgtaatactgcctttgatcccttaggattatttgtatggacaaagcacttcgtacctgacctataatgacttcataaacaaggaactcatcctcttctccaactctgataatgaaaggtctatcccatccatggtagacggtacgtgccgatggtgtagtcttattttatcgtagaatggtaacttacgccaaaaattgataaattgaaaatgctaatgattgttctttcattttaaaggtttgaaaccaggtcagagaaaggttttgtttacttgtttcaaacggaatgacaagcgagaagtgaaggttgcccagttagctgggtcagtggcagaaatgtcctcttatcaccatggtgaggtaaacccacaatcgttaatcagaatgccttagagcagaaataattgaaagttattcttgaaacacatttggtacaagtgtaacctgctatatccatcgtagaaaacagcttggtaaaagtctttgaaaactaaaatatgattaccctttgaccaatagttctatttctaaaattagcatcctattaggatatttgtctgccaagttatgttcatagattttttttttaaagatttatttatttattacatgtaagtacactgtagctatcctcagacactccagaagagggagtcagatctcattacggatggttgtgagccaccatgtggttgctgggatttgaacttcggactttcggaagagcagtcgggtgctcttacccactgagccatctcaccagccccagatttttttttttaatacaagtacaagaagctgtcttcagacacaccagaagagggcattggaccccattaagatggttgtgagccaccatgtggttgctgggtcctgagacctttggaagagcagtcagtgctcctaacctctgagccatctctccagccccatgttcatagatttttagtaagatttagtattactatatgatgtaaaagtttagataccttgaagtcttatgtttgagaaccctttctgccatctatttatcttggaaagatcactaaacattaaaaccatacaaccttataagattgtgtaacttaactgaagtagtgaagacacacacagacatgcttgctttcatctttgggtcagagtaatcattgttcttttcctccacagatgtcactgatgatgaccattatcaatttggcgcagaattttgtgggtagcaataatttgaaccttttacagcccattggtcagtttggaaccaggctgcatggtggcaaggactcagctagtcctaggtacatctttacaatgctcaggtaagtttgcttttagtggcttgaaacaatatgaaatcaaaggataaaatgttcaatgttaagaatagtcagttttcactagagagatggatggctcagtggttaagagcactgactgctctctcagaggtcctgagttcaaccacatggttgttcacaaccatctataatgagatccgatgccctcttctgatgtgtctgaagatagtgtactcatatacataataaatttttttggtttttcgagacagggtttctctgtgtagccctggctgtcctcaaactcagaaatccgcttgcctctaaaaacaaaaaacaaaacccatgcactccttttagttttttaggctaaaaaacttcaaattaccccttactcttaacactttattcaaattattagctgtgatttctgcactggaaaaatagtaagcaccacctcactatcttcccagttagtatctcagcaagcagccatggctcaatgaggaaagtcattgccagcaagcaaggacttgcattttgagtcccaaaacccatataaaagctgggtgtggtactagcacatgtctgtaatcccggtgctctggtggcattatggaaggaggaggcaagagaatccctataagcttgagggggtggggtagggggatgacaagaacaaggtaacctggcatcacagtatcaaacgagaccctgtcttgaaaaagtgtaaaccaaggactgacatccagggctgtccttgcacctccacgtcctccacgtgtgtgtcgacatttacactccacacacagagatagaagtgagatgggaaggaaatcgtatgtcttccaggttaaactaactcctggccttaagtaatccatttgtaccaacttttcacaggcacacgccccatacttcatagttcgatactctgttgttttataagttcttaacccacgttagcatttttttttttttttttttttgtcgagacagggtttctctgtatagccctggctgtcctggaactcactttgtagaacaggctggccttgaactcaagagatccacctgcctctgcctcccgagtgctgggattaaaggtgtgcgccaccacacccagcccttgttttgattttttatttatttattataagtacactgtagttgtcttcagacgcgccagaaggtctcattatggatggtcgtgagccaccatgtggttgctgggatttgaactcaggaccttcagaaaagcagtcagtgctcttacccgctgagcaatctctccagccccttgatttggcttttttgaagcaatcttaatacatatccaagataagccttaaattcaaaatccttcttagactgcatcttcaggtcacaggattataaacatgtttctgcagcactcatttcttagcaccctaagtaatctcttgcttcattttcctttttagcactctgtctgccccaccaatcttgaacttgagaggattttgtttggtgttaaagcaagatctcactatgttccctgactggtctagaagtcagagagctgcctgtctttgtccaccaagtgcaggcttgtgccaccatgcccacctgtgtgtgaaaaatgacagggtcattttctaaatgatgttctttgctttctttagccctttggctcggttgttgtttcctccaaaagatgatcacacattacggtttctatatgatgacaaccaacgtgttgagcctgaatggtacattcctataatacccatggtgctgataaatggtgctgagggaattggtactgggtggtcctgcaaaatccccaactttgatgtgcgtgaagttgtgaataatatcagacggcttctggatggagaggagcccctacccatggtaagtgctctgggttggaactgtttctcatcaggcacggctgaggagattggacgctaagatagggtacaaggacgagatttgtttcagagtttagatttctttaacatttgagatgaaatatttataaaggtttttgttattaatttagctcccaagttataagaatttcaaaggtactattgaagaactggcttcaaatcagtatgtgattaatggagaagtagctattctggattctacaaccattgaaatctcagagcttcctatccgaacgtggactcaggtaagtaactattgacttcttagtttttcaagagaaaaatattgtttttgttattgactgtttaagagactccttgccaaaggattattgtgttttggtttttgttcttgttttttagacatataaagaacaggttctagaacccatgttgaatggaactgagaagacaccctctctaataacagactatagggaataccatacagataccactgtgaagtttgtcataaagatgactgaagaaaaactggcagaggcagagagagtcggcctacacaaagtcttcaaactccagagtagtctcacttgcaactctatggtatgcattactttgtaagagataatatttcaaaactgttattatcataatcctagcactcgggagacagagatgaggagatccttatgaattccaaggttattctgggctatgtagtcagaccctgtctcaaaaagaaaggctgcagagctgactcaacagttaagagcacgtatacttgtacatttggatctatgttcagttttcggcacccacatggcagttcacaactgtctcactcagttgagagtcaaggtgtcttcttctggcctccatgggctagtgctacgcgcacatgaggcacatatatacatgcaggcaaacatccagatacataaaataattttcaaatatcaattttaaagggtatatcaggcagcttttataagggttacccaattgactgatcatagcttaaatgttgcttttcttttccaggtgctttttgaccatgtaggttgcttaaagaaatatgacactgtgttggatattctaagagacttctttgagctcaggcttaaatattatggattaagaaaagaatggcttctaggaatgcttggtgcagaatcttctaaactgaataatcaagctcgctttatattagagaaaatagatggcaaaatagtcattggtatgtaaagatctactaaatacctaaatgcttgagatagcttttcctggattgtttattgttatttgaaaggttttattggtactgggctttaattacagggccttgtacttgctaagcatgtataatgcattagcttcattccccctagattgagcatctaaagaaattaacgcagctaatatttacacaggaagaaactagagaactaaaagactgtgcgggtctagggtttagctctcacggtggcagaatgcttccctgatatccacagatcctaggtctaacctattagccactgtatttcacagatgactttgtttcattcgacaagaagatgaatgatacggggcgggggggaggttttatttggctagcaggaattaggaaatatcaggatggcccagtcttcttacagagtaaatgtcaagggtctgaaagtgtaatccagggagttggagggatggctcttattgctcttctaaagagcccaagttcaattcccagcacctacatggtggttcgctatcattcgtaactccagtcccaggggatctgatgccctcttatggcctgcataggcaccagacacgcatgtgcccatatgtaaatgtgggcaaaacactcttactgggtggtgctgtcatgtgcctttagttccagaactcagaaggcaaaggcagagctctgaatttgaggccagcctagtcttgtgatcaagtatcataacagccagggctacacagagaaaccctgtcgcaaacaaagaaaataataataagagggtggcactccacaactatattgctagtgattttaactgtctttgaaagcatggttgtctgcaacagatactgaaagcgaagtactagagaaagggatcagacatgtcctgttcttctgtaattaagagagtgaagctgtgagcagcctgtcctagagcctagcccaacgtgctgctgaaatcaaagtcagaacacgggattgagtcccaggctcttcacaagtggagtctgtgtgtcattctgttttgagaattatgtagattacagcctagtctgtctcctggtaattccttcgtcctggcttacagaaatttgtctgatctgggcaggtataggcaaaacacagacagctgaatttcccttttgcagagaggagggctggggaggggaattgttggtttgtttttcatgacaggggtttctctgtgtagccctggctgtcctggcactcactctgtagaccaggctggcctcgaactcagaaatctacctgcccctgcagcctgaatgctgggattaaatgtgtgtgcggccaccacctggctcaaattttccagttttaatcttttgacttaatgtagaaataacttgtttttctaaatctttctcaaagcttatctctttctctctctatttttttaaatagaaaataaacctaaaaaagaattaattaaagttctgattcagagaggctacgactctgaccctgtgaaagcctggaaagaagctcagcagaaggtagggtccttagccacttgctaagctccgaggatgtccgtcctactcacttacctcttgctctggcactcatcaggcagcaccacacacagaatgaagatggaaaaaattagttagaaattaaaatttattttctaacatttctagaggtcacaagtagaaaatgaagggagctgcatgtttgtacttcatggtctgaatgtaattccccctttaggttccagatgaagaagaaaatgaagaaagtgacactgaaaccagcaccagtgactctgcagccgaggctgggccgaccttcaactaccttctcgacatgcccctgtggtatctgaccaaggagaagaaggatgagctgtgcaaacaaagaaacgagaaggtgagctccaggtgtggggaggtccacgtgggggctgtcctggtgggaaatttaactgggttctgcttgaaaacactccttgttcatatttgctaaccccattttttggtaatcttatgaaggaacaagagctcaacacattaaagcaaaagagtccatcagatctgtggaaggaagatctggctgtttttattgaagaactggaggtatgcattttgtaaagcctatattaatatttatagcctagcaacatgccctttcttattttacttataattatgtatgtgcgggcggagggagagtaagtgcaggtgcccacagaaaccaaagtcaccaatctcctggagctttagttgcagtcagttaggagtcaccagggtgggtgctaagaaccataactcatcctccgcaagagcagtaagggctcctaaccactgagccatccgtccagcacagcagcataccttcttatgaaaaagtacaggaagagaaagaatatatgacaaaatatgtaaaaataatgaaaaggctggctttggtagccacgtagacagtcagccctcagactaaggtagggacatcacaagtctgaggagcctaggctacccagtaagttcaaggccagactaaactatattagtaagaccatgtcaaaaaccaaggactaggagataatgtaattatagagcactaactaatagagcactttccatacaggtataaacctttgccctctatgcttagcacttcaaaaaataacatagtgtatggctgggtgaacataagagaaccctggctggggtagcacaacgcctttaatcccagcactcgggaggcagaggcaggtggatttctgagttcgaggccagcctggtctacaaagtgagttccaggacaaccagggctacacagagaaaccctgtctcgaaaaaaaaaccaaaaaagaaaaagaaaagggaaaaacaaaaaaacaaaagcagagaggacagtcagagtggtacagcctggtaacttgagttcaatcctcagaacccaggtaaggtggcaggagaaaggcgactcacaaagtgatcctctggtttctatatgcttgctgtgatgtgtacatgaccatgcacacacccatccagtaatgataatgtacttttaaagagagaaggaaaaaattgagttgttaaataatagtatgaagcaaatgatggcaagaaataaactaaaattaatatcgggaatacacacacacatttatatggtttaccttaaagcatggcttcctctttgtttcagaaagactgagtgagattagacgtaagcactccattcttctgtttctgccttttcttgcttttgttactgtgtgacccacttcagtgccagcagcctacagacggggccacgggtcgctctagcacagaacactatgcgatccccaggggaacgggcctgccgtaaatccaaacccatgcactgtttccgccttttcaaagtaagccctattggatctccactgaggctgaccaccaaattaccttacgttgtatacagttctcacgcttgcttaactgttgcttttcaggtgctgtgttttctccactgcacatttgctctcactcttccctttcataggttgtcgaggccaaggaaaagcaggatgaacaagtgggccttcctggaaaggcggggaaagcaaaggggaagaaagcacagatgtgtgctgacgtcttgccttctcctcggggcaaaagagtcatcccccaagtgactgtggagatgaaagctgaggcagagaagaaaattaggaagaaaattaaggtaatactttcaaaattgaacaaattaggaccagtcaaatggttcaggggtttgagtgaccagatttcagtccctggaaccacatggtggaagaaaagagctgacctcagaccataaattttttttttttatgtatatgagtgcactatagctgtcttcacacacaccagaagagggcatcaggtcattacagatggttgtgagccaccatgttgttgctgagaattatgaaacttgggagatctggaagagcagccaatgctcttaatctcaaagccatttctccagcctccataataccatttttttttgtttgtttgttttttatttttcaagacagggtttctctgtatggccctggctgtcctggaactagctctgtagagaccaggctggcctcaaactcagaaatctgcctgcctctgcctcccaaatgctgggattaaaggcgtgcaccaccacacccggcctcataattaccattttttaatggtgaaaattacatctaaatttctttttttttttttctttttttaaaagatttatttatttgtttgtttgtttatttatttaatgtgtgtacactgtagctgtcttcagacactccagaagagggcatcagatttttgttacagatggttgtgagccaccatgtggttgctgggatttgaactcaggacctttggaagagcagttggcgctcttaaccgctgagccatcttaccagccctacatctaaatttctaaccctattgtttttatgtctatggatatttgcctgcctcacattcagtgtacatagaatccaggtgaagatagtggatgccctggaactggagttacagacaatagtgaacctccatgtggttgctgggaactgaaccctggtgctccggaagagcagccggtgatcttaaccactgagccatctccagcccgacttcttttttcttttgttttgtttttgtttccagacagagtctcactatatagctctggctgtcctggagcttactatatagaccaggctagtcgtgaactctgtcctccagttgctgagattaaaggccggcttattttagattgcttaaccaaaacccaaagagaaatatattctttcacagtatatttgtgtctgtgtcaatctatatatgtgaatatttgacttttttattccaaatcacaggacaactgtgtggtttggtcttgctgagtgttatttcttccatgttgctgtcttctagagtgaaaacgttgagggtacccctgctgaggatggtgcggaaccaggaagcctccggcaacgaatagagaagaagcagaagaaagagccaggtactgcagtggtgggctaggtggtatcaactcatgtttgcattgttagtatagtctacatagatagtcagtgtttctctacagttgaactaagtattgtaaaggaaggtggctatgaattatatttggagcttgtgttgcccttgatgtttgatttattttagaagagactcataattatcaatttacttgaattccttagttgaaatctaaaatagctcccctcccctttccaggaagtcctgcttggttttccttggcttcaacagcctacagaagagagaggagtaaactgataactgtgacagctttatagttcccgagactgcctttacagtctgagcaaacatgggcaacagaaagagcccaggaggaactcctagtgacccagacctcagctcagacatgtgttctcagggaactgatgtttagacatttgtatcacattatttactggaaatacgtcatacacttgtggaatggaataaccaaaccatattattatgtagggcaggaactgcatcgcttcctactcgtgctgctgtgccttcagccccattacagtgtgtgaggaatgaggaggaaaccagaggatagcaggatagttagtttctgattgagtgctctgacttagcgtgtgcaggaccttgccataaagcctgacaacctgagtttgatttccccagcaccaccatatggcagagagagaaccaactcccttaagctgtcttctgacctccactcagtgtgtgtgtgcgcgcacacaagtgtaataatataaaacttttctgctgggcagtggtggcgcacacctttagtcccagtacttgggaggcagaggcaggcgaatttctgagttcaaggacagccagggctacacagaaaccctgtctcgaaaaaaccaaaaaaagaaaaaaacttttctaaagagtaaattcctatctcccttctaggtgcaaagaagcagactacattgccgtttaagcctgtcaaaaaagggaggaagaaaaacccctggtctgactctgagtcagacgtgagcagtaatgaaagtaacgttgatgtccctcctcgacaaaaagagcaaagaagtgctgcaggtaaggagaactacagaagcccgcgggtagcgggtagcgggctttaagatttgggtggccgagccgggcggtggtggtggtggcgcatgcctttaatcccagcactcgggaggcagaggcaggcggatttctgagttcaaggccagcctgttctacaaagtgagttccaggacagccagggctacacagagaaaccctgtctcggaaaaaaaaaaaaaaaagacttgggtggccattgggctgtggtggcgcatgcctttaatcccagcacttgggagtcaaatgcaggcaaatctcttttgagtttgaggccaacctggtctacagagtgcgatccaggacagccagagctacacagagaaaacctgtcttgaaataataaagaagaggaaaaaaaacggtagacgacatattcctaaaacataaagttaggggctgtagagattactcagtggttaacagcactggctgcgcttggcagtagtggtgtgttcctttaatcccgtcacttaagcactggttgatctccagagtaccttggttcctttcccagcacccacgtgacagctcactaccaactgtaacttccagtcttggggatctaattctctctctggcatccacatagtacgcagacatatatgcaggcaagacattcaaacacataaagtaacatgagtgctgtggtaattaatacacacgagtagcctatgcttaaggtttgtaccctctttgcttattcgtgtatgtattcaacagcaaaagccaaattcacagtggatttagactcggatgaagatttctcaggtttggatgagaaggatgaggatgaagatttcctcccattagatgctactccacctaaggccaaaatccccccaaagtaagtattttatctaatgataactatctggattgttattggtctatttattgatgattggtgttttacacatatggagttggttggagggatgtcttctcagtggttttgttttgttcttttagaaatactaaaaaagcactgaagacccagggaagctccatgtcgggtatgtacttaggtagagttagcaggcgcgtgggagacgctcagtcagtccagcccacagcacccgccgcagagacccatagactttagcgctcaggacttagaggcaggaggattgtgagttcaaagccaatctgtgcaagctctgtgccccagaaagtagaaaatttaaattcaattttattattattattatttaaaatagtctaagaaattgaaagtgggactacatatcaggaacagaccagcaaggggatgttttcaattgctatcatgactgaccattttcctttctgtttgaagtagttgatcttgaaagtgatgttaaggacagtgtgccagcttctccaggcgttcctgctgctgacttcccagcggaaactgaacagtcaaagccatccaaaaagaccgtgggagtgaagaagacagcaaccaaaagtaagcctggaaacgcctaggactgacttgcccaagtcaggctttgctttgctttttaaaagatttatgtatataagtacaatgtagctgtcttcagacccaccagaagagtgcatcagatcccattacagatggctgtgagacaccatnnnnnnnnnnnnnnnnnnnnnnnnnnnnnnnnnnnnnnnnnnnnnnnnnnnnnnnnnnnnnnnnnnnnnnnnnnnnnnnnnnnnnagataaaatttaaaaaaaaaatagtgggtgctggagagatgactccgtggttaaggacaccgcctgctcttccagaggacctgggttcaattcccagcacccacctggcagctcacaaccttctgtaattctagttccaagggatctgacatcctcatacagatatcatgtaggcaaaacaccagtgcactgaaataaatacaagtaaattatttttaaaaccaaaattcaaagtttcaaattagcacacgacctagagtctaaccactatctagctcatttctataagtaaggaaagaatttataagctgctgaaagtaatccatatatgataacttagaagtcaaggctggggatgtggctcggttgagggattcctggcctaaaatctatgaagacttcgaatcgctctccagcccagcataaaccaggcatagtggtgtagtggcatgtgactcacaatgagaaatctcaccagacggtgacgatgactgataaccatgctgacttacaggccagtcttcagtctccactgctggtaccaaaaagagagctgcgccaaagggaaccaaatcagattcagccttgagtgctcgtgtctcggaaaaacctgctcctgccaaagccaagaacagtcgcaaaaggaagccatcttcttctgatagctctgactctgattttgagagagcaatttctaaaggtgccacgagcaaggtatttatcactgtttgactcctctgctctggaatgttgaagcatccacttaggctgtgctcttagtttgcataattttaaggaagtaaatttaaacctgagttcatcattcctttgcaccatgtgtaaagtttgatctgtcagtctgtgcgactcttgctttggacctttttcttactacttagtagaagaaggtggggagaactctggaggtatagaactaccctagtgcattaacaatatgcaagttacttggctcttctctgtttagaaagcaaagggagaggaacaggacttccctgtggacttggaagacacgatagctcctcgagccaaatctgaccgggcgaggaagccaattaagtacctggaggagtccgatgacgatgacgacctcttctgaggcagaagagattgttttagggatggttttacggagccaggttagttttaaagttcttcctcctctgaatttgatttttttttttttttactaagactatccaagtgagtagagcccgtgtggccttcagctttgctctctgtaacatgctgtcgaggtgaccatctcatgggcaattgtcttctctgatttgtctgttttatgtgtgtttactttggtctctaaaatctgcctcaatttttttggatttcacagaattgtatgctcactttagcacaatagtatttatctatcatctattaaactacagtgaaaatgttttcaaaagcacttctgctgcctcctttcctcttcccacaaaataggaagtaacatggtccttgttttcagttttataggtagaattcggtcatatagaactggttagttctagtacagatacagtgctcaacctctgacgtgatgcattttgtttaagccatgagaagttgctcgtaccttttgaacatcggaggctggagaaagtcaccttgactgtgtctttatgactcagcacaagcagcaaggtgaggaaagttaggtcagttacgtagagtactgactctactcgggatgccttcccaacacgagatccctgggaggaggcaggactgctcacggttacatctccaggatcaacccaggaagtgggatccattgcagatctcccataattccaacttgtgactgccaagaccttctgtgctgttgtctcttatttaagtgctgttatcaatgtcttttgtaaatatttaatatgtctgtctgttccgctaattccaactattttgtactttaataaatcttctaaacaatgcaagccatccattcctcttattttaacccatctgacatcatctcctgtagtcaggacttgttatagccatggtctgtctgctaagacggtcagcctttggcagctgagggatccaaaagagaggcactgtgacctagatgggtccagtgttacttacaatctcacatatggctgctgaggtgtccatgtcctcggggaggtatcagattagggatgtagctccattggtggagagctttctgagcatgcctgaggcctgtggaactagtactataaaccgaccaggttagcctaaaactcagaggcccaccagcctttgggtcccaagtgttggaattaaagtcatgtgcaaggccaccttgggatacatgagactctttctcaaaaaacaaaaacaaaaaagcatgtatctttaaaaagatgtctacttccattttgatagcttagacaactacttgttggactcagtaaagttatattggagcagcctgcttgatccctctaaataaaatggtgaatccaattcctttcttaatattacacaaaattcagtccaaatacacagttttgttttttgtgctggggatcaagtctgggcctggtgtatagtctaggtagtgtaccaaagctaccacccacccaagactaaatagttaaatgtcaaagattagaaactgtttcaagcgggctgaggtggcttcctgggtaaagatggctgtcagcaaagcctgacccctgagttggatctccaggaccctcgtggtgaaagggcagagctgatgcccacgagctgtcctttggctatgacacaagctaatgtcctctttccctcccctccaacacacacataagtagataaataaattttttacttattgggggaagcgctgaggctatgctcagtggttaagaagcagcagattcaattccctgtacccacgtgaaggctcaccaccatctaactccagttccagggaatctgtcccctggcctcctcaggcaatgtacacatgggtcacagacttacattcagacaaaacacctacacataaaaaaatcttaaaaacagggctggcaggatgactcagcggttaagagcactagactcagaggttattggcactgactgctcttctgaaggtcctgagttcaaatcccagctaccacatggtggctcacaaccatccataatgagatatgactccctcttctggagtgtctgaagatatagctacagtgtacttacatataataaaaataataaatctttaaaaaaaaaaatctttgggccagagcgagtagaggtccttaaaaattcaattcccaacaaccacatgaaggctcacaaccatctgtacagctacagtgtactcacatacataaatctttttaaaaaatcttaaaaacagcacatgaatctatcagtaccacacagcactgctgtacctcttgacatgttagaccttgctgaatgcgagaagttagtaacttgaccattcttcctcatgttgctaacattcaaggacatttttaaaaagaaaagctacttgatagttatagacatttagactctaatttttagagaatttgttagcagttattgagagaagagactcaaagcctgtattaagggactgaggaaatgtctcagtgggcagagtgcatgctgagttaggattccagccctccctggggcctcagcactgtcgggagagagagacctggctatccaggggactcactggccagccagtctagctgccactggctccaggttagagagttactgcagtagagagtaaaagccaggccggagaatgataaaacgacccagcattgacttccggcctctccacaggtgtatgtacccatggaaacacagacacatagaacatacacatcaaaacaaaactagtgataatgagctgttcagacctacccagatctaaaccttctcacaattcattctggttaaacaagggctgggtgtggtggtgtgtggtcccagcactttttttttaaagatttatttatttatttatttattgccaggcatggtggcgcacgcctttgatcccagcactcgggaggcagaggcaggcggatttctgagttcaaggccagcctggtctacagagtgagttccaggacagccagagctatacagagaaaccctgtctcaaaaaagcaaacaacaacaacaaaaaaagatttatttattattataagtacactgtagctgtcttcagatgcaccagaaggggcatcagatctcatttcattacaggtggttgtgagccaccatgtggctgctgggatttgaacttagggccttctgaagagcagtcagtgctcttagcctctgagccatctcaccaactcccaatttttttttttaagattttttaaaatttcatttaatgtatatgagtatactgtagctgtacagatggttgtgagccactatgtggttgctgggatttgaactcatgacctctgaaagagcagtcagtgctcttaaccactgagccatttcaccagccccagcatctcaacagccccccagcacttcttaagaagtaccaagaggctgaatctagcctgtctcaaaagtaaacagataaacaacagagctagaggtggctcagcagttaagactttaagtctcgggggctggagagatggaggaaagaactgactccacagaaatgtcctccgacctccacgttcgccatggggcgtgtatccctaccccacaataatgatttgtaaaactaagcattagggagctggagcgctggcttagtggttgggagcacttgttgctcttgcaaaggaccaggattcaactcccagcacctacatggtggtttgaatctatctgtaactccagttcccagggatcttatactttctgtgacctcctccggggataagctctcatgggagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgtgtgtgtgtgtttatacatgtacatgcatgtgtttgtatatatagtcatacgtatatatgaagaaatgaacaagcacagtgataaatgcaaaacctttaaaataaaaatgttaaatagaatttaaagtgtccctaaattgcatatatcagtggtctctttttcaaaacagacaaaaatcaattctttttattattgctgagtatcattccactgcacgtgtttgtttatccattcacctgttgatgggtgtttggattgtttccaggttgggcctattatgagtaaagctgttatgaactgtatagaatgtatccatttcacactttttttttctttcaccatgggtggaatttgtgccactggggcctctgggtcccgtgtttaactttataaactgaagagctgtctttccaaacaccagtcttatttacactccctcttacatttttccttgaaaatgagatgtgtctctttggtgtaaaatgtcacagtcactcacctcaggtttccccaatatatcctcaaatcagaagacgtaccagaaaatgccattttagctggagaggaagcccagtctacaggtgaactttctttttttttttttttttggttattcgacacagggtttctctgtgtagccctggctgtcctggaactcactttgtagaccagactggcctcgaactcagaaatctgcttgcctctgcctcccgagtgctgggattaaaggcgtgcaccaccacgcccggcttacaagtgaacttcctaagacccatctcaagcttggccctttggatggagaaaccctgccgggaagatgtagatgtggctgtggtcctctggtgccttggtttcgggtggagctgatttcagccttgcccgaatcatcttcctcagcagatgctgcaaaagacctcagagtgttctcaggaccacaccaacgacaggatcttaagtcttgggtaatgacagctaggaccaggcagtgtgcagccatgcaactgcttgtatatacacacacagagatgcaggggcttgttgttgtttgttttgagacacagtcttgctctgtagttcaggatagccttgaacctacctcctattttaacatcgagagtataggacttagcaatttgtactaccacctgcagcctgaatcttttttttaaaaaagatttatttatttattatatgtaagcacactgtagctgtcttcagacactccagaagagggagtcagatctcgttacggatggttgtgagccaccatgtggttgctgggatttgaactcaggaccttcggaagagcagtcggggtgctcttacctgctgagccatctcaccagcccctgcagcctgtatcttaagttgacaaacaccagccattctgagctttggggagagtgactttgaaaaaaaaaaacttttttaaggattttcattactttttaagtttatgagtatttaacctgcatgtatgtaatgtacaccacatacgtacctggtgcctgaggaggacaaaaggtagccttggatccctggaactggggttatagatggttgtaagctggcgtgtgggtactggtaaccagccttgtcttctgtaagctcactgagctgtctctccagccccaaaagatgcttcctttgttttgttttattttgtttttcgagacagggtttctctgtgcagccctggctgtcctggaactcactctgtagaccaggctggcctcgaactcagagatccgcctgcctctgcctcccgagtgctgggattacaggcgtgcgccaccactgcctggccaaaagctgcttcttgaagagtcaagcacaggctgaatccgggttactggattagtgctccctcagtgtgcacaaggccctaaactcaacccctagtaacaacacacaggtacaatcagtgccacttggtcctgtaggaagacgactgtcatgagttcaaggccagtccaggcttacaagatgagctggacataatggcacacacctttaatcccagcacttgggaggcagacacaggaggagctctgctagtttgagcccagtctggtctacatggtgagttttagagacgatcaggactatgtaaagagagcttgtctcaaaaaaaccaaagaagataaaataataaaaatttaaacgataaagcctaggaagtgagattgttcagtctgatggcctgaccccaatgcctgggactcacatgctgcaaggagagaaataattcccaaaagttgtcctgtgacttccacatgcatgctgtggcctcccctgaccctaccacacacacacacacacacacacacacacacacacacacacagagagagagagagagagagagagagaggagcacgcatgcgtataaacacatacacgcacaaatctataaacatataaacaaaccttttgaagagggcctgtcagcaagatgtctcaggtgtgagagcacttgctacacaagccttctgaccacctgagcgtggaccctgaactctccggagacatcacgtggagcggggtttcggcaacgaccctatggtgtctactgcacgatggcgcagtcctgtgtccttctttgtgaggaagacactacccttttggttaattaagcccctggctggtattctggctactacagccaaacaaaataatgaagaattccagagccaaagcagatatccaagcagacggagatgagttctaactgtgagaactgcagcatacaagagtagagaagccaaggccttgccatcgtgaggtgtcccgggacatacagcagtgggaaaggttcaaaggctcagatgttagtggcttttaaataagtgtttgttacagttttcctcttaacccaactagctctcaaatgattaagactggattattatatttaacaagcttgaagggcacaacaactgagcagtggtattccactttaatcctctaaactaagaatctgtacctcccagccagaatcccagagatacctgctggctctctgggctccaagggttttctcaccgtgtctccgagactctctctctccttgtccagtccccacttctttctccatccctcctctcctggctgggagggaagttcagccctattggctgatcagctcttattgacaagtcagagaataaatgggaagcgaagcccacacagcattgaggcaggagacacttagaataagcattccaataccctgtctgcattgcaaccagacactgaggcagagacatcggcatttgaatataaagataatttttacagagtatgcacgtaacattgtgcctatactcaggagccgcgcaggtttgacgatggctacagaaggaccggaaatgctggaggactcccaccccttccccacccaagcccctgacccgactcgggagctggcccttctgcccaggcctgtacattttgcatggtactctcatactgaatgagacacttactggacagagtccaggagaacagggagaggagccggcaggggactgggacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttattagatatgaacacgtccacgccccctgtgtatgtccacctgtgactgatgcgggactatggctccacagccagactgaggtgtctgggacacagaagaaccctctcagcccagaacttcttccaagcagggccaagaagggccaatgccaccagctctgggtattgtcagcaacacctcccgggctgcccacggctatctaggactgggtcctagagattgtagagtctcctctggcatggggagctaggtgggggacagggcagagtgacagtggctctccatctgctgccccaccctagcatctctgtggcacgatcccactccctgcagagtcacactgggtggggtcgggtgggctcaggtggggtggggtctggtgggctttttcccagcctgacgaagcaggagcaatgggggctggggctgggaccattcctgggtagttaggaaagaagagatgtgaccctgagcctccatagctgaggacagggtgcagacggcagctcggccggaagtgagtggcaggggtcgcccggtgctccacctcacatcctgttttcagaatgtggggttccagcacgtgctattctcttggattttatccagggtagcgcccccacacccaggcctatttctaagggaccctgcaggaggatggaaacgttcaggggcacacccaagctggagttaaccaaaagtttttccaggctgggctagacccctgactgagccaatcagtagagaacacatttcccattagggacccactgttaacagacagaaacccatgcaggtctttgtactgactgggggagaaaatatcacggagtacgtgaggactaatgacctatcccttcataggagtacgcacagcccacctcagtgctgagaccctcagccccacgcaagaccccacccaggtatagagaggtggcagttttccctcgcaagctgtgagggagcatgcgctccagaaccattgaggccaagagtgagttcatggtccgcctttcactgactgcgcatgtgtgactctctaagcctcggtttccccggctgtaaggctgtaaatagtgccggggtagctgaagactgaatgagtgggtgactgaggtagacagaagggagaaaaacaccatcttaaatcgggagtccctcttcctggcccactcgggtccccgtggattgtctatcatggtcccgcatctccccgcacctagactggtagacaaagctccatattagaaaatccttggcagaagcttttctcactgctgttgaccttatgaggtgccacacacctcacggtaaacctagacattgctgagtaggaaagaccagagctttggcttaaccacggtagccagctatctccacatcttcctgatgccctcacggagtatttccaagcactgggtttggggtttctgtaacacagctgagacctggtcattaagatgggcgactatgacgggtgtggtgatgcatacttaatgtcctgcacttgggaggctgaggcaggaggatcatttacttcaagggcagcctggcctatacggtaaggtcctggccagcttgaactacacagcgagactctgtctcggaacaaagtaagaatcttagagtttagctggctcaggtgacagaccaagagatcttagcccaagtgacctacatggctcatccaaggtccaatagtggcagaaccaaaagccccccccccccaaagccatatttgttgtcccctaaaagccgaagttatctccctctggcccacaagacccttcaaaaatggggtcagttggttgtggtggacctagtcttcagtttgaggagtctgccaggagatagggttcccatgattgatctctctggctccctcaattaaaaaaaaaaatgtagctctagttagcctccgtccatcgccagatggagacatggctatgggatgggcatggggggtaagggatggaaagagaaggcaggaaggacccaacaaggggtgtggccctggatctatttccagggtggagccggaccacaggtcaccctgtccctttaagagaagggggagagctagcccctctcagccatacttgtcctatcatccatcccggccaaagccaaaaaggaaaatgaaagagggacccagagggacaggtcccagctgtctctcaaggtcctccgctcagctctaaggcccaggtcccggggtaagtggggttggggacatctagaggccactaagggtctacagggacgggacgtggtgtattctgtgtgtctggggaggcttacaagagatgcttgataattgctatcagagaggagtcgagggggctgtgcccggtctccttggctgaggttggtgaggaagggaagattgagggcgggcgagagatcctaagttggaaaaacaggcttctgtgtcagcttccaaccccaaaa

SEQ ID NO: 476 - DNA, 4108 bp, Mus musculus
  misc_feature (1)...(4108): n = A,T,C or G
caggtggtcgaaatggctatggagctaaactgtgtaacatattcagcaccaaatttactgtggaaacagccagtagagagtacaagaaaatgttcaaacagacgtggatggataacatggggagagctggtgacatggaactcaagccctttagtggagaagattatacatgtatcaccttccagcctgacttatctaagtttaaaatgcaaagcctggacaaagatattgttgcactgatggtcagaagagcatatgatatcgctggctccactaaagatgtcaaagtctttcttaatggaaatagtctgccagtgaaaggattccgcagttacgtggatttgtatttgaaggataaggtagatgaaactgggaattcactgaaggtgatacatgaacaggtcaatccccggtgggaagtgtgcttaacaatgagcgagagaggcttccagcagattagcttcgtcaacagcattgcgacttctaaggnnnnnnnnnnnnnnnnnnnnggcggggttgcagtgaaggctcatcaggtgaaaaatcacatgtggatttttgtaaatgccttaattgaaaacccaacctttgactctcaaacaaaagaaaacatgactttacaagccaagagctttggatcaacatgtcaattaagtgaaaagttcatcaaagctgcaattggttgtggtattgtggaaagcatactaaactgggtgaagttcaaggctcaaatccaactgaacaagaagtgttcagctgtaaaacataccaaaatcaagggaatccccaaacttgatgatgccaacgatgcagggagccgaaactctactgaatgcacacttatcctgactgagggagactcagcaaaaactctagccgtttcaggccttggagtggttggaagagacaaatatggggtgttccctcttagaggaaagatactcaatgtgcgagaagcctctcataaacagatcatggaaaatgctgaaattaacaatatcatcaagattgtgggtctccagtacaaggaaaaactatgaagaatgaaggattcattgaaaactcttcgttatgggaagatcatgattatgacaggatcaggaccaagatggttcccacatcaaaggcttgctgatcaattttatccatcacaattggccatctcttctgcgacatcgttttctagaagaatttatcactcccattgtaaaggtgtccaaaaataagcaagaaatagcattctatagtcttcccgagtttgaagaatggaaaagttcgactccgaatcataaaaagtggaaagtcaaatactacaaaggtttgggcaccagcacatcaaaggaagctaaggaatattttgcagatatgaaacgacatcgtattcagttcaaatactctggccctgaagatgatgctgcgatcagcctggcctttagtaaaaaacaagttgatgatcgaaaggaatggttaactaattttatggaagacagaagacagcggaagttacttggccttcctgaggattatttgtatggacaaagcacttcgtacctgacctataatgacttcataaacaaggaactcatcctcttctccaactctgataatgaaaggtctatcccatccatggtagacggtttgaaaccaggtcagagaaaggttttgtttacttgtttcaaacggaatgacaagcgagaagtgaaggttgcccagttagctgggtcagtggcagaaatgtcctcttatcaccatggtgagatgtcactgatgatgaccattatcaatttggcgcagaattttgtgggtagcaataatttgaaccttttacagcccattggtcagtttggaaccaggctgcatggtggcaaggactcagctagtcctaggtacatctttacaatgctcagccctttggctcggttgttgtttcctccaaaagatgatcacacattacggtttctatatgatgacaaccaacgtgttgagcctgaatggtacattcctataatacccatggtgctgataaatggtgctgagggaattggtactgggtggtcctgcaaaatccccaactttgatgtgcgtgaagttgtgaataatatcagacggcttctggatggagaggagcccctacccatgctcccaagttataagaatttcaaaggtactattgaagaactggcttcaaatcagtatgtgattaatggagaagtagctattctggattctacaaccattgaaatctcagagcttcctatccgaacgtggactcagacatataaagaacaggttctagaacccatgttgaatggaactgagaagacaccctctctaataacagactatagggaataccatacagataccactgtgaagtttgtcataaagatgactgaagaaaaactggcagaggcagagagagtcggcctacacaaagtcttcaaactccagagtagtctcacttgcaactctatggtgctttttgaccatgtaggttgcttaaagaaatatgacactgtgttggatattctaagagacttctttgagctcaggcttaaatattatggattaagaaaagaatggcttctaggaatgcttggtgcagaatcttctaaactgaataatcaagctcgctttatattagagaaaatagatggcaaaatagtcattgaaaataaacctaaaaaagaattaattaaagttctgattcagagaggctacgactctgaccctgtgaaagcctggaaagaagctcagcagaaggttccagatgaagaagaaaatgaagaaagtgacactgaaaccagcaccagtgactctgcagccgaggctgggccgaccttcaactaccttctcgacatgcccctgtggtatctgaccaaggagaagaaggatgagctgtgcaaacaaagaaacgagaaggaacaagagctcaacacattaaagcaaaagagtccatcagatctgtggaaggaagatctggctgtttttattgaagaactggaggttgtcgaggccaaggaaaagcaggatgaacaagtgggccttcctggaaaggcggggaaagcaaaggggaagaaagcacagatgtgtgctgacgtcttgccttctcctcggggcaaaagagtcatcccccaagtgactgtggagatgaaagctgaggcagagaagaaaattaggaagaaaattaagagtgaaaacgttgagggtacccctgctgaggatggtgcggaaccaggaagcctccggcaacgaatagagaagaagcagaagaaagagccaggtgcaaagaagcagactacattgccgtttaagcctgtcaaaaaagggaggaagaaaaacccctggtctgactctgagtcagacgtgagcagtaatgaaagtaacgttgatgtccctcctcgacaaaaagagcaaagaagtgctgcagcaaaagccaaattcacagtggatttagactcggatgaagatttctcaggtttggatgagaaggatgaggatgaagatttcctcccattagatgctactccacctaaggccaaaatccccccaaaaaatactaaaaaagcactgaagacccagggaagctccatgtcggtagttgatcttgaaagtgatgttaaggacagtgtgccagcttctccaggcgttcctgctgctgacttcccagcggaaactgaacagtcaaagccatccaaaaagaccgtgggagtgaagaagacagcaaccaaaagccagtcttcagtctccactgctggtaccaaaaagagagctgcgccaaagggaaccaaatcagattcagccttgagtgctcgtgtctcggaaaaacctgctcctgccaaagccaagaacagtcgcaaaaggaagccatcttcttctgatagctctgactctgattttgagagagcaatttctaaaggtgccacgagcaagaaagcaaagggagaggaacaggacttccctgtggacttggaagacacgatagctcctcgagccaaatctgaccgggcgaggaagccaattaagtacctggaggagtccgatgacgatgacgacctcttctgaggcagaagagattgttttagggatggttttacggagccaggtt

SEQ ID NO: 477 - protein, 990 aa, Mus musculus
QDQDQDGSHIKGLLINFIHHNWPSLLRHRFLEEFITPIVKVSKNKQEIAFYSLPEFEEWKSSTPNHKKWKVKYYKGLGTSTSKEAKEYFADMKRHRIQFKYSGPEDDAAISLAFSKKQVDDRKEWLTNFMEDRRQRKLLGLPEDYLYGQSTSYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSPLARLLFPPKDDHTLRFLYDDNQRVEPEWYIPIIPMVLINGAEGIGTGWSCKIPNFDVREVVNNIRRLLDGEEPLPMLPSYKNFKGTIEELASNQYVINGEVAILDSTTIEISELPIRTWTQTYKEQVLEPMLNGTEKTPSLITDYREYHTDTTVKFVIKMTEEKLAEAERVGLHKVFKLQSSLTCNSMVLFDHVGCLKKYDTVLDILRDFFELRLKYYGLRKEWLLGMLGAESSKLNNQARFILEKIDGKIVIENKPKKELIKVLIQRGYDSDPVKAWKEAQQKVPDEEENEESDTETSTSDSAAEAGPTFNYLLDMPLWYLTKEKKDELCKQRNEKEQELNTLKQKSPSDLWKEDLAVFIEELEVVEAKEKQDEQVGLPGKAGKAKGKKAQMCADVLPSPRGKRVIPQVTVEMKAEAEKKIRKKIKSENVEGTPAEDGAEPGSLRQRIEKKQKKEPGAKKQTTLPFKPVKKGRKKNPWSDSESDVSSNESNVDVPPRQKEQRSAAAKAKFTVDLDSDEDFSGLDEKDEDEDFLPLDATPPKAKIPPKNTKKALKTQGSSMSVVDLESDVKDSVPASPGVPAADFPAETEQSKPSKKTVGVKKTATKSQSSVSTAGTKKRAAPKGTKSDSALSARVSEKPAPAKAKNSRKRKPSSSDSSDSDFERAISKGATSKKAKGEEQDFPVDLEDTIAPRAKSDRARKPIKYLEESDDDDDLF

SEQ ID NO: 478 - DNA, 41624 bp, Homo sapiens
  misc_feature (1)...(41624): n = A,T,C or G
acagttctaaagactgggaagtccaagatcaaggggcctgcatctggtgagggccttcatgctgtgtcatcccatggcagaaggcaaaaggacaagagagcaagagatcaaacttgcagcctcagcctcaagtccttttataattgtcattaatccattcatgagcacggagttcatgacctacaaacctcccgttaggccccaccttccaacactgttgtgttggggattaactttccacacatgctttttgagggacacattcaaaccgtagcactgggtctttgagtccaaggtagagatgttcctgcatagccccagtgtccccaaggacagcccagctgatgccagcaatgagtactgtaccttccactgaatccaaagaggatgcagcaaactgctggtacagtcatccctggcttccataggggcataagcagaggcttgtgtggacatttcccttcacttaggggtttgacagcccagccacctggccagagagctggctttcctgcacaaggggtctggtagctgggtgtgctgcctccaggtggacaatgatagtgctaataataccattcacagaaggcctccagtgggtgggcattgtactaggtgagggtaccaaagaaataagtaaatccctgactttagaagagcttgtggtttgaagtgggagacctgtgggtaaacacacagtgctgtgtaatagagagaaatgcacaggaagccaagaaaacaaagacaaaccaaggctggttagagcaagcttcaaaggaaggtgatattgagctgggtgtgttgggtgacagaatcccagcttactctgcaggctgaggcaggaggatccttgagcccaggagtttgaggtgatcttgagcaacataagaagaccccatctcataaataagtaaataaatatttttttttaaaggaagtgacattggatctgtgtcttgaaagatcagtagaaattcacaatcttggggacactgcctaactcttgcaagcctgagttgccttagtttaaaggattgttgtaaagattagggagaaagttatgtgcagtgcttataattggcattcaacaaactataatcagcaaaactattgttggaaatagagtgtgtatcagtcaggattcccatcttcctgctcctgtagcttctctcatgatcaggaaggaagacagaaaaccacataagcagcacttaactccaggcctttgggaaacaccattattttcttcaatcctaaacagaaggatctaactttctattttcttcaggtgaataatttgctcctagcaccactccaccctttccaacctgcctagtgtctcagatcgtcagtgaaggggaccctgtagacataaactggccctgattgccttggagatagcagcagggggggacaactgccggataacgtcggagggaagacgctccagagacgtacttttttattcctcttccgaggtagaggattccaatgcagaagttcctcggtgatgaccttccatgttccacagtgaccaaataaaacatactgagggcgatcattcaagtagcctgaggactatcaagatactcagtccagttctgcctccctttcctggtgtgaaaagctgagagaacagagaggcccagccctggcctctgctgtcagatgggagggctactttaccacttccattctgtgggctgcagaggaaggatgtagggagctggagagtttaggggtgaggaagcagcaaggggctcattatgtttgcccaggtcttgctgatcaagtctccagcaggcataaaactaaggccaagctccagttccagcagctgccatcggcaggcactggtgccagagaggggcaattggggatgtcttagggagctggcagagccccagccataccactaggccacgagatgggggaagggatgtcacataaagagtgaaaaggatccgtggccctcctctgcctccccatacaccagggttcagccccgatgggcttgagctcctctgcagccctggttgggctctgtgggggggaaaggaagacaaagctgcaggcataccctgatttaaaccaactcaataaatgaaaagtcatatttggaattacagtgtcagaacttgaaaagcccttaacagtaatttacccattaattttaaaaatctaagcagtggagccctgtgtttaatgaagttttacacagaacctaaaatatgaaaagatgaaagtgggactgttctggattggttaactgggcctcacctcctccaagtgctttcactatcacctctctcttttttttttttttttttttttttttttgagacggagtctcactctgtcacccaggctggagtgcaatggcgcgatctcggctcactgcaaactccgcctcccgggtttgcaccattctcctgcctcagcctcccgcatagctgggactacaggtgctcaccaccatgcccggcaaatttttttttttttttttttttgtatttttagtagagacagggtttcactgtgttagccaggatggtctccatctcctgacctggtgatctgcccgcctcggcctcccaaagtgctgggattacaggcgtgagccaccatgcccggcctcactatcacctctctgagactgtgaagaaggcattttgcaacccaatcctctagctggggtacctcaacttcagtttacaggtggggaaactgaaaactagagagagaaggggatttacccaagctcgtgcaactagggacagcagagctggtctgggacttctcaccacagcacagtgtcccttactttggtccaaagatttaacttttctgcagagttcttagcactgagttcccaagtctactgataatctatctttatctataaaaattacattcttacacaaacgtgtatagacaggtatgcctgccttcaatgaggtgggggaaggtgacaggggtgagaagggtgaccttacttttaaattttcaaataggaggaaaaatacaaaaagcaactcttggctgggtgcagtggctcacgcctgtaatcccaacaccttgggaggctgaactgggaggaccacttgagcccaggagttggagaccagcctgggaaacatagcaagacctcgtctctaaaaaaaacattttttttaatcagccaggcttgctggcacaggcctgtagtcccagctacttgggaggctgagacaggagaatcgcttgagcccaggagtttgaggctgcaatgagtcatgatggtgccactacactccagcctgggcaacagagctgaaactgtgtctcaaaaagaaagaagaaaggaagtcttcctttccctccacctccttacaattccttccagatattctcaatccatatatatatacatatatatatactcaatccatatatatacacatatatgtgtatacacatatatgtatatataatatatacacatatgggtatacacatatatgtatgtataatatatataattttatttactcaaatggaattatgctctagacagtatttgcctcactttttaaaaaacttaacagtatatcttagagatacctccatatcagtacacttagaccaatgtccatctctttaatagctgcatatcatttcattccattagcttgctgccagttattttctattaaaaacaatattgcaataaataggccgggtgcagtggctcacacctgtaatcccagcactttgagaggccgaggcgggtggatcacttgaggtcaggagttcgagacaagcctggccaacatggtgaaacctcatctcttctaaaaatacaaaaattagctgggcgtggtgtcatgtgcctgtagtcccagctactcaggaagctgagccaggaaaaatcacttgaacccaggaggcggaggttgcagtgagccgagattgcaccactgcactccagcctgggcgacacagcaagaatccgtctcaaaaaaaaagaaaaagaaaaagaaaagaaaaagaaaaccaccaacattgcaataatcctatacatatgtacatacatctttgcacaattccacaactgaattgaattgattgaattcagtattcctagaatttaaactgctgagttacaaggtgtgtacattttaaaatttttgatggatagggaacttctgtgcagacttagggattactcaactctggtcctgaactgctcccctctgtaacctcccttgctctcctcccaactttgtccacatttctttgacaggggccacctagaggctaggctgtatgggacattttgggttttcttggcctcctccaaccagaggctggtatccctggtaaaaaaataaacaaataaaaataaataaataaataaactgaccaggctcgccagttgtcaacctcaaggtaaacagagcttcttggcccagccctaaccacctgagtactctggcgctggctcagcctcatccaggaattcccagtgggctccagcctagccagctccaaaccccaaatccagagccacactttcagtccagcctccttctgctgggaaagcctgcaaaagagaagaaatgctgctctttctaggggaccttccagatccatgaaggggacactatgcctccaggaccttccctccccttgccaaagagcagaaagaacggaagcacacaacccaggagaaaacaaccaaagaatacttataaaaggaacttatctgcatatgcaaatatacctcaaaagacttgaggaggttcaatgaaaaagactgtcagagaaggctccctgggtaggagaattttgagctggttttggagaaggaattggtgggactagcagggaaggaagatcctggaaaggagcagaggtagtcattgttaacatgtcttgagcacttattacttgccagacaatgcactaagaatttggtgtaagaattttgcagagtggggcagggtgggtggataatgaggatagctcaccctatgaagagcaggaggaggtactcccattatccccattttagattgttaaaaattataggccgggcgccgtggctcacgcctataatcccagcactttgggaggccgaggcgggtggatcacgaggtcaggggttcgagaatagcctgaccaacatggtgaaaccccatctctactaaaaatacaaaaattagctgggcgtggtggtggacacctgtaatcccagctactcagcaggctgaggcaggagaattgcttgaacctgggaggtggaggttgcagtgagccaagatcacaccactgcactccagcctgggcgaaagagcgagactccgtctcaaaaaaaaaaaaaaaaaaattatgggaggttggctgggagcgggggctcactcctgtaatctcagtgctttgggaggccaaggcaggcagatcacttgaggtcaggagttcaagaccagcctggccaacatggcgaaacccgcctctacaaaaattagctgggtgtggtggtgcacgccagtaatctcagctgctgcagaggctgaagcaggagaattgcttgagctcgggagaccgaggttgcagtgagccgagatcgcacccctgcactccagcctgggcaatagagtgagactccgtctaaaaaaaaaaattatggaggccattgttttcaactgagctcctacactaggccccaaaagactagaccaaaccaagatggagtaattcgtgctaaatgccatgtaatccaactgaaactttaaagaagcagatagattccaaaacagaccactttttcctgaaaacaggagagtccaatctacctaagtcagtttaataaggaagtcccctctgctttaactccacaaaaaagtaacctgaagtacctgatgttaaccaatcaggttttttcctattgctgtttcctggttcccaccttacaaaacccaccattctgctattgcccagtggaagctttcattctattttgtagaatgggggctgccccaattcatgaatcacaaataaaagtcaatttgatctacaactgaacttgtaagggagactgagtgacttgcccaaagtcatatacccagcaaataccctagtcagggatctgccttaagtactcaaccacatattcaagtacaggttgggggagggagggggtaatgtccaggtagctactttgggcccctgcagagtgggggcagggtgggtggataatgaggatggtatctttcccctccccccaccacagccccctggaactacccccaaccccttcttgcctcccaggactggcaggcacctgcagttccctcttttttttttttttttttttttttttttgagacggagtctcgctctgtcgcccaggccggactgcggactgcagtggcgcaatctcggctcactgcaagctctgcttcccgggttcacgccattctcctgcctcagcctcccgagtagctgggactacaggcgcctgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgtgcccggccctgcagttccctctttgtgtgcaatgccttccaggcccacccatcccagacccccaccactattctttcttcaatagtccccacaagtcctgcaggaccccctgcaataggctctgggaagagggagggactggcagagaaatagcttgtacccagaagagaaggggggtgggccagagcaagaccaccttgtgctacagagctggaaaaggattgtccccgacacttgcatatctcattttgccctctgtgtctttgataaaggataatggcatggggaaaccaagagacccaggaagaattctaacttaggtgtgtgtggccccaaagtccttttgtgttttttgttgttgttgttgtttgtttttttgagacggggtcttgctctgtcgcccaggctggagtgcaatggcacgatctcggctcactgcaacctccgcctcctggattcaagctattctcccacctcagcctcccgagcagctgggattacaggcacccgccatcaggcatggctaatttttttttttgtatttttgtagagatggggtttcaccaagttgtccaggctggtctcaaacccctgaactcaggtgatccacccacctcagcctcccaaagtgctgggattacaggcgtgagccaccacacccggtccccaaagtccttttgactccacagtacttcttctgggtttttggaacaaagacacacaggatccagctaaactgcaggacagatttaaagctgggcccctaaaaaatagggctggagctgcttgttaaattcctgttgcctcattgcccagtgggtcactgcaggctgggatgagctacagggtagaggccgggagctgcagaaactgagctgccatccttggggaagcatgcccaccatccccactaccttggaggtagtgcgttctaggaggtagaagccagcatggctggtttctgtcagggccctcgggtgtcctgcagagagtggcatgcaggccctggatcccagggcctggtcagtcttctggctgagcagaggctactggccaagcttccctaccactgctctgagcccctggtggtcctgtgctctctaacacatgtggtgagcagagcagagctgggaacacgcagagactgctggaggccagggagccaaaggtcaagagagcagaacaatgccgaagcaccatgcctatggtttccgagtgcccctagcccatgggcaacttccatccttggcttcctgccacatcatacggctccccattggccctcccttgacacactgtggttatgtaacaatggttgacctctggtttcttttagaagaagaaaaaaaaaattacatccacaattgtcacaccagcctaaggaaaattcctgctacctaatactgtcagcccactgtttaccttacacttctctcatgtaaccctcacactactctgagatcatagttaattattctttttaggagaggaaacggaagcaccgagaggcttcctccatcgaaatgacacgaatggcaaattgctgagttgggactgaaacccaggtagaggaaggaagcaatgaatggaaagaggtggctcagctggaattagtaggcactcaaattgtgcagtttttttttttctggcttcttgtaagggtaataactttgtttaatccactcaaacatttatatgtaagagtaattttaaaacttcagtcttcgccgggcacagtgactcacacctgtaatcccagcactttgagaggctgaggcgggcagatcacttgaggtcagaagtttgaaaccaacctggtcaacatggcaaaaccctgtctctactaaaaaaatacaaaaattagccaggcgtggtggcaggcgcctgtaattctagctacacgggaggctgaggcaggagaatcgcttgaacccgcgaggtgaaggttgcagtgagcctagatcgcgccattgcactccagcctgggcgacagagtgagattccatctcaaaaaaaaaaaaagcaacaaaaaaacaagcaaacaaaaaagcttcagtcttggcatttccttgtcaaattggaacagctgttctggactgcagggttcacggaggtgagcaaaactagccagtcggagggtatctggccagctggctgcggaaaaggtttcagccccggacggctgagcccaccctcagctcaagaggctaccaccacaagttatccctttcgatttaccagttgcagtccagcgctgctctactggggacctgaatgctgccctccattttgcaaagcctttctacatccttccactatatggaacccccaaaccacaactgtggcacttttattttaattatttttattatttatttatttatgtatttatctcttgaggtggcctcgctctgtcactcaggctggagtgcagtggagcaatcacggttcaaggcgcctcgatctccgatccccggggctcaagcgatcctccctcctcagcctccggagctggagttacaggtgtgcgatgcctcgcctggctattttttttcctttttgggtagagacggggtctcgctatgttgcccaggctggtctccaactcctaggctccagcgatcctcccgcctcggcctcccaatgtgctgcgaatacagactccagccaccgcacacagcctacttttatttctttgaaaaatgaattcgagggtaaagggggcggggttgaggcagatgccagaatctgttcgcttcaaccaagcagccaggctgcctgtccagaaagccggcactcagtttcctcaggaaaacgaagctaaggctcccattcccctcgctaacaacgtcagaacagaggacagtttttagatttcagggatcttaaatagattggcagttcctggagaataaacatcctttgcttttctcctgcacacttttgcctcaggccaccccttcccgcttccaaagcccatctcttccaagctttccgcacgagaaaacaagtgagcccttctcattggccagattccctgtcaatctctccgctatgacgccgagtggtgccttttgaagcctctctagtcccgcctccctaacctgattggtttattcaaacaaaccccggccaactcagccgttcataggtggatataaaaggcaagctacgattggttcttctggacggagacggtgagagcgagtcagggattggctggtctgcttcgggcgggctaaaggaaggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcaggtacggctcgcgggggggactggcggtggagcctccgcgcggcccgggcatctctctggccgcccgtgacgggtgaagctctggggctgcggtcaggccggcgaccggcttgggagcccatattctccattcccggttccggggtgatcgtggagaggcggaagccccttctggtgctagtagtgaagtatgacccggcttccagggtgtcgtgcgttgttgccctgtttctaggggcaggagtccgttggtcccgtagtggatccatgttacagcggcccgggtgcgacgttattgagtcgcgcgtacagatgctttcccctcctgcccgctgcttgaaaacggtcttgaatgtccccgatcttggaaagggcagagcctagcacagtgtttctctggagcagctggccagcttacaaaagcgcccccttcctgagttcacaacgctcaggtggccaagggattgaacggatagccgcccaaactgctgctgccgaactagaattatttacggtgtcgtgtgctcgggacaccgtaaataatttataataataggcactcggtaaataatgtatgcaggaactgaaagaagtgggtgtattttattgatgacatctaccatgttgctcaagaaaagaggtttccagacagacccacttggtgagataatatgtgtctgtttaacctgacacctggggacctggccgcagcgaatttaaattgtcctatttgtacaaaactggcaactccaccactgcctactaacagattgcaatgcatgttgacatctcactatggtaggcattttgttcctagtttagggtaaacttatgattaaaaattcccttctttctctctttttttttaattgctagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccaggtaaaatcaagctcatcaaaggcagttaacctagtagttgaaatggatactcttctttctgtacctttcatgtactgagtgtgacctttctgtatctctcatgtactgagtgtcactggaactggcctaaatatggtaatacttaatatgaacactttatggtaatcatgataacagaacaatgaatatagaataaaaataacagtatttctttgccttatttctagcaaatgtgggtttacgatgaagatgttggcattaactatagggaagtcacttttgttcctggtttgtacaaaatctttgatgagattctaggtgagtaaatcctttaatataaagatctggtcaaatctttcataagaagtatcattccaaataaaaatttaaaaaagataaaagtaaaaacaaaaagtatcatttctaccaaacctgctgtagccagggctcctgtcatttcaatcagttgataaaggtgagctggtttcctggagcccaggaggttgagcttctcgtagaaacagtactatggacaaaaattgctaaattaacaccttgttaatgccactcctgtgctgtttgggaacttttttttctatatcttacttagagttacagaatgttttttaaaacactaatttcttacaaatgtatattttattttctttcagttaatgctgcggacaacaaacaaagggacccaaaaatgtcttgtattagagtcacaattgatccgtacgtcttttgcttagtttttgttatgtagctcgttgctattgttagctgcatgtattttgattactggtgaagttggcttttcctaaacagaagttgagaaaagtacacaaaagcagaatgctaaaatgaaaaacctatggatacccaccacctagatccaacagttgccaacgtttttccatattttctccatcttttttttaattagttaatttttttagaggaaggggtcttgctattttgcctgggctggtcttagaactcctggcctgaagcaatcctccagtgttggcattatgggtgtgtgccatggcacgcggcctatttgctctggatcatttcaaaataaattacaggacttatgacacctaatccctaaatatttgagcaagcaccttcagtaattgctttaagtattctggcatctggagttttaactttttctcatgatgctattcaaacagtaaaccagtaggtggtggtagagaataatttgatctgacatttctgcttataaatgcggggtgtcccttagtgggtgatcagggtgcttatttcacttttttgttagtctgattgattatgacaaagtatacctggattttcctaaggactcaatatcatagtctttaaaaaatgttgagctagggccaggcacggtggctcatgcctgtgatcccagcactttgggaggccgatgcgggcggatcacaaggtcaggagatcaagaccatcctggctaacacggtgaaaccctgtctccactaaaaatacaaaaaattagccgggtgtagtggtgggcgcctgtagtcccagctactcgagaggctgaggcaggagaatggcatgaacccgggaggtggagcttgcagtgagccgagattgcaccactgcactccagcctgggtgacacagcaagactctgtctcaaaaaaaaaaaaaaagttgagctaattttaattagttttttttatagataataagtactatgtagaacaagaaccataatgtatatcgagttattaactaaaatatagtaccatccaagaattaacttaaaataactgaaataagttttcagcattttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacacctggctaattttgtattttttttagtagagatggggtttctgcatgttggtcaggctggtctcgaactcctgacctcaaagtgatctgcctgcctttagccctcccaaagtgctgggattgctgggattacaggcgtgagccactgcgcccagcctgtttttatgtactttgttgagtgggaacgagatgtatagatgatcctcttgaaaggggtataataggcatgatgactcactcctgtaatcccagcactttgggaggccaaggtgggaggatcagttgagcccaggagtagtttgagaccagcctgggccatatagtgagaccctcatctctacaaaaaatttaaaaattagccaggtgtggtgatggacacctgtagtcccagctattcaggaggctgaagtgggaggattgcttgagcccaggaggtcaagactgcagtaagctgtgatcctgccattacactgcagcctgggtgacagagcgagatgctgtctcaaaaaaggagtgggagtggtgtataataatgtttccagattgtccttttctttccattgggcataaatcatttccctctgtttatcctaacattttaaaattttgtattttttcaacattatcagtgtctattcaggtgttggaaaaggtttttttttcctcttgactcctatttcaggaatgtcaggaactaagcatggtgggaaatgttcctgctgaatttcagaaggtatatatgaaaagtgccaaaaaaattgagggctgggtatggtggctcacatctataaccccaacactttgagcagttctcctgcttcagcctcccaagtagctggaatcacaggcatgcgctaccatgcctggctaattttttttatttttagtagagacggtttcaacatgttggccagaactcctggcctcaagtgatctgccctcctcagcctcccaaagtgctgggattacaggcacaggccaccgcgcccagcctgaatatacatattttagaaataatagtatttaaatatttttaaatgttaagcattcgtttaatgtgttgtaaaatacaattttcaatctttttttcttagggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtagagtattgaggggaaataacatatttgttgctaaaaatatatatatttaaatgactgtctgtggcatgagggttaaagatatggaaataaatctctataattgaatagctctgccagtgattaagaaataaagctgtcaatgagatagtaacaataaaatagtgtttcatatttatttgcccaggtggtcgaaatggctatggagccaaattgtgtaacatattcagtaccaaatttactgtggaaacagccagtagagaatacaagaaaatgttcaaacaggcaagtaaataagtgtcttgtaccttaatgataaatggtagtagtatagccatttataatggcattaatgattggtttaatttaacataatttataagctattgaagtatggaaaattataagcatatatattaggttattaggactcataaatttatgttatttacttccagtttgtgagatgacttgaatttttcatgtttcctattctttacttccatagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtgagtattttcctggatgttaaggataataagggattttgtaatcattgtcaagtgcaaaattgaattttttcccctcccatatgtttttgtttgtttgtttgtttgtttgtttgagacagagtctcacactgttgcccgggctggagtgcagtggcacgatctcggctcaccgcaacctccacctcccaggttcacgcaattctcctgcctcagcctcccaagtagctgggattacaggtgcctgccaccacacctggctaattttttgtatttttagtagagacaggtttcactatgttggccaggctggtctcgaacaccagacctcatgatccacccgtcttggcctcccaaagtgctgggattacaggcatgagccactgcacctggcccaaccatatgtattttcttaccacttctcacatatgttcttgaaaagagaatggtatgccacattttttaatcagctcattttaaacttaccgaaggaatttctttctcaaagaaacacctaaaataaatatttcatgtcctttttttattttcctttttctttcttttcttgataacctcgctgtgtcacccaggctggagtacagtgatgcaatcacggctcactacagcctggacctcccaggctcaagcgatcatcccacctcagcttctggagtagctggaaatgcaggcagcaccaccatgcccagctaatttttttttttctttttaatagaggtggggatctcactatgttgcccaggctggtcttgaactcctgggctcaagtgatccacccacctcggcctgtgtcctttaatgaccattcccttatgcctatcagtgaacatcattgcattggttttggaaagtcctcatagtctatcattgaacctattttttaataactttcttaatactgttacctttaattcctgtacaggtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaaggtaattttattcttaaattattaatcatgatttatctttacatatatgtgttcttattgtttttaatatataaagtggacttgaatattgggctagcttagtataaaggaggttaaattagtttttaatgtttgattattataattttgaggatactgagttttacagtttggtatttttccttattagggtggcagacatgttgattatgtagctgatcagattgtgactaaacttgttgatgttgtgaagaagaagaacaagggtggtgttgcagtaaaagcacatcaggtatgtgcttttggcagttttctttttctaaagtcaaggaagaagagaaaggctataaataaagcatgagtacatttttagtggcttaatatcaacttctattgcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgtgagtacttagaggaaaataaaaatagaaacacctgactttattttccattgcacttcttagctctgcagaaacaatgattcttctcatagtgagcttctccaagtcttcccaatctgaaaaggaagtaaaaaagggctttactttaactgatttaccaaagacttaatgaccgtctatatttcagtatttcccaattacattttaccattaagcttagatcacttttgaattaatctagctgtttaacaaacaccctcacttaaatgcctaagacttgctttcagtcaacacatccaaaattgaatttgttacctccatactcactgatttgcccatacaagcagccccccactctccaacaaaaaaacaacttcctatcttagtaaaaagccccaaccaacctctaggttgtataaacaagaaagctgggagccttcctttatttcccctcctctctaatccggtcaataagaatcatctcttggatgctgcagtagcttctcaccattatctcttttttggtttactacaataggttcttaaccttcatactggttaagtcctttccttggaatgcttttgagtgacttttgtgttaaaacacccatttttatcttcactctcatttgaaatctttcaatgacttccactcagggaaagtccaaattccataatttggccaacaagaaagatctgctgtaatctaattacacctacttctccaactcatctcagtgccagtttttcgtatattgtcctgttgcttttaaattactgaaaagcacagtgctcttcccctcctcagagtttattcacatgctaatccctctgcatgaaatacatccttttcacctggctactttaggtcttgtcctttcctcaggaaagcctttactttctacccttccccccacctaagttggttccaatataatattgaacataccttattagcaaactttttgcttatccataacacttataacactgtaacttattttatttctgtctttttttttaggcagagtctcgctctgtcgcccaggctggaatgcagtggcacgatctcggctcactgcaacctccgcctcctaggtttcagtgattctcttgcctcagcctcccgagtagctgagattacaggcatgcatcaccatgcctggctaatttttttgttgttgtattttcagtagagacagggtttcaccatgttggtcaggctggtctcaaactcctgacctcaaatgatccacccatctcggccttccaaagtgttgggattacagccatgagccactgtgcccagtcttttttttttttttttttgagacagagtcttgctgtgttgcccaggctacagtgcagtgacgtaatcctggctcattgcaatctctgcctcccaggttcaagcgattctccttgcctcctgagtagctgggattctccagcctcctgagtagcggggattacagacatgcaccatcacatccagctaatttttgtatttttaatagagatggggttttaccatgttggccaggctggtcttgaactcctggcctcacttgatccaccatcctcggcctcctaaagtgctgtgattacaggcgtaagccactgcacccagctatgtctgtcttctatgttgtgtcttaaacttgatgaggacaagtgtctcaatttgttttatttgtgtctaattttatttatttatttttaatttttttttttggagacagcttctcactgtttcccaggctggagtgccgtggcttgatctcagttcactgcaacccgcgcctcccaggttaaagcaattctcctgcctcagcctcccaagcagctaggattacagccatctcaccaccaccatgcctggctacccttttttttttttttttttttttttttgagacggagtttcacttttgtcacccaggctggagtgcaatggtgcgatcttggctcgctgcaacctctacctcctgggttcaagcgattctcctgcctcagcctcccgagtagctggaattacaggtgcccaccaccacgccagctaatttttgtatttttagtagagccggggtttcgccatgttggccaggccggtctcaaactcctgacctcaggtgttctgcccaccttggcctcctaaagtgctgggattataggcgtgagccaccgtgcctggtctaatttgttttaaccactatatctccaacaagtagctcagtgctagcacaatataattatatagtaaatatttattgaacgaatgaaccaaaaggagcagctccctcagtggtgataacctgacatgggaagatgtgccaccctctatccagaaattattgttctacatctttttaatttttgaatcatttttatttgtattaaggctcatttgtattctagatttctgatagatcccttcttccctaatatgatccctaatatgaatcttctcgttttcaggccattggctgtggtattgtagaaagcatactaaactgggtgaagtttaaggcccaagtccagttaaacaagaagtgttcagctgtaaaacataatagaatcaagggaattcccaaactcgatgatgccaatgatgcaggtatatatttaataatgtttccaaacttttaagtcttatagttgttattttattcattaatggcataccacggatatttatttttcccttgacagaataactatattcaacagaataacttgttaaaaatcggcccgtttcctattatggaagatttaggtcatttccatgttataaataatattgaggtgattattttggagtataaaacaagaatgtttatattatgatctattacctaacaaataattttgctcattatatagtaaattgtgttttatcacaaggctataaacagcatgttcaagttagtatatttgaggttgaactaaatgtgctaatattaatatgtatatttttattttagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcaggtagaatataagacgatcttcagaatctaaatctaatttataatacaagactttatgcttatatttaattccctcattaggcattttaaaatatattttagacaatttgtgcttattttgagaaattaggtacattgtagcctattttaacagacctttctgatgtagtaaattataagctaatagctcaaaatactggagctcaagaaaatccaagcaacatatactgttaaatttctttgttcttttcaaatttataaacgatgctttttttggtatatgtccatttcagatcatggaaaatgctgagattaacaatatcatcaagattgtgggtcttcagtacaagaaaaactatgaagatgaagattcattgaagacgcttcgttatgggaagataatgattatgacagatcaggtcagatttgttattaaatttttagattgttcaactaaattaagcatgtcttaatttaatttcattgttttttgccatgaaaataaattacttaaataggagctttattcatcatctctaatcaacatctaatcagatatgcttatatcatatgtatgttgcaaatacaggttaagtgagtctggatttgaacagaccttttttgattcccatagaaaatttgacaaattgccagtaggtcagtcataatatttttttatttctaaacaattctttgtttgtttgagatggagtttcgcccttgtcgcccaggctggagtgcaatggtgcaatcttggctcactgcaacctccgcctcatgggttcaagcgattctcctgcctcagcctcccgagtagctgggattgcaggcggatgccaccacacccaactaatttttgtatttttagtggagacagggtttcaccatgttggccaggctggtctcgaacgcctgacctcaggcgatccgcctgcctcggcctcccaaagttctgggattacagatgttagctaccacgcccagcctaacagttcttttgaactttggctttcaaatctttctaggaccaagatggttcccacatcaaaggcttgctgattaattttatccatcacaactggccctctcttctgcgacatcgttttctggaggaatttatcactcccattgtaaaggtacgctaatttctaagtaccatcatggatattttaagaccctactcctcaaacctggatatacatataagccccgtcacatgtagtggtatacaggggaccccacagtgtacaaagccacagtcattgttttttatcacaggtatctaaaaacaagcaagaaatggcattttacagccttcctgaatttgaagagtggaagagttctactccaaatcataaaaaatggaaagtcaaatattacaaaggtttgtaatgaaacccatatagaacttctcattttattatacaccctgtacaagactatatgaaggaacttggtatttttggttttataggtttgggcaccagcacatcaaaggaagctaaagaatactttgcagatatgaaaagacatcgtatccagttcaaatattctggtcctgaagatgatgctgctatcagcctggtaggtttgagttgtattttatatacattctaattttagaaatcactactttagccagttgaaacatttacatttttgtataagactccgtatcaaaaaaaaaagaatgttttatagaatagaatgtttccagtaagcatatcccagagaaggaatcagatattttagaaaattttgatttttggctgggcttggtggctcatgcctataattctaggactttgggaggccaaggcaggtggatcacctgagatcaagagttggagaccaacctgtccaacatggtgaaaccccctctctactaaaaatacgaaaattggccgagcgtagtggctcacgcctgtaatcccagcactttgggaggcagaggcgagcagatcacaaggtcaggagatcaagaccatcctggctaacaaggtgaaaccccatctctgctaaaaatacaaaaaattagccggccgtggtggcacgcagctatagtcccagctacttgggaagctgaggcaggagaatcgcttgaacccgagaggcagaggttgcagtgagccgagatcaggccactgctctccagcctgggcaacagagtgagactccatctcaaaaaaaaaggaaaaaggccaggcgtggtggctcacgcctgtaatgccagtactttggaaggctaagtcgggcagatcacaacgtcatgagatggagaccatcctggctaacacggtgaaaccccgtctctactaaaaataaaaaaaaataaaaaataaaaaattagccgggcttggtgacacgcgcctgtaatcccagctactccggaggctgaggcaggagaatggcgtgaacccaggaggcggagcttgcagtgagctgagatggtgccactgcactccagcctgggcgacagagcgagactctgtctcaaaaaaaaaaaaaaaacaaaaaaggtcgggcgcagtggctcacaccagtaatcatagcactttgggaggccgaggcgggtggatcacctgagctcgggagttcaagaccagcctgaccaacatggtgaaaccccatctctactaaaaatacaaaatattagctgggtgtggtggcacgtgcctgtaatcccagctacacgggaggctgaggcaggagaatcacttgaacttgggaagtggaggttgtgggagccgaaatcgtgccatcacattccacaagagtgaaactccatttcaaaaaaaaaaaaatacaaaaattagctgggcgtggtggcgggcgcctttaatcccaggggctcgggaggctgaggcaggagaatcgcttgaacctaggacgcagaggttgcagtgagccaagatgacaccattgcactccaggctgggcaagagaacagtaactcccgtctcaaaaaaaaaaaaaaaggaaaacagtatttttgtttttctgttgttcgttctttgtagaaggatattttggaacctattagcctattagtaccagtgacatcttttcatcctttaatttataggcctttagcaaaaaacagatagatgatcgaaaggaatggttaactaatttcatggaggatagaagacaacgaaagttacttgggcttcctgaggtaaaagttttaaatatatgccacaaaatggattgttagactgaccttttggtattgatactatagcaaattaaacttactgaatagttattttagtaaaaaatttgatatgatagagttgtgcagcagttaaatttgctttatctttaaaacatataaaatatttctgtattattcaatattttttaaagacttaagaattacagaaataattcttagttctgaaaggtttctgtttgatttttgtgttgagcattgtttagaccggtagactcatgtaatactatttggtccttcaggattacttgtatggacaaactaccacatatctgacatataatgacttcatcaacaaggaacttatcttgttctcaaattctgataacgagagatctatcccttctatggtggatggtgagttccaatttgttagtctgttttcattgtaagatggaaatcaaattccaaaattggttaaattgaggatacttacgtttgctcttatttcattttaaaggtttgaaaccaggtcagagaaaggttttgtttacttgcttcaaacggaatgacaagcgagaagtaaaggttgcccaattagctggatcagtggctgaaatgtcttcttatcatcatggtgaggtaaacacacaatccatgtttccagaaagcattatatcagaaatccctgcagagtcattctcaaaacagatttggtgaaagtataagctcatatattcatagtaaagaacaagttggtaaaacctgtgaaagaataaaactgcttgccctttgatttctgaaagtaatattcctgcagggatattcataagtctgcaaaggtctacattaaaaaatgcttagtatgtttattataactttgtgatgtcaaaatttagacctccactgatttgaaaattgttataataaattgtgacacatgtatgcatggaatcagtgctgtaacttcagtaaaactgtgtgcactgacactgaggaatatccagggtctattctcaggtgaggaaaaaaagagacagaacaataactaaaaatgtctacaaggatatgttccaaattgttcactttagttacccctgagaactggaaagggcaactttcactttttatatgtgtctgaattgtttgactttacaccaatgttttgtgattactttttgcattaattatgtaaaacagttttaaagaactagattgcctacaggtttctagaattttaaatataatggttgtcttgttgctttcaatcaaaatatagtagggatacaataaattttcacccaacgaacatttgttgaatgcctaccatgtaccaggtatacaaaaataaataaaaatatgttccttatccccaagatataataacaatttagccagagggccaatacacacacagctatagaataaagtgatacatgctagaatagaaatgaacacagcattgtaacacaaaggaggaaatatttcattttgctgaggataaggagaagaactatgccttcaaagttgagtgggatttaatagaaattgttggacggcagccctaaacttggagccagaagttgtaggttcaagtactatttctgccatctattaatctgaggaaagtcactaaacaactagacctcacaaaatgttacaggattatagtgaggttaagtcataatgtatttgtattagtaaaagcctcagcttaatgaatctttttttccccacagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcaggtaggtatgctttcactttctagtgacttgccatttccagttttgaaacaatgtgagatttagttcaccaaaaatacaaaaactcagttaatcagaagatactggcatctagtggcagaggccaggggtgaggcttatacaggaaagcccccccataacaattatccagtgcaacatgtcaattatgctaaggttgagaaatcctgatgtagagcttgggactgagtaaaggagactttgattcttcctaaatatcacaattgaaattttactcctttacaagcctatggaaagtatattatgaatggtcaattttcagctgtcatcccagtcaccctttcagtggcattcaaacagttactaattgctccatccttcttgaaactctttatttggcctctatgactgtagactcttctggttctcttctaccttattagctttctctgctgggtccttctcaccttcccaacctctaaatactggcccattccagggctccttcatcagatctctttccaatgcctacactcaattcccaaatgatctcccattcatccgttctatacctttaaatctccagtcttggtctctcccctgaactcccaacttttatgtctgactgccctcttaacatttcccacttggatatctagttaagtatctcaaacataagtctaaaaccaaatccttagttttcctgtctcagtaaatggaatgccatgccatccttctaattgctcaggctaaaaaccttgtcacccttgactcctttgcttgatacttaacatccagttcctcagccaatcctataggatctgcattggaaaaatactaagccacccccatctcatctaaactattgtaacatatcatcttttcttaaagcagccaattattttttaaaaaataagtcactctgattcagaaccttcaactgctcagagtaaaatctaaagacctattttagctaaccagacattatgtgatccgtgtccccaccttccatgtcttttgattccttctcataccatctcctctccagccacactgtccttggcctatactcaaatataccgagcacatttcctcttcagggccttttacttactggttcctttgcctgcaacactctttctctagatatccacatggttcagtccctcagtttgttttttgttgtttttttttcttttgagatggagttttgctctttttgcccaggctggagtgcagtggcgcattttcggctcattgcaacctctgcctcctgggttcaagtgattctcctgcctcagcctcccgtgttgctgggattacaggtacacgccaccatgctcagctaattttatatttttagtagagatgaggtttcaccatgttggccaggttggtcttgaactcctgacctcaggtgatctgcctccctcagcctcccaaagtgctgggattacaggcgcgagttactgcacctggcgccctcagtgtcttttctctgctcaaatgttttcctatcagaaacggcttaactttccttagcacctcttcagtcactttcccactttttcttctcttgtttatcccaccacctaacaaaatatgtgttaattgcaaacttctactggactgtgagctccttgaggattgagactttatgtccatgtgcgtgacacatagcaagtgctcaataaatattgttaaatgtatattagtcagcaagtaaaaccaagataattttcatgtataatacatgtcctttccataaaagttaagtgtgaaattcagtatttttgtaaaataacattctttgtttcttttctttagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatggtaagtattctgtgtgtgttaagagccttaacttttccttgggtttcagttgaatagattgtatgattaaagatgatgcaaacataaaatttaatttcatactttagatttattgttaaacgctgttgtgatttccgtctagtatcacatttagaaaacatactgtttttttaaatgccaatttagcttccaagttacaagaacttcaagggtactattgaagaactggctccaaatcaatatgtgattagtggtgaagtagctattcttaattctacaaccattgaaatctcagagcttcccgtcagaacatggacccaggtaaataattgtggatttcttttttaggtttgtgatcaaaagaaataccttttgtactattgctgttgactattcagaagcctatattttagaaacttcaggattatttctttctttagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtatgtatttgttttgtgagatgtacacgtttcaatttatattaaagattaatatcaattttaaaagtatatcttagtctacctttataaagtttagccaatttgtctattcttggctctaatcttgttttcctttttcaggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattggtatgttttgggaataataactgcttactaaaactctagttacgccaaactttctttaaacatttttggtgagagtaatggtggagaaagaggcaaaatccatttaattcacctggtcacttatacacgcatttctttaaaatatctgattaggtatttatagtttgaaagagatgatgtttccttgactgagcatcttgagaaatcaagatttagttgacaattagacatgaggagaatagagagctagaagaccttgcataaactgattgaccaagagaatagatacactaatcatgtctacaggaacagaaaataaaagagacagagaagagataataaatctgatggtaaaaaaaaaaaaaggcaggaagattacgaatggcttctactctctgggtgtggtggcgcatgcctgtaatctcagcacttgagctggggaggtcaaggctgcagtgagcctaggtagtgccactgcactccagcctggacacaagagtgagagagaccctgtctccaaaaaaaaatgatttgatcatagcctcatatatgatttgactgcccccttgtggtaatttacatttgtcaatggtttagggagacttgcctgtataccgggatatacaaatttatgcaagcacgaagacagtttaatttccagttttaaacttttgacttgtgtaaaaccttatccccttcctaaaatattactcaaaatcattatctctgtttacttttttaaaaatagaaaataagcctaagaaagaattaattaaagttctgattcagaggggatatgattcggatcctgtgaaggcctggaaagaagcccagcaaaaggtaatcttgggtggcacttttctatattgttaaagactatgtattgtacaatgtttatgtttcacattttctaataaagctagattttaattaatcctttaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagtgagttgatagtaggatggtacatgctgcttagttttgttctattctaatggtaaaagtaaaattgtgtgttgcatgaaaatgctgcttgtatacatatattaactcaattttgtaattatcttatgaaggaacaagagctggacacattaaaaagaaagagtccatcagatttgtggaaagaagacttggctacatttattgaagaattggaggtatgtagtttataatgcccatgttagaatttttattaatgaaataatatattccagcagtatacctttgtcaagatagttcacaattggcaataaaaagaaaataagaggcataaggataaattccaaatagcgtataaaagaacagattattggccaggtgcagtggctcacgctggtaatcccagcattttggaaggctgagttgggtggatcacttgaggtcaggggttcaagaccagcctggccaacatggtaaaaccccatttctactaaaaacacaaaaattagccaggcatgatggtgcataccagttactcaggaggctgaggcaggagaattgcttgaaccgagaggcagaggttgcagtgaaccgagatcacaccactgcactccagcctaggcaacacagcaagactccgtctcaaaaaaaaaaaaaaaaaaaaagggacagattattaaatactacttagaatacaaggccgggtgcggtggctcacacctacaatcccagcactttgggaggccgaagcaggcagatcacctgaggttgggagttcgagaccagcctgaccaacatggagaaaccctgtctctactaaaattgcaaaattagccaggcgtagtggcacatgcctgtaatcccagctacttgggaggctgaggcaggagaatcacttgaactcgggaggcagatgttgctgtgagctaagatcacaccattgcactccagcctgggcaacaagagtggaactccgtctcaaaaaaaaaaaaaaaaatactatttagaatacagtaaatgataccaggagactgcccagacattcagacatttctggacaaaaaaagaaaagagcaggagttgatttttgataaagggaagaacatattaggactgagaagataaaaagagcctaaatgtggaagaagaccaccaacccagtcccccaagtcaacttaaaaggacaaagccacagggcatggtggctcatgcctgtaatcccagcactctgggaggctgaggtgggcagatcacttgaggtcaggagttcgagaccagcctggacaacatggtgaaaccctgtctctactaaaaatacaaaaattagttgggtgtggtggcatccgcctgtaatcccagctactcaggaggttgaggcaagaaaattgcttgaacccagaaggcagaagttgcagtgagccgagattgcgccactgtactccagcctgggtgacagagcaagactccatctaaaaaaaaaaaaaaaaaaggagaaagcagggctatccagatggtttcagaaggttatttgttacttaaatcttcctaataacatttgtttctcaacattattttaacataagaaaaaaggccagcactgtggctcacacctgtaatcccaatgtgctttgggaggctgaggcaggaggatcacttgagattaggagttcaaaaccagcttgggtaacgtagcaagacctcatctctacaaaatgttttttttaaatagccaggcatggtggtgtgggcctatagtctcagctactccggaggccaaggtgggaggatcacttgagaccaggagttcaaggctgcagtgaactatgatcatgtaccattgtactcagcctgcgtgtctcttaaaaaaaaaaaaacaaaaaaaaaaccaccaaaagctttatttcttaaatttaacatgcaaatttgtattactgcacttcagtatagatgcctagctcattgtaatcagttggttggataagtgtgcatcacttcctttcatattttgtatgtgagtttacaaatatatatgtatatacatgttttatttttagtttctcccttgttttcctcaaaaaggttaagtggtagaatcaggaataaaacccagtccttctgtctccacaccttccttttcaaggtgtgttttaattacatcttcactattgttgatagtatactaggttatggagcaatttatcactagtttttaagatgtaacaaaatgaaatcagtttaactgttgggtgtttagatattgtaatgtttttgttaacatttaaacttgctttcttatatcccttctgtaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaaggtaatactcttgtggtggctcacacctataatcccagcactttgggggccaaggtgggtggatcacttgaggtcagtggttcaagaccagcctcccaacatggttgaaaccctgtctctactaaaaattaaaaaaattaggcgggcatggtggcaggcgcctgtaatcccagctatcgggagactgaggcagaagaatcgcttgaacccgggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggtgacagagcaagactccaactcaaaaataaaaataaagtatgccattcagtggttttagtatagacaaacagttttaatacaatttattgccccccaagaaaactgaactcattaacaatcatttgccatttgccaccaactcctctccactgggtgaccactaaaaaatctaggggcatttcctataaattaaatcatataatatgtggtcttttggagctgacttctttacttaacacattttcaagggtaacccatgtggcagcccatatattagtacttcattcttttttttttttttttttgaggcagagtttcgctctgtcgcccaggctggcatgcagtatgcagtagtagtgagatctcggctcactgcaacctccgcctgctaggttcaggcaattctcctgcctcagcctcccgaggagctgggattacaggcacgcaccaccatgcccaaataatttttgtatttttagtagaaacagggtttcaccatgttggccaggatggtctcaaactcctgacctcaagcgatctgcccacctcggcctcccattttgctaagcccgtgaaggtaaacctctgtgttttcttctaagcattttatagttttagctcttacatttaggtctgtgatccactttgaattagtttttgtatatggtgtaaggaaggtgtccaacctgattctttgcaggtagatatccaattatttcagtatcatatgttaaaaagacttctttctacaatgtttgtcttcacccttgtcaaaaatcaattgactataaatgttaaggtttatgtatggagtctcaattctgttccactgattgagctatatatgtccttgagtatctactttttttgagacagggtttcactcttgcccaggctggtcttgaaatcctggctcaagcaatccttctatctcagcctcccaagtagctgggactataggcactcgccaccatgactagctaatttctaaaagttttttgtattttgtagagacagtccttttttctttttttttctttttttgagacaagatttcactctgtctcccaggctggagtacagtggcatgatcacagcccactgcagcctcgacctcccaggctcaaacaatcctcctgcctctgcctccgcctccctagtggctggaaccacaggcgcactccaccatgcccattaatttctgtattttttgtagagatggggttttgccatgttgaccaggctggtctttagctcctgagctcaagcgatccgcctacctcaccctcccaaagtgctgagattacaggtgtgagccaccgcacccagccaagacagggtcttatatcttaccccagctgatctcaaacccctgggctcaagtaatcctcccgccccagcctccctaagtgctgggattacaggcatgagccactgtgcccggccacatttatttatgagattaagtgaccaagctatatgcaccacaaaaacagagaccatatctgtctcttttcacgattgtattctcagaactatcacaggagttaataaatttgaaggatggatggatgatagatggagaaaagtgggtctaatatataaaggtgattaatttctatctcccctctaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaagtaaggaaaactaaagaacattatagataaactgtaagagtggaatggccaatatacttcagggtactttgccccagaaattactgtgtcttaatagagcagtaaattatgttaaagctttgaaacactgaagcatctttcaggagatttaaaaactaaaatattcatgaaatgttatgtcaacctatgaattgtttctcctactaccctctttgatttttttgtatatggtttttttactagcaaaaacaaaattcacaatggatttggattcagatgaagatttctcagattttgatgaaaaaactgatgatgaagattttgtcccatcagatgctagtccacctaagaccaaaacttccccaaagcaagtatcttatctaatatgggttttgtcatgattgtttctaatatattgttttttgcttgacacatttagaattggttgtcaggatttttttttttaattctagacttagtaacaaagaactgaaaccacagaaaagtgtcgtgtcaggtatgtatttaagtaaaagtagtgagacatctgccttactgggacactcagatccaactgggttctaatcctggctacattatccaagtacttcctttggaaataaatttgagttcttattaacattatgttgatactgttcactgggtttagtttcacatgtaaataggtactgcattcagtatactaaaagtaatcatagtgcttgccaggtactttgctaggtgctagagatacaaaaaataaaaactgttcttgctgataaaaaattcagaaattagaacaaagttttaagagtatgttttaaatattccagaaaagtcacatatttggtgtttaaataggaattcataccagggacaaagcagaaaatggattttcatgtgttgcttaaatgtactattttcctttccatttgaaataatagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtaagcctaaatctttgagatgggttaatgttgcaattacctaactggtttccacgtgtctatttcaatttttttattgccaaaacttactattgatattacagattaaatgttttccaattggaagcaatttcttttcgatctttataatcaaaattagtagtcaaggctgttccaaaacagtaagttatctctattgattgttcagttacagatcaaactccttgttctactcttttccctccttctcactactgcacttgactagtcaaaaaacaaaacaaaagccaggcagagtggctcatgcctgtaatcccagcactttgggaggctaaaacaagaggattgcttgaggccaggagttcaaggctgcagtgagctatatgatcaagccactgcactccagcctgagtgagagagcaagaccctgtctccaaaaataaggtagtccaaatgtttaaaatcagtgagtttctctcagtaccaggcttcatctagttcatttctgtgacaaggataggatttataagcaattgcaatgtttaacgtaaaacgtattcttgaaattgaattaagtttaaggctgggtgcagtggctcatgcctgtaatcccagcactttgggaggccaaggtgggtggatcacctgaggtcaggagttcgagactagcctggccaacatagtgaaccctcatctctactaaaaacacaaaattagccaggtgtggtggcacatgcctgtagtcagctactcgggaggctgaaacaggagaatcacttgaacccaggaggcagaggctacagtgagccgagatcgtgccactgcactccagcctgggcgagatagagcaagatgctgtctcaaaaaaaaaaaaaaaaaaatagaatgtttaagaatactttgattctctgttttcacctctcttagattgtcttttcctatgttaaatatacagtcatcacattgctgaagaaagttcgcaatgagaacaattcatctaagagtggctgtgactaggtcaggcgcggttgctcatgcctgtaatcccagcactttgggaggccgaggcgagtggatcacctgaggtcaggagtttgagaccagcttgaccaacatggtggaatcccatctctactaaaaatacaaaaaattagccgggtgtggtggcacacgcctgtaatcccagctactcaggaggctgaggcaggagaatcgcttgaacccaggaggcagaggttgcagtgagccgagataacaccactgcactccagcctggacgatagagtgagaccccatctcaaaaaaagagcagctgtgacaaatgcctgtattgaattgcaggtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaaggtgagtgttgatcctagtcagtccttttgctgtagatgttctgaaacacgtaactaagccattgctcttaaaaatttggcatatctttaagaaaattaactctcatattctgttagcttttactgtacatatttagttttaacaaagttaaatatgccacttatttgggcaatggaagagttggccttagatctgcttcttattacttggtagaaaatagaaaactccttgaatatagtgtcttgatacatttttttacattacaattatgttgtcagatttacaatgtgcaagttacctgggcttttctcttttagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccgaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaaatgttctaaacattgcaacccatagaatgcctcttttaaaacacacactacacccttttccttattctaaaatatagtcttcacttccctttcagaagcattccaatcatattgtgacagaccttacagcctctggctaaggtgataagtccaagagataggcattaagacctaattaaggccaaagactctttattgagattttatacatgaggactaagttcttcatctccaccacacttgatcagtaaatatgcatgtatcttttttttttaatgataccttcctttaacaactattttgataacctagtcaactacttgatggtatcagtaagatatattgaggcaactggctaatccatttagaaaaaaaatcagataaatctctttcacaccttacaccaaaattaagttcaaatagatgaaatatttaaatgtcaaaaactatttaaaaagtaactataaaaaaagtaatcttgagttacagagggataaactgaacaaaacccaaaagtagtgttgacaaagatatggaggaattagccctttcaaagaaatctgggccaggcatggtggctcacacctgtaatcccagcagtttgggaggccaaggagggaagattgcttgagcccaggaagcagaggttacagtgaccagagattgtgccactgcattccagcctgagcaagtccctgtctcaaaaaaaaaaaaaaaaaggaatttcgtttgacagaagaatcagacatgcaaaaaactatgtaaacacacacaaatatgagtataagtaaatctgagtaagatcaatgggttgcttcaatgtaagtattctggttactatataattttgcaaaattgggaaatgggcaaagtatacgatggatctccattcttttttttttcctttcagaaagagtccttgtttctgatccatttctttttttttttttctgggacagagtcttgctctgtcgcccaggctggagtgcactggggccatcttgactcattgcaacttctgcctcccgggtacaaacgattctcctgcctcagcctcccgagtagctggcattatagggtgcatgccaccacgcccagttaattttagtatttatagtagagcacgggttacaccaagttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtaggccaggcgcagtggctcacgcctgtaatcccagcactttgggagcccaaggcaagcagaccacgaggtcaggagttcgagaccagcctgaccaacatggtgaaaccccgtctctactaaaaatacaaaaattagccaggtgtggtggcgtgcacctgtaatcccaactactcaggaggctgaggcaggagaaatcgcttgaacccaggaggtggaggttgcagtgagccaagatcgtgctattgcactccatcctgggtaacatgagtgaaattccatcaagaaaaaaaaaatgatcaggtagaccaggcacagtggttcatacatgtattcccagcactttgggaggctgaagtgggaagattgcttgagcccaggagtttgagaccagcctgggcaacgtagtgagacccccatctctacaaaaaaaaaggtaaaaatcagctggacatggtggtgcatgcctgtggtcccagctacttggaaggctgaggcaggagtattgcttgagcccaggaggctgcagtgagccatgatggcactgcactccagcctgggcaacagagcaagactgtctcaaaaaaaaaaaaaaaagaatgatcatctatactgtttatttattgacatttattgacatgaaaagatagatgttcacgacattgccaagtggaaaaaagcagattacaaatcaaagatgaaatccccatctggtaaatatgccagttgtttacaaaataaatagtgggaggaaagtatgtaaactctttttagaaagtaaaagaatcaaatatttttccttttttttttttttggagatagaatctcattttggcacccaggctggagtgcagtggtacgatctcagctcactgcaattctctgctttctgcctcccaaggtcaagcaattctcatgcctcagcct

SEQ ID NO: 479 - DNA, 3742 bp, Homo sapiens
cccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacaggcaaacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaag

SEQ ID NO: 480 - protein, 1083 aa, Homo sapiens
QVVEMAMEPNCVTYSVPNLLWKQPVENTRKCSNRQTWMDNMGRAGEMELKPFNGEDYTCITFQPDLSKFKMQSLDKDIVALMVRRAYDIAGSTKDVKVFLNGNKLPVKGFRSYVDMYLKDKLDETGNSLKVIHEQVNHRWEVCLTMSEKGFQQISFVNSIATSKGGRHVDYVADQIVTKLVDVVKKKNKGGVAVKAHQVKNHMWIFVNALIENPTFDSQTKENMTLQPKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTNFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSSLARLLFPPKDDHTLKFLYDDNQRVEPEWYIPIIPMVLINGAEGIGTGWSCKIPNFDVREIVNNIRRLMDGEEPLPMLPSYKNFKGTIEELAPNQYVISGEVAILNSTTIEISELPVRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKETEKSDSVTDSGPTFNYLLDMPLWYLTKEKKDELCRLRNEKEQELDTLKRKSPSDLWKEDLATFIEELEAVEAKEKQDEQVGLPGKGGKAKGKKTQMAEVLPSPRGQRVIPRITIEMKAEAEKKNKKKIK

SEQ ID NO: 481 - DNA, 39121 bp, Mus musculus
  misc_feature (1)...(39121): n = A,T,C or G
tacctgttgttatgactacctgctgttacaattaccttgcaatcatgtctctgcttgaggagatccttgggatcatcctagaatgttcttctcctgtaactttgcgtattttgcctgacggatcccccatttgggaacccccaacccctgagctgttaaaaccttgttttcgtcatatccagtgctgtcagccccagtacatgaatgacaaattttgctttaattaattgttttgttttagtaaccttggctataatgatttgagttggtggtcttcctcctcccaactttgggattaataccaggatggctgtaatgatcatttttaatattaggatgtggaggatgtgggaacgtaaaatggtgctgatgcatttgtaaacagggtggtggtttctcagaatattaaatctagaatctccatgtgacccgacaattctacccctagatataaatacaggcgatagaaagcagggatttgaccagatgtttgaatgagcatgtccagagcagtgttagtaacagcagccagcgctgaagtactctgaagccaggtgagccaggtggacatctatgatcttgttactcaggaagctgaggtaggaacatcaagggtcaaggccagcctagtgatcctgtcacaaatgaaaatgcacacacacacacacatacacgggggtgggggtggggtggaggaagagagaatcaaccagcagataatgaatgaatgaaatgttgcacataaatacagtggaatgctattcagccatttaaaggaataaacatgccaacatatactataaaatgaatggactttgtgttaattagggttcccattctgtgacgaaacatcatgaccaaaaacaacttgatgaagaaagggtttgttctgcttatacttccaggtaacaatccatcactgatgaaagtcagtgaagtaccttaagggcaagacacttaaggaggcaggagcaaacgcagaggggtgcttttttactggcttgttcctcatggcttgcgccttccatctgagtgacagcatcttcctcctnnnnnnnnnnnnnnnnnnnntttcctctataacagcacagtgtggcaaagggaacttgctctcagaatactttgttagtcaagataccagttgggggaaattgtatgcaattaatgccaccaggtttatgctgactcatctcacgaagacttgatgtcatgaacacaaggtcttctgtgtccttaaacgcttacctggacaccttatttgtttgtacaagtgctctgcctcatgaccaacttcgatctcacgaaatgtggtgatgcatgctttggtcacctcctatttcttgacatcttctctacaccaggagaggctgttgggagtccttggtgggcatgggagttctggggaaacattccttttcttttggatacaaagctaacataactcagggcataggcttaattcctgtagtttaaaacatttcaaacacaaagcctttgatctctgaagtctttgatgtctgaagtgtttctggtttcccttctctagagttaggggctttttcctggtgtttccatagcttcctgggtctgcttttgttcttgctcaccatagggtattgtatagcctgttactgagagccatgaccagagccccgagtctagtcagcctttgatccaaggacacggtacactgccccccttcttcatccccacatcagcctttccgagagccgttcctgggtgtggcttgaaaccttaatagccatggatatcatatgacaaaactcagcacatcaattttccagtgacatttagtgctcctgagctctgcctactatctcatctgtaccactaagtagccccctatctcttgatcacaaggtttctcaaccactactgccttgcagagggttttatagacagtgtgtctctagggtcgtctcttgggaacagatgtaaaacaggacaatcaattcaattaactagttggtatacagctctctccatatcctctcccattgcacattcaaactgcagtatttgctcaccccagcccgtctggcagcacccaccaggcttttacacgggtgagtgcacgacctttggccagctggcaaaggatatggttgcatcctttctctatccaaaggctgagctttactgtggtggttccttagataccttcaagatctgggcttgtgaagtacaagccaattctgcaacgttcaaggccctgttttctcgacattcacagagtctctgtcccggctgcctacaggatgtttggttttgactatgtgggcatttgtgtgatgtgatttgtgagggcccactaaattctacctatccactctccactctccaatctgtcccatttgtttattcatgcttgaaattgctttaacaaaatttacatttccagttaaagtttttaagagccacagacatagatatacacacacacatatatatacatatgcacatattattacacatcacatattataaatgcatattaatagttctaattaataattcaataataaacctttcgattaaattaacatttaattaataatttaataattagtcttcaccagctacaacacatatatatgaaagtatataaatcatagctgcaaaagagccactcacaccatgaacaccaggttagaccattcccattcccagagctctctcctcacgtcttcttccctttctagttttgttccttagaacccaccaataacttacagcaggattgggacattcattttttgtttgtttgtttgtttgtgtttttttttgttttttgctttttgttttttgtttttacaaattgctgcataaaatttatatctacttactctcacagcatattgctttgagatatatacttacaacgtggaaggactaaatgtagttaattggcatatgcattcttcacatgggcatcacatttgtttgcttttgctcttgatccacattgtggtgtttagttatagtttgttcaaggtggtttttatctatctatctatctatctatctatctatctatctatctatctatctatctatctatctaatgtatagtagtctactgtgtacttaaaccaaactctccaagtactttaacttggattgcttctagctttcttccttaggaatagatttgctataaatattctagttcaggtctttctgtgactatgaacacttgctgttaaagaatcaaacagatgagacattgatatgcgtgtttagcattagtcggtgttactcagcgcccttcccaagcctcagcaccagcgtgcacaagttaaggtcagagcacatcttcaccaccacaggatcagctgtcttctcctttatcccctccggtgtgcaatcatgtgctctgtgttcacagcctgtgtttgtccaataacagtaaatgtaggtgccttgctgcatctgcattggcttttggtgtcttctgtggatggatccttcaaaccttttgccatttttttttttttcctaccgagagtcgacttttagtgtaatacattctttcaatgctttcagatgtttaaaatttttatttgtacagagtttttcctgcatgcatgcatgtctgtatatcacatatatgaagtgcccacagaggcaagagatggcactagatctctgagacgtggagttacagacgtttgtgatctgacatgtgggtgctgggaatcaaacctgaattctgcataatcagcaagtgcttttagcctctctggcatctttgtataccctagtataatagtattaaaatatgttttttaatgtattagctatgtatacacactcatataaacgttgtgtgtgtatgcatgcatttatttgaatatatacatctctttttctccaccctgtaacttaacttttcattttcttaataaaatcttctaaatgaaacagaagtctttttttttccatttttattaggtatttagctcatttacatttccaatgctataccaaaaggaaacagaagtcttaacttatttatgccttcttgtgcactctatttaagtccttctggctctaagagaaaaatatttaaaaataccatcaagatgtttttctgttttatttaaaactgacttgtgtgtggtgtaaggtagggatcaagccgcactttttaaaccatatgttgtgcagcaatcactcccaaactgaacaatttctacttacttttaaaggtttattttcttcttgattatgtatataattatgtacatgtggtagcaggtgtgggaggagaccagaggggggcactggaacccttggaactgtggttaccggcagattactgtagcctgatgtgggtgctgggaactgaactcaggtctattgtaagggcagtatatatgtattcttaaccactgagccatctctcaaccccaatttcctccaaattaaaatattgcatcctggagaggaactcccaagtctctgtaagttccaaagaaaggcttgttaagattcaggcagtaaacaactcccaagtctcaagaagtccctgaaacttaccaggctctcaaggtctctctctccttaaggttgttactgctaagaagagggaactctcacctcctgagctgcctgtaagttgtgcagagagcttcagggtgcttgttttcatgagttatcactcatactgggtaagcttttttagatgcagtgcctgtgggttgtctgtgctcctgtaagtaaccctcgccatgctcctgtaagtgactctgataaactctgttaatagttctctgagttggactttgatggtattgttcctttggtctgtcattgatcccttatctggaatgaatagcagggatgagtatcatgttttcccagaaaacttctcacacaatattattctattctgttgactcggaactatttattagccagaccatatttaatcctatgctgttaaccacaggactatatgtgtattggtcttgggatacttgagaagtagttaatagttgaacttattccgttggtatttgattctttttgcaagtagcatttattatagtcactaagaataagtcatcattgctcaggaatcacttcatcttaaacttaatcagtcacagtaatatagatacttgtattatcctattttataggtaaggaaataatttgcccagagttctctagcttgtgagtggcaggaacatgacttcagggaaattctagttgactctgacgttggagaagcttttgatgggggggggggggggacagtgatgatattatgttgttaggagagagctagaaagaagagctaattaaaaaaaaaaagaaaaagaaaaagaaaaaagacaagctgaagagtcggctcagtggtaaagagcatagagtgctctagctgtgaatctgggtttggttcctagcactcacatggcagatcccaactgtctgtaactccagtgccaagagttctgccgcccccttctggcctccatggtcactgcatgcatttgatatacatgcaggcaaataaactcatgcatctaaaataaaaatgaatttaaaaatctttaggaaagaacaaagaggtagagaatgtcttaacttaagtatacaaatattaaaggttttttttttacagaagaggtattttaatctttttgtgtgatttgctaaagtttcaaattccctccaaagcaaacttattacttctccaagaaagtgttttgtttttgttttaagtaatcctcttgtcttccacagggatgcttacaatccttcaatctttccagctttagaaacatctttcatttttctccattccctcatcctttatacttaattagccacaacttctaccatgtattccttcagctattaaaccatttctctcatttcccactgcctgccatctgttctgatgaactccctactgtccctcctgcctccagccagtctattaaagggataatatactaccaaagcactgcgcacaatgtctccttttcaaagctgaaccctttaaatgcaacatctgagcggattctcacactcttgtccatccatattgacacctctattttataactctcctttatcactaaccaaatgccaaaatttagtattcaagaacattccaaatcggcctcaagttctctctgtggccttaccttcactactcctttaaattctactctcagtgaagtcaccccctcatgttcctctaaacaagtcatagctatttctacctcaagtcttttcctgaaagtacactgtcttgattattatcccccttcccacatcctttaacatttaatatctacatttaaattatagctcaagtctgattccttctaaagccgttaccacattttactaaactctttctcaagttatttggttacttttctccttaaaaaaaatagctcccaatttgcccaaatatcacaactgccatcggcctattgaaaggcagtagaaatattaaacagaaaccctgaactcagagtcaaatgtatttgggaccatttacatgctcatgactttgggaaagttaatttctctaaatcttctttcttgtctgtaaaatatgaatgatagtactttgtcttgtttaacaatatttacatatgtgtacttttgtgggtatgaacctgtgggcatgtcagcatgtatgcggcagtcagaggacaccccagatgttggtccttaggagccttccacctttagtttgagacagtgcaactcttggctcttacaggtagttagtctaattgctccactaactttcaggaatccatatatatgtatatggatgtgtatatgtatatgtatatatgtgtgtatatatatacacacacacacatatatagtttctctagagaaccctgactaatacagatgaaaacataaggtaggtgggttatagccaagttggggaatctgttataggccttagatgccatctgataacatttttcaccaagggttgggaaaggtagatgtttgtactttccaaaaggacttatctaatctttgtaagaatcttaggtaatacatggttatttaaagggttaaagatagcccaagatgtttgacaatggatctgcaacattttgactttccataaattgaaattgtaatcagtcaattgaccatgtagaatgattaacatgggcagttgttttttggttttctgggatctcaatttacagcatagaccaaaccaccccaagagtttgttgcttgaagcagcatttaatttgcgtaaatctgcagtgtgggtcggactcagtgaagatggcttgggtctgtctgtactatttaccatcaagaagacagaaagggtcaggtagaagctgcatcatctgtcacatgcagcttcgaagcctctcagcattatttctgtagagccttgacagctggggcagagatgcagatatcaggttaccatggagaaatattaatgttgtatcaaccttaatgaaaaaatattcatgtgatcattttgggaaaataaagtgtgttcagacctaaaggataacagaacatgtattgaaagcatggcttgatattttatggccatcgccatccatctctggcccttatctaatgccaccatagcattttgttgctttgagcatcaacatattattgcattttttgtaattattgataacatatcttaaagcctggaactcataggtttccatatgccatatacttatggtatatgatagaatacattgattttactattttatgtgctctgtcttttaaactgatttgtctctgagataaagaggtgatttttacatgtttgtaattccaatgactgatccacccaaagcatgttcttaatgggtgtttgtgtcttttaatattgaattgtaatcgcttacttgagagttttccatcaggtaagttttctgtcctgtgttgattcaaattcagattatgttatctatctatagcatatactttgtatttaatgtctccagtagctgctgacctcaaagcaaaaaatggaaacctttgaatgaatggaaaatagaaacacacaccaaagcagcagctactcccccatagaatcatgaactgagagataggagctgaattgtataaaaggaaagtgctgccgagctccaaaccctcatggacctgtggggtcaaggtctgtgtatatctctcttatgtgtaaagcaaagcatgttttgaagagatggcgtgttatggttctattgctgtgaggagacaccatgagcaaagcaacttataaaagacagcatttaattggaggcctgcttacagttttggagggtgagttcatggccatcatggttagcaagcttggtagcaagcaggcatgatgctggaccaatagctgggagcacaaatcctgatccacaagttataggataggggtatggatacatatatataactggatacacacacacacacacacacacacacacacacacgtcatatctatctgtctgtctgtctgtctatccatccatccattcactgggcctctgggctttgagtttcaatgaatgaggagcaagcagtcaagcaagcatctgaatctacggggcccattctccttcaaacccccatagctggcaaagctgtggagaggcttgctgctctttcccagggccagggttcggctcccagtacccacaccactctgtcacgcttgttccagggcttaccacaccgtcttctgtcctccatgtgtaatgtgacatggagaagcaggcacacacatatgacacagaagcaacatctttaaaaaatttaaatgcagggcctacaacagcagcacagggttgttggaaaactaaaaagaagttaatagatgtttttttaaaaaaacaaaaatgctaatgcatgtcaaatattggtatacaagagttgcatttaggctacaggagttcttattagtgataaaaggacaaagtatttggtttttagatatctataaaaattgactgcttgacaaattaactcaatactttaaaaatattaaattatgaggtttcctatttacatttttaaaggaaacatttttattgtagtataattcaaatgcaccttgaaatgcataaatttataattttgtaattaacaagattgcaatcgctgctctatgtaaattagggtgtatctatgatttgctgccaggaataaaaaatgtcttgaactgattgacaggaattttgttatctactggttaggataaaagatttaaaacgaacgtgtattaagattcagagttcttccttaacatggacccgctgtaaaagtgagaagcatgccagttctgttcagcaaatgttttagtagctcctgtgatttcaaaggcacagtgttggctgcggagtgcgagatgaataactgctggtattgaagagaagcaagatctgtacccagtggaaagaggaatgggacgtcacggtgtagggcaaacacaatgcaggaacaacccagtggagcttaaaataatttaattctggctgcctgaggtttttttttttttttttttttttttttcccctaaattttatattggatgccctttcctgcgtgtgctaggttgcttattggcgtagaatctgcgaccctgtgaaatctttttcattccccatttcttacttttccttgccaactcgatctcttcagccgccagcactgcctttggaacagtatctattgtgtgggtggcggaacgcggggaagctatttctgttctaattatgagcactgttttcgtaggggaaaaggagggggtgataaggcagatctgaggctgagccgttggctgggcgaggatgctcggtggaggcgttactaaggttactagagagaggaccgcaggtgacaggcggggtttttctctatagcaatatacattttccaatgaaggacgtgggctgggcagtgccacattgtactacatattggattccctagaggaaaaaagagatggcccaaaggaaaaatgagggaccaaagcagggagcctctgcttcctcttccgggccttttcttccgccttctttgtttacccccgagccattctggctgcagcacagagtcggcgcgctggagaacggtgtcttatcgatgtgacacgcctctgagccgggccggaagcggttcccagccggtacccgtagggccaggcgtgcagcgtgcggtgacagtggcgcgggcggcggcgctgcgtggctctggaggaccggcgcggacctgcagcggctcgctgaggccgtggctcgtcgctgcagctgtcaggactcttgggggcgaacttgccagacagagaggagcggaagggaaggggtgtgtaaggagggccgtgggcgtgtttggtctcagagaggactttgaaactggttcttagtagttgagtcttatttttattttgacagattcgggaggcagcagatgccctattctcgagattttcttaattccagtcagttgatagcatgatttgagtgagagctttttagtgaagctactgggttaagatagctcaagggatggatgaagctgcccgagataaaaagaaatgtggcgtcggagcagagaagaggtgtctggaatgaggggtcaagatgatctactagttcatatttcaggttttcctgtactaggtaccgtccccaaactatgttaagcttgaggtctgggcttctttacataacctctatgttaacctttacataagtggggaagtaggagacgcgtctgtgccagccagaccttagattctgcaactgctccaggcaccacactgcggttttccatcatcaatatatgaagcacgtgaggatggattagagggtagtagaatttgaacagccttgatgagatctgctaaaaggtgtgacgtctaggtgtataaggcaatgatagatgtcggtcaggaagaactgtggcctgcaaacctatgtctccaaagcttggctgttgccttctctttagcatttggtgggataaggaagagaggtttatactcacacgcccaagtttgaaaatggagttgcaaagactcacagaatttaatgatttgacatagctaccttatttaacagatagagtgacaaacagaaggtagtcaagaacgcagacactggctgtcctagctgtacttgccaacacagatgctaaagttaatgtctctttacctggactgggtcctttcagcaataaagattgcaacccacctttacccctattaatgtgtgttacgaattctgtacacttactgacacaaataccaaagctgaaaaatattatcgcttgacctggactggctcctttcagctgcaggagttgactattgatgatatacagcagtaaaatctgtacccttgctcacgtgtgttccaaactctgtgtaatgctggagtcagatgccttttcaggcacaactgacagctgaagcttttcagcaattccaagattgtccatctgaaaataataagactgactaagcctaggggtaaggaaactgagcttaaggagacctcagctaaaattcatgcttaaaaattaaagaaaaaaaaaactttaatcagttgataatgtactgtttacaaacactaattctggcaagttgtatctaatattcccaagagattgttgaaactggggccttaagaaccaagtagattagtttaactacattttcattcctaaaatgcaagtacttatttttaacttgaaaaatcataagctttataaaagtgcttatcactgtgtctgtgacaaagtaataatatagttacccagtgcttaataagagagacacttaaatacatttctgcagctccttcattgttcaaacagcagagagtatgcttctacaatggtacagccatcaaacacctctactacagatagcccctaaactagtatctttctagactatgaacgtatatagcatgttgttgcaattattactgtagataagtttaatggtatttgcacagttaggcatagctacaatgtagaaggtatacttgaagtactaggcaataatttgtattttcctccagtggtctgtctgtggctgaaacatctctagggggtgtggggtgtgtggcacaaataaaagtgatgcactgttgtcccttgcatggagtcgctttgcaatatccaggcttaggtttcactggaaggccagtgactaatgtccttattcttcttatttcaaagggattaaagtgttaggtggctgcgtagaccatagaccatgatctgcccagcatgacttgtaaagcttgtggctgtttaagatcacttaactctcagtcttgtgtttcctgagtatttggcagctcgggtccgcacagctgacctcacactcctttgcagatgcatgggcatggaggctatgactctgattttagtgacgatgagcaaggcggaggctccagcaaaaagaggaagaagtaagtctgttgatccatcgttcacactgtttctagacggacatgaagtataactaaatcctggaaagggtnnnnnnnnnnnnnnnnnnnnnnnnnnnnnnnnnntttcatttgttaagactgtgtgtctgcaaatgtcacagcttaaaggaggcttggttgctgtttgtcttcccagtgaggtgcttgtggaggatgaattgtaattcagaacagttgtaatgttgacttgaatgagcaggtcagagttggcaagaccaagatcctctagcatacaaagcctgggcttcacaaagaggacacatttttgttgttgttgtcatttttgtttcctgagacagttttattatttagttcaggctatcctggaattccctacatagcccaggctgtcctaagacacagtcttcttggtttagctttgaaagtgctggggttccaggtatgaactgcatgtccagctggaggctacatcttcacaaaattgctgtgtttagggccattgtccttagctttcagtgctttgaaatgtcatggtatgtagtaacaggagggcttgattcgtagtagcaggacttagagaagttggtttattatcccatagtgagactgatgtgttatcactaactaggaatgaacattttataaaatcggcagtctttatcaataacagaagaatagtaataattatagcaatgtatgttttttagatttctttctttctttctttttttcttccttccttccttccttccttcctttctttcttttaaaagatttacttatgttgtttatatgagtacactgtaactgtcttcagacacaccagaagagggcattggatcctattacagattgttgtgagccactatgtagttgctggaaattggactcagaacctctggaagagcaatcagtgcccttaaccactgagccatctctccagccctgtgttgtttttttttttttagattttcattaagaaacattgctttctggtctggggggggggggtgtaactaagttagtggaatgcttgcctaggatataggacgcccaggttcagtccccagtgctgtgtaaaacaaagaaaagtgacacatgccctttagaggcagattaaggagcatcaggaattcaggtttatccttgcttgtgtagtgatttcagggctatcttgggctagtgaggatcctccctcaaaagaaatgatttatgaatagaatttgagcagatttagttgggtactgtggtctagggttctatgtatccatatcagtaaggctgtttgtctgtggtcagtgtcctctatagtcaaactttcctttccatattttttacctgttaaatcttcattatctctcctttagaggtaaataacttagggtggtaaatgatcaagtcaggaactgagctaggaacctgctgctaagaactagccattttctcttatcttttccattttataagtagtaaataaaatgaagaagcaaaatgtttcattaaagatcagagacccattttaaagttaagtccttatttcatgttagttacttttctagttgtgagcctgttacccgacaagaagaaactgaaagatttgcttttggtcaagatttaagaaggggtacagtgagaaggggtccccatggaggcaggggcatgaagtagctggtcacattgtgtctacagtcaggaggccgagagcagatataaagtgaggccgggttataaaatgtcaatccatctgcagtgatccacttcctccagcaaggctctgccttcctaagacagctgagacagaggtcactggcagaatacctgtcgagctgtcacaaacatgggaagagttagacagcatccttcaagaaaaattaacttttaacactttttctttttttactacaccaggacagtcgaagatgagttgctgcttacaaaaccgtttcaaaaagaaaggcatggaaaggtggcccataaacaagtcgctgcagacttgctcgacaggtgtggcgctttggtgctatgacggacggcctttgcgttaagctcttttataatctcagaacctgtgggtttcattatgttaataaaatatgggcatttgaatttacctaaacttttcttttttaaacagggaagaagcaagaaatagaaggtttcatctcatagctatggatgctgtatcctttttatagtcctattttcataactaatagaatattttgcttgttatccatgttttctgacttttaaaaatcaaaatcttgtcaagttaagtagactagttttatttttacaggttagtagttattgatatagaaatttacgatttgaattttcaggtgtaattctcttttgctaatatataggaaaaactagaggtaaaaataatgaaataaatactagttgtggtctattaatagactttaaagtccaggaacttaaaagggttcccacctgttcttgtcaggcttgctcacttccctttactgttctcgtcttcttgaatatcattttaattcatccccttcctacctggctcttgactactttaaattttctgcaaaacttctgttttaaaattaagtgtgtctgagtgccatctctatgtgtgctgttgctctgttcctcgggtatgactgaagacttgagctgtgagttagactgtcatgcaccgctactcgggatgttagagaacaggagaggccaggcaagacctgagtgttcactcccaggtcaggactgaagagaggaagcaccacactagagtcatctgatgcattttcacctcattcctttcctttaagttactgtgttctagattttttttttttaaaaatctctcttacctcctaatccattggaaacttaccttagcttaatggtcttatctcccataaacatctatacatatgttctcccttctctgacactactcattgagggtgttagtgcacctagcgagaataaaaatataggtgatatgtttctgtcatggtagagagatactcatggctgagatggtagagaaccccagtatttttgggaagtaggcatatgtttagctataggagtagtcaccatcttaaaagttagtgattttgctaggtgtggtacacaccttcaatacccagcattcagaaggcagaggnnnnnnnnnnnnnnnnnnnnnnnnnnngccagcatggtctacatagtgagctccaagccagccaaggctacatagtgtgaccctgtctaaaaaacaaaaacaaccaaccaaccaaacccaaaaaccaaaatgttagtggctatcttagttaaggtttcatagtgaagggacaatatgaccaaggcaaatcttataaaaggaaaacatttaattggggttggcttacagttctagaggttcagtccattatcatcttggtaggaatcatggcagcatccagggagccatggtgctggaggagctgagagttctacatctgccccctctccccccaacaaggtttctctgtgtagccctggctgtcctggaactcactctgtagaccaggctggccttgaactcagaaatctgcctgcctctgcctcccaagtactgggattaaaggcgtgagccaccactgcccagctaacttctacatcttgatcctcgggaagcagaaggggattgatctcctacaaacaaccaggaggagaatgtcttccagactgggtccagcttgagcataggagacctcaaagcccacctacatagtgacacaccttgtccaacaaggctacatctcctccagcaaggcgcacctcctaatagtgccactctctatggtcaagcattcaaaccatgaatatatgggggccacccctattcagtccaccacagtagtcttttagagttgtaattgtttcagtctgtgtctgttggtatttttaagttgctagcctcaccaccaagtctggggtagatgaagaaaaaaaaaaaaaaaagaaaaaaaaaaaagaagaaaaagaagaagagcccggggaatgaatgtagttcagtacacgggcagtccctggtgtgccttttaaccaccgtctttcacaggcttgtatttgttacatatgatgcccaaagtgggactcgttagtttaaagagtagggaggaggaataggtttttgtctactccttctcctggaagccaaactctcactgccatccgtgtttttgctcaaggagaagttgtgttaaccacagccctgcctgttgcctatgactgcctcatgttacagtagcagagctgagcagtaacggcagaaaccactaggctgcgaagcctgtaacatttgtcttctagctccttacagaaaaaaattagcatttttaacagcttgcccatttagtggtagttggagagttcaaacccaggccttgaggtgtttgtctacctccccactcaatttcatgttcttattaataagtactctaattctaattattaataattagcatacactgtgattagggaaattactatgcctataagggtgtggtcagtgaggttgagacagttcaccttgcatgtgcttgggtatggagagtgctgccttggttttaaaaggaacaccaggtgttcgtatatcttgttattgtgcatgaaaaatatacatagttgtgtagattctctgaatattaaaaagaaaagaaaaatcttactgtgatttatttatttcattttcttttctttttgagacactctcttaccctaaggcccaggctggccaggaaatcttgttgctcctcctgcctccacctcttgaatgctagtacgctaggtgtgagccactacacctcctctctgacttcttcggcggcggtggcggcagcggcggctcctcctcctcctcctcctcctcttcctccttctccttcttcttcagatttatttatttctttcatgtatatgagtacacactataactgtacagatatttgtaagccttcatctggttgttgagaattgaatttaggacctctgttcactccggtcaaccctgctccctccggtgggccccactcactctggcccaaacatttatagactatgtttgaagactgtagcagtcttcagacacaccagaagagggtgtgagatctcattataggtgtttgtgagccaccatgtggttgctagggtttgaactcaggacctttggaagagcagtcagtgcttttacctgctgagccatctcaccagcccctctctggcttcttatgtttgtgttttgtttttgaaaccttaatgttcatgggatttaattttataaacatatcctatttttatatactttattattaattattgcattgtataacagaagataaattttaattttttatctttaatttagaagctgcagtttatttgtaatattattattagactgaataagagaataaagctgtgtgcagtctagaagtagactagaaagctccctctttcccctggtggttatatatttttatcccaagaataatgtattcatgaaaaagattccaaactttataagtaatacatgcttgaaaggttttcagcagaaagtgaaagtccgctgtgtagttgtcgtacatgatttacacatttaaaaatgatagacagattcataccatgctttctttttatttagtagtatgttacagtggaacaacttctgaacagttacagaagtccttaatgttttgcatttcagtatcaaaggcacaccaagtttgtaaacgactatattttgtactatggtggcaaaagagaggactttaagcggttggggtaagtattgtcaagttcatttggcacggtagggcaagtacaaatgattttctaggccctgttgtaactttcttggcgacaggagcatcctcatgatagaaccaggtgtgatgctggtaagaacagtacacttgagcaatgctttgtgtcttgttgatgagaccattgaaatgacgacacacttagactgtagtgtccaggattgcttttgcaaaattaaagcaatgtccaaaagactccccaaatataggctattgctgttgcccctggttgctccctaggcattgaagataagtcctactgctgaggacaccagacacttgacataggattcagatgacctgagatgagtctgacctgaaagcttccttcctaagggctacctttcctggtacaattgagaaagtggccaggaatttgagagcaatggagagggtatctgagaggggttggaggaagaaaagataggatagaagtgatgtaataacatttataatctaaaaaagtaaacatgttatttaaaaaaaaaagacaagcaggaaacttcacataaaaattattcctgtgttgaggctgttgtcttgcatggattcttctctgatttactatctgagtaggtagggccctaacgaatttaactattatttaatttaatagttaaattagctaccccatttctatcttcccctgtccactgagaccatgctgctcaaatgtttcttccacttcctagctgagcatctttatttttctcctgcctttattggtcttcccgggaagctagtaacatgatgtaacatcgcatattactgagagctcgttactcggatctactctgaaacttgttctcactcacatttcctcactcagagtctggttgagcttctgtgtccttgttttggcaacaaagcaccatctgtataactaacccactgtagggttgagtggatctgcttctctatggaactcactcctttcttgcaagtttttcttaagtaccttctgaaaatattgaatattttttatataaaaatttccaaattgaagtatacttttatttatatttttattcaagtttttcaaaactttcagcaatgtttagcctaaatttgactaattttaattttatattaaattaaaaattttatattctagggagaatgataagacagatctggatgttatacgagaaaatcatagattcctttggaatgaggaggatgaagcagatatgacttggtaattttattgattatttatttgttttgtgtgtgtttgtgtgtgtgtgtgtgtgtgtgtgtgtgtgtagggcagaggacaactgggaagaggggttctgttctttcaccatgagcttctcagggctgaaacgcaggtcatcagaattggtggcaggagcctttactaattagactgtcttgccagtctgaggcttggtgattttagccaatagcgtctaatggaacaagtgttatagtcttgtctttcttattctatgtgtgtgtgtgtgtgtgtgtgtgtaggaactcttagaggccagaggagggcatcagattgtccagatctgtaagtacaggaggttgtgagccacccagcatgggtgctcagatctgaactaaggtcttttgaaaaacaacacatgttcttaacccctgagccatctctccagctccaatatgtattgtcttaatcatcatttatcaagatgttcagctctttcatagacagtttctgaaggatagaaacctacatttatgactcctgattctggtttgcttccttgggtaatctttggtaatttaattaacttgtaattgtttgacctagtcttcaaaaataattatgctactgtttgttgtcttataataagcaattgtatgttccttataaaatgttttgaataatttggaaaaacaaaatacgtgaaagtggttttcaaagtcagacatcactgagggtaataagtgaagagtaattctccatctcattctctgagagccgccattaacaaacaggtcatctctagacagtcgtcacatctgtctatattaggcatctcttagcattaatatttatagcatatatgtatcacctatttgatatttcttccaagtaacaaactgttgttggatttctgaatatataatacatactttttatggatttagggagaagagacttgcaaagaaatactatgataaattattcaaggaatactgcatagctgatctcagtagatacaaagaaaataaggtatgccctaggaatatttatagctggcgctcttgttcaactacagcatcaatttttattaacaaccatgacccacattactttttcctggcactgatttgaatctgttatcttgcactttgaacatcattttaaccacttaccctctgtggtcatggggtttaaagggtctataggatttatgaaggacaagtgctttgtgtttgtgagatcatctataaaaggctaaaattacacagttggcaactagattccatccgggctgtcatcttgagcctctagttattaaacactttagaatgatgtctcatttcatagatcatgctttaaatcagcagttttttgattgattgccatttatggagtggcagatgtactttttttctacataaatatttctattttggtaaaattaactttcagtcaatgctaattagtagtggcagatttccatttccacattacatctttagttaatattaaagcaatttttattcctagctcaacttccattggaactagagaaggtaatccaagaatggatgatcttcagttggaaatgttaaaaggactgagtgactatttgtattctactaagaaaaaaatccatttataaacaactatcttaaaagaaattctaaggatttcttttttttaatttattttgatttctttagtttgtgagttgttttttagttctctacagacagtagcaataattaccttgcatattcctgatacaaatctatgtggttgcggtagaccaaagacttctcagttccttacaaactagttgtgaatactattgcatagcacttgtctgtaccagcgaattaccatagtaactagtctggagtcagcacaaccacctggatggagttgcttgtaattactagacagtaagccaagtctgaaatacctttctaggcccatgtggcaaagtagattgattgccagccatggatttttttttttaatgatacactccagtatttatcgaaattggactgcaccctctatggctgcagtctagatgggtgtgatggtgtatacctgtggtctcagcacttgaggcagtagcaggattgtgaagtcatgactagctgaggctgcagagcaagttttgagggagatactgtctcaaaaaaatgtagtctagctaaggagaacagataattcacaagagtgtttaaagtctccattttaaaaatactactagaatcagggagctggaaagatggctcagtggttaggagtgcttgctgaggagtcataaggacctgaggacgagagtttggatttcagcacccatgtaacaaggcaggcaaccacacatatgtaaatacacacacatacacacacacacacacacacacacacacacacacacacacacacaccctgtagtaacagcctggatgtagtcagagataggaggatctctaggacttgctagcctctatcctagctcccactcccagcaaaattgcaagcctgagggtcagggagagaacttacttcaaagaataggtaagggtgcgttagatacctcagacactcttctggctctcttatgtgcatgcactcgtgtgactgtctttttttttcttccagtttttaaaatctatttagaatattaaacatgatagaagtagaagaaaatctcttatgaagttctctatgaaaggaaattgtgacaagtttctggttagacagaaactgttccatctgcaagggagaatacacagcttcactgaatgaactgggtagtgttccttctgtttctattttgtggaatagtttgaagagtattggtattaggtcttctttgaaggtctgatagaattctgcgctaaactgtctggtcctgggcttttttggttaggagacttttaaagactgcttctatttgtttacaggttatgggactgtttaggtggtttatctgatcctgatttaactctggtacttggtatctgtctagaaagttgttcatttcatccagattttccagttttattgagtttaggctcttgtagtaggatctgatgattttttaaatatcctgggcttctgatgttatatctcccttttcatttctgattttgttaatttgaatactgtctctgtgccctctggttagtctgactaagggtcaatctatcttttgatttttctcaaagaactagctcccagttttgttgatctttggatagttctgtttgtttccacttggttgatttcagccctgagtttgattatttcctgccatctactcctcttgggtgaatttgcttctttctgttctagagcattcaggtgtgctgttaagcttctagtgtatgctctctccagtttctttttggaggcactcaagttatgagttttcctcttaccagtgctttcattgtgtcccataagtttgagtattttgtgcctttattttcattaaattctaaagtctttaatttctttatttcttccttgaccaagtgatcattgagtagtgcattgttcaacttccatgtatatgtgggctttctgttgcttttattgctattgaagaccagccttagccctggtatcttctgcacctgagattctctcttctatctcttgtattctgttggtgatgcttgcatcaatgactcctgatctctttcctaggttttctatctccagggttgtctccctttgtgatttctttattgtttctatttccatttttagatcctggatgtttttgttcaattctttcacatgtttggttgtgtttttttctaattctataagggatttttgtgttacatctttaagggcttctacctgtttacctttgttctcctgtatttctttaagggagttatttatatcctacttaaagttctctatcatcatcatcatgagatgtgattttaaatcagagtcttgcttttctgttgtgttggggtatccagggctctctgtggtgggagaactggattctgaaggtgccaagtagccttggtttctgttgcttctgttcttatgcttgcctcttgccatctggttatctctggtgttagctggtcttgctgtctctgactgtggcttgtccctccagcaagcctaggtgtcaatactcctgggagaccagttctctcctggaggaatttaggtatggagagctgtggtacagggttggctctggggtacattcagaaaccagaaggatcctgtcccggctactccatggtgtcctgatggctatgggtgggtctctcttgggccagaaatttgaacagaagtggtggtcttacctgtaatcataggtgtgtcggcactcttgggagaccagctctctcctggcagtatttgggtatggagcactgtggcacaggatcagctcctggcacagacagaaactggaaggatcctgtccctggctgctcctcagttcttgtgtcctgagggctccaggagggtccctctgagcagaagtggtgactatcttaagaagagtaattttgatagatgttatgttttgttagaacatggtaactgcatgtgaaaagaagataggtgataataagaaacgaaacatgacttgggtttgagtgtggaaatgagagaacaggaagtttggaggggctatgtttggaacatgtaatagctctgtgttctagcataccatgtttgacatgttggaaaaagtttagcttacatcatgcttccagagttaggatgcgtttttctcttagcttcatttacacagatagtactttattcactttaattaagcaggtcttaattaattagttaatcagtgcctactgtacatagcagagccttaaggcacgtctagtgactcttcctttgctctgtgttcctgttcctttctttgaaaacttttcatgtttgaggctgtatttgagttctattgagccactaggaaaggagaagtgggataagaaaaaaggaaaaacactgctttaaatgagccaaaagctatttttcttttacagaaagtcccagtagatctgtgttgcaggaagcaggattcaggaccaagccctgagtaactgcagcctggatcccatgagaagaactggggttgggaaaggatataaggagacagaggttacaaagtgggacagtgtagtctcttactccccataagattataactttcctcgtgatggatagtgccctgtaaagctttatttatttttgttttatgtatatcaatgtttgcctgcacatgtatgtgtactgcatgggtgtattgtgcctgtggggaccagaagaaggtgtcagatgcccccgtactggaggaatagatggttgtgatgcactctatgcatattggcagtcaaaccctggtcttctgcagcagcactaagcgctctttaacagctgagccatttctccagtcctgaaatacaagtccaataagtagttccttaaatagatgaatgaatgaaagaaaaggcttggaaaactcttgctagtaatacagttgactttgtgcttcagtagacactgcaagacaatgtgggatggcatgtaatctctagacacagatatacactaaagcataaaatgaaagggagtcactttaaaatttttacttcctttttttgatacttatttattctactccccccccatagacatggggaattttatttttatttgcattttaactagaatgttttgacatttttttgaatttttgtatgaatttaagatataaatttgaaaaattaagaaatggatgatttaaaacttgaatattaataagaaattgaatgttttatctgaattatttatatttttcccctttaaaaaatgtgtatggctgttttgcctgcatgtctatctgtgtaccacatgtgtgcagtgcctgtggaggaaggaagatgtcagctcctctgagctagagttgtaggtagttgtgagccaccacataggggctgagacttaagcctggtcgtctgcagtagcagccagtgctcttacataccgagccatctctccagccttctgaattctctcgtagtacactgagtctcagggttaagatattgaagtaatacccttggccataaccacagcccctgttcttgttaatactgtatactacgcatagatgttatatgcagatgttatcctgttcttgttaatctgtatactacgcatagatgttatatgcagatgttatcctgttcttgttaatctgtatactacgcatagatgttatatgcagatgttatcctgttcttgttaatactgtatactacgcatagatgttatatgcagatgttatcctgttcttgttaatactgtatactacgcatagatgttatatgcagatgttatcctgttcttgttaatactgtatactacgcatagatgttatatacagatgttatcctgttcttgttaatactgtatacaacgcatagatgttatatacagatgttatcctgttcttgttaatactgtatactacgcatagatgttatatgcagatgttatcctgttcttgttaatactgtatactgtgcatagatgttatatgcagatgttatcctgcctcaactcctgtagattttaggtattttaaaagtcatttttaacagaagttggtaattgtcaggagatatccttaagttctgtaaaaagagaaaaagccatcacactgatagttaagtttatttttcaggctgaaaacgtcaccaaccttggctttgtgtttagatttgtacatatattaatttaaaatttgaatttacatttattttatataaatgtacttttttttttttttaaccagtttggatttaggtggcgaatagaaaaagaagtaatttcaggaaaaggtaactttttaaaaatttttactttctaattgatcacagtttactttgttatatagaattgaaatcatcaggtgagaattttttcttataaaaataaagtttgggaaaaatgtatttctgatatatatgttgttagcaaagatcagaatttaatgctttcatgacttctttagaatttggtccttagaatatttgaggatatgtggacaatgttttaagaattaaagatttagtaacaaggaacaagtgcttgattatcaattataacaaaatattgatagtactgcattccaacaaaaatcattattttgaagatgttaaatatcattcgtgaacccaatagagttgcactccagctccagggatcgggagccctcttctgaccgctcccggcaccgcgcctgacgtgcacggatatgagtggcaggggtgttttctgtgactgataaaggctctgtagaggggagggaaaggggatgaatttaaagcagctctcttttgggtcagtgaggcggttggtggctaaggacaggtgccacaccagcctagcaacttcatttcaatccctcaagctagagttaaaggagagaacacactcaacagaattgtcctctgaactctacatgcatgcacgcgtgtgtgctcaagcacacacacacatgccgtgcacacacaatattaaatatactttttgggttttttggtttttcaagacagggtttttccgtgtagccctggctgtcctggaacttgctctgtgaatgaggctgggcaggaacttgatcctcctacctctgcttcctgagtgttgagattaaaggtgggcaccactgccaccaccatccccagctccctatccccctactctcccacccccagctaagtaaacattttaaaaaataaggcaattcaaaagttttcttaaggtcatgttttattttgtatctttacctaaaattatgagatatctgagatgtcactagtaaaaatatctgtattaattttgtcaagtgaaatttttaggagagtatataaaactgcttttaaaaaaatggcaggctgccggccgtggtggcgcacgcctttaatcccagggaggcagaggcaggcggatttctgagttcgaggccagcctggtctacagagtgagttccaggacagccagagccataaagagaaaccctgtctcgaaaaaccaaaaaaaaaaaaaaaaaaaaatggcaggcattctctaagttcttaaatgaatataggactagtggggaagcagagaacaagctgttgctctgttaaaacagtgttgtgcttgctgtttaacagacattactaaacatgctaaacatgcttaattaattagcttttcatttgggataacttgtacaataattctgtgacttccttacatacttcatggcatgacatgtatgtatacacacaatagatagatagatgcatacatacatacatacatgcatgcagaaagtgtgttttaagttcaagtcgtcctctgctacatggtaagcttgaggttagtctggggcacatatgctagatcctggtgcagacgactgagttacaaatcagcctttggatgctgatgttagagtttcattttggcagtcttttgcattttatgaaaaagaatttatggtttctatttgttactcttggtgcaaattattgtggtggaaattgttctttgtataaatcatttttattttctctttctctttttctgccaaaatagttttgagttgtgcttatgtccaaatcatttttttgtccttagaagtttttagatagaattttatgtaaatgatatatttgaaaacattaatttaacatttagctaaatactgaaaggactgacatctaagagcatgtcttttgggaaatgatctctttcagggttttagttagtacacttactatttcactttctaaagtgtaagattctctaatatggactcactaaaattctacttaaataaacagtttaccaacaggaattgtgtgccagcttttgttttaagagttcagctctttagcttggtccggtggcacagtctcatggtcccagctaccctggggatgtttgcaattcagtcctgacctttagaacaagttctaggccagcttaggcaatgtggcaagcaagcaagaaataataatagtgtttttgtttgtttgttttaagacttaatggtaaaacaaacactttgcatgcacgaggtcctgggttcagtccccactgtagaaggaaaaaagcatctctctgatttcatatttcaatacatgcatgctatagttattgtggtcatcatttttcatgctgactttgtattgaatttattatatttattttataatttttaaaggaaaattttagaggtaataggttcttgtaggtgactcctatcatgtactgtgggtgacagtccttttcttttgcaggccagtttttttgtggaaataaatgttgtaatgaaaaagaaggcctgaggagctgggaagtcaacttcggttacactgagcacggtgaaaagagaaacgcacttgttaaattaagtaagacgtgttcagtggatttcttccaaatttaccttgaatttagaactgaaaaaaatgtatgtactatttaattttaaaagatttggtatattttcctgaaagtatactttttccctgtagtttccccaaacctcaaataaaatttgaatctaaagtctttagcattatggaagcgctttgataagacaattctaatgtcagatttcagctggtaacttgtagagtcatctgttacaagcttgaggatggcactagattaggagtctaagtcagagtatcagaaaggcagtgtagacctcacatctgattgtgtagccgtaattatcagcaataaatacattttctttctgacagtgagtgaagattttggaaaaatatccttttaaaaaagtttttacgtaactaacttaatattaattttacttaataatgagtttcactatgtcattttcatgtatgtacacacacacacacacacgtacacatatgctatttactctctcttgtcccctcatacactgatcccctttttcttcctcattagtcctcatgtgtgtgtctgtgtgtgtctgtgtgtgtgtgtgtgtgtgtgtgtgtgtgtgtgtgtgtgtgtgacccaataagtgtagttagggttacttacgaggtgagggattatttacaggacccacttaccagttgctctacacctgaagaaatcttcaggagtacagagtctcacgaatctcccccaactccacaatgatggactgttcatgcatttaatagtctgaaggttttatacaagtaatcacagctgctgagaattcaaggctgtagtagttatgtcatgctcagaggacagagttatgtgacgtactgtgctacctctgggtcttcttttttctttttttcttctgctttctcactgtagatgttccctgagccttggaggctctaatataggtgccctagtaagagctgagccagttattctcagcacttggactagttatgagtctctgcactaataactgcactcataattgtctctcactgcaaaaaagttgagcctagcaccattctgggtaattaggagactatttgacaaccacaccagactatttaggaaagcagtagcaatagcttccatactaggaccagccacaagcccgtgaccagatttggagtaagatttccagtacttcatgtggacttcctcctgtagagtgagccttaaataccatccagagtagttggttaccccataacagtcatgccactatcacaccagtgggcaggcacatcttgtctgggagatgggttgtctaacatgaaggattcgtggctgagcaagaccattgatgacaactctcccagaaccccctgcacagtaccttctggcactgaaagctaatctctagagaggaagcttccagctccatttcctttgtctctcacacaagcaaagcatatggtatcttcaattgtgctgtctcctctggcttctaatgggcaactaatggccctagcaccagtcagtgttgtttaaaagtatagagatgagctagtgacatggttcagtgggtgaggtacctgctaccaagcttgacatcttgaatttattccctggagcccacaatgtggaaggagacaacagaccatgtaaactgtcctcagacctccatacactcatcgcactcactgtggtgcatgcacatcccctcgccacaaagtaaataccatgtaattaggaaacagtgtagagggactggagagatggcttagaggtcaggagcattggctgctcttgcaaatgacccaggtttgatttccgtagccacatgatgattcacagccacctgtaactccagttccaggggagccagtaccctcttggcctccacagtgagcctgtatgcacatgtccaggcatgtgtgtagacaaaacactcatacatataacttttaaaaataaagaaaaagattagagataaatgttactttgagtgttgttctctctgagtttctcaacattgctcatttaagaccaggtctcttgctgaatctagagctcaccagcagacagcagttgcctatagccatggtttacagtgttaccctgctcttttttaaaattagtttactactttcagttgcttgcttgctccctccctcgctccctccctcgnnnnnnnnnnnnnnnnnnnntccctccctccctccctcccttccttcttcccttccttccctcctttcttccttccatttatgaccatcagcttttctggctctgtaataaatcttcagagtttcagtctcctcctgatagtacagattggtttctgtgagctcctcctgatagtacagattggtttctgtgagctcctcttagaagcacctgtctggaaaagtcagccagtttggaatgagactagggaaaagaagtttttatagtggattctctttctgtttacttgaaagtttttaacacttcagaggagatggctaaacccaaataataatcatcatcatcattatcattattatatacatattattacatcatgttatattaagagagatctttgatgtcagatactaattttgtctatgaaacacaatggataaaactttttctaacgtacctttaaaacaacattttcatatgtaacagggctgacacatatataaactcacaaagacagcatatataagaccagcacaagttcaaaccagatagaatcccagcacctacatgggaaagtgggtacattaagcaggaagaagtttgtgattggtagctgctgggaaaaggaaaaaaataagttttctttaatgagtgatactttttttttttcaaaagagagagaaaatatgaattggggtggatagggagggggatcttggaggaactgagggaagggagagagtatgatcaaatatattgtatgaaaaaaaattctcaaacattgtaatataattttagatatactgttagattattttctttgtattatttcctgtgtatagtaagggatagaaagaacatgggaaattataattaaaatatatagagttgcaatataattacacggattcagaagctcagtggtatattttttctcttttaggattatgccaagaatgttcctttaaattaaattttcatcacaggtaatttttttcttttaaaatatcatttttaatgtttagtaacttaggccatactcattttatcacactgagtgtctaaatctcaatttggaaaatggatttgtttagaacatagagcatcattgtatgatccatggaattggagattcactctgccctcatcaagccaagcaagtttatatgtaaaggtctgtgtggggcgatagatgcctgttgttaatttggagccaacgactagacactgtaatagtcctagaaatgatattataaagctggctgcataaactggagcatgcgtgcatgcctgcctgcgtgagtgtgtgcccacgcgtttcttaggcagctaaaggaggacactgagtgttgtgctctctgtcttttcccccgttactcacttaaaacaaggtctctggttaaacctggagcttgccatttttgactagtctgactggtaagccccagcaatgttcttgtctctggtctccaccttcctgtccctaagcactgagattattggcgaacatggtcacagctgacatttatgtggttcttgggattcagattcaattccccgtgtttgcattgcagactctcttacccgggcatctttaagtcatctggagtgtgtctgctatgttgaattaggagtgccactggtctgcaccatgcctttcatgtgagatcattggtcttggttttattttattatttgcttgttttttgttttgctattttgtttcgatttttaggaagactgccttcagttcataatgcctctgaggctagcctcacatttgtgattctcctgtctcagcctcttgagtgctggctggggttataggccaacacccggcttattaagtttaggaataagcatgtctacattgtgttctagctactacaaataaacagtacattttcaaaaccagcaggnnnnnnnnnnnnnnnnnnnngaaggatgaaggtaagagaggactaagtatctgctcatctcgagtgtgagatacagacggccacggcactggtcagaatccatctggggatgtgcttagaggtctcttttagagcaactgaaagcgaagtggtcaagaattcagatgtaaatttatagtcgcttgtagcctgttaagaacagaactggttttggttccttttggggcataccctatagtattatataatgctgcaagcagtgttcggctcctggctgtatccaagccatgttacttggctaagacacagactctcctgggcttaccttctccatgtatgttggggtagtgtgaacacctgcctgcatattcataacagtcagatgagaatttgaaggctttctcagactgtaaagcagtttttcagtctgtcattcaatctaaaatcttgattatagtagctgccttataggattatgagaaaaattgagatcgtttatttagcaatttgactaatgcccaccgtgtaattcattattaagaaggtttcttctagttgctttttcgcaccaggaggtaatcagatacaacttttactcaatttaacccaatgctaatataagatctggacaggagagggcccccttgctctagataggaagatacttggctcaggtgcattcttttgtgcattttttttttccttcttgcatatcacaatggccatgcagttcaagtatatagtataaaatgtcactgaattggaatggctggttagtagacgtattattctgttgtttattgagagctggcatttgaagctgaaagcctttttatgtctatcttatttcctaactccacaataagtctcaataagtatggcaatctcaatttaattctgagttttaaatttaaatctgagtttaaaattttgtatttattctaatatgctgtaacagtaataaggcatttgaaattttggttatgtccattattaaattaataatattgttatcttcttaacggtaatcataccatgtaatcatggcttattataaattaaggaagagctcatctctacctagacctttttaatttgaaataatctttaataatgactaaacatctagacagttggcactcctggttctatccctagtcatcccttgcccctttgtgtgagactgtgtattctatagcttcatcgttaccccatagaaagtgctaagtaagtgaatggctgggtggacagctgagtgccacatggcagaatgagaaaactaagacaagtcaatagcttgtgtttgaagagtggttttgctttcgcaagaaaggaagaactaaatacttggacaaaggctctctatctcctctccccatttccctcggagcagcctcaccctcacttttcacttgagctcagttggaaaggcccttcttaacaacgtctgtctcacttctccaacccagcttagatccctagggtacatcctgagtaccctgtacttgtttagagatgcacaggaccctggaaatcattcattttctgtgagagaagggattacgtagctgtttaactcacccccaattcctaagaccataggcatttatttagtagatattagtgagtggaatcagtgaattcattcatttttctaatagttgaagaaactccagaaatcaatcctaaacataatcaaaaagatgttgtagaattttgcttttcaaactatgatgctctgttgtaagcagctctaaattggtctgaagttactgtctgaagcccctgtgatttgtgggtcctcacacacagacaagtgtgcaagagcctctgccctgtggcgtgtggtggttctgactgcttcagcatttccgggaagaggagcccactcatcccacagtcgccttcccgtcagatggtgccagcaggtttccctggacaaactacaccttcccactttgggcctacttatatcaatgggtttgcagagtaaacctaacctttccacctactttttaaattttttttttttaagatttatttattttatttatctgagtacactgatggttgtgagccaccatgaagttgctgggaattgaactcagaacctctgaaagaacagtcagtgctcttaaccgctgagccatctttgcagcctccacccactttttaaaagcccattgaacacctgtacttcttgtatcccctttggcctctaaaagactaaaacttaggcttctccagcctctcatccagttttgttgggtggctattttgtcatctggctttactaccccccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 482 - DNA, 1149 bp, Mus musculus
aagagatggcccaaaggaaaaatgagggaccaaagcagggagcctctgcttcctcttccgggccttttcttccgccttctttgtttacccccgagccattctggctgcagcacagagtcggcgcgctggagaacggtgtcttatcgatgtgacacgcctctgagccgggccggaagcggttcccagccggtacccgtagggccaggcgtgcagcgtgcggtgacagtggcgcgggcggcggcgctgcgtggctctggaggaccggcgcggacctgcagcggctcgctgaggccgtggctcgtcgctgcagctgtcaggactcttgggggcgaacttgccagacagagaggagcggaagggaaggggtgtatgcatgggcatggaggctatgactctgattttagtgacgatgagcaaggcggaggctccagcaaaaagaggaagaagacagtcgaagatgagttgctgcttacaaaaccgtttcaaaaagaaaggcatggaaaggtggcccataaacaagtcgctgcagacttgctcgacagggaagaagcaagaaatagaaggtttcatctcatagctatggatgcttatcaaaggcacaccaagtttgtaaacgactatattttgtactatggtggcaaaagagaggactttaagcggttgggggagaatgataagacagatctggatgttatacgagaaaatcatagattcctttggaatgaggaggatgaagcagatatgacttgggagaagagacttgcaaagaaatactatgataaattattcaaggaatactgcatagctgatctcagtagatacaaagaaaataagtttggatttaggtggcgaatagaaaaagaagtaatttcaggaaaaggccagtttttttgtggaaataaatgttgtaatgaaaaagaaggcctgaggagctgggaagtcaacttcggttacactgagcacggtgaaaagagaaacgcacttgttaaattaagtaagacgtgttcagtggatttcttccaaatttaccttgaatttagaactgaaaaaaatgtatgtactatttaattttaaaagatttggtatattttcctgaaagtatactttttccctgtagtttccccaaacctcaaataaaatttgaatcta

SEQ ID NO: 483 - protein, 355 aa, Mus musculus
KRWPKGKMRDQSREPLLPLPGLFFRLLCLPPSHSGCSTESARWRTVSYRCDTPLSRAGSGSQPVPVGPGVQRAVTVARAAALRGSGGPARTCSGSLRPWLVAAAVRTLGGELARQRGAEGKGCMHGHGGYDSDFSDDEQGGGSSKKRKKTVEDELLLTKPFQKERHGKVAHKQVAADLLDREEARNRRFHLIAMDAYQRHTKFVNDYILYYGGKREDFKRLGENDKTDLDVIRENHRFLWNEEDEADMTWEKRLAKKYYDKLFKEYCIADLSRYKENKFGFRWRIEKEVISGKGQFFCGNKCCNEKEGLRSWEVNFGYTEHGEKRNALVKLSKTCSVDFFQIYLEFRTEKNVCTI

SEQ ID NO: 484 - DNA, 196686 bp, Homo sapiens
  misc_feature (1)...(196686): n = A,T,C or G
ccaataggtccctgtcaccatgaggtatgtgtaagaatgaagagcacggactctggaaaaagactgcctgcattcagatcctggctttacttaccgtgagaacctaggcaaggtgcttagccaaaccaggcctcagctttttcgtctgtagaatggggatcctaccatagcagggacttcacagggtagggtggtggaaggtttcaatgagaaaaaatgcttaggatagtgtttggcacgtagtgagtactcagtagatgttactgagcaaataaggctctctgagctggtaactgcctgcctgcctaggctcagtgcttgactgttttatgtcatacatgatgttccaccagtgtggaatgtcttggggttccaaatgttcaccatatgtatttaactctatttcagatcatacagtcaggcacacacacatacacacatatcaatccaaccattaagattcagtccagttttcagctgtcacctcctccagggagcctaccatgcttgccctcccctgccctacagatacctatctcttcagtttatctctttctatcattgccctcaccacatgatgctacaattatctgtgagcttcttgcagagcagaaatgtgtcctattcatttttgtagttagcattgtgcctggcaccaagtagcgtttaataagtattagctgaataaggtgcatatgtgcgtgaatgaatgagggctcttccagaagaacagctgggagccatttgtctatcagacattttgatgaagaattattgtttctgtaaaggtgagcacaaggcttaaaattattccacttttgcctgttctattttttctaggttgattttagaaaatatattaatatcttcttagagaagtcagattaattcctatcttatatttagctcccccagttgccttgaatgatgacaatatgatggtgccaaatgttataaaataatttatctcctcctgccctctacgtggactcagttgctgccaagcactttcttaaaggaatgaaattcaaatatactatatattaagttatttaaagatagtgtcttccactgtgagaagccctgtaattaagccaccaaaaatagtattttagctctaaaaagcactttggttatcaactgaaacaatggacccttctgtgcatgccaatttgaaaaatgctgttaggtaatacctaagattctgtaaaactggaattggaataagatgttacgaatctatcttcatttctcttccactaaatcctctttgctaccccagcactttgctcttcacatctagattttttgctgagtctcccttctcttcctctcacattcctctttctccatctcttttgtctcactgttccagggcaagtgtaaggccactcacctagattaatgcttgagtttacttgagacaggtaagaaacaatgaaacagaaatatgagatctcagctgaggtgaagctgggaagggagtttgactcggaagacactaggtttgaatcctggctcaagttttttgtcacttctgtgcctccattttgttagggcagtacaggtatttcttcttaacttaagatgggccattgcttttctcatgttcctaggagccaccttagtagtgcgtttgcaccatctctgggggccttgcggcatatgaaatcagcatcttgggggagcgcacccatactggtcaactctcttttatccaaatttgtgttctgcactgcccttcgacacagcacacttagaatccagccccatgtgaactcttccagcttctgccagtccaattggttgtgtcctgcagtttgttcaaggggtgtcccctttctgtcttcagcaggcaggcctagcacatcccaggcagcaatatgttgttaggacttaaccgtagatattggtaacggccggggtgggaggccttcgcagatcctgagaaaagaacaaggtgtcttgcaggggggaggccttcacatcatctccaagcaaggtggagtggtgcttgtctttaatctgagctcccccaggctcagagggctcagagaaatttggggatttaagattctcaaggacatcaaccagatatccccatcctatgtatcagggtcccagtccttccccaagcagagccttgatcttatcagagtcaacttgtctcggttgggggttcaatcttccttggagcttgtcgtcttttgtgactaagttctggtgctgggcctgagctttcccagttctcctgctgcaggagaggccacctggctttcattcatagctatttattgctgattaatcactctcaaccttttgttacttttccagagtgtcaactgagtttggcaatggctccctaaatccaaatccttagttactgttttccctgcatatttcaactgcttgacatttcacgcagctaatgcgttcccttccattggtgacacattttactattgtactgtgccagggataatcattgatgagattatcaggggtcttcattcccatctgggtggtggaagatcaagctcaaaatcccatcttaggatctgctttcttgaaccactcctggcacccaactctgacaggttgcattccccagggaaaatttctgaaatgatatcagtatacaggtatttcttaagaagtattcatgagatcaacaccacagatgcagggagaaggaagctgggtccatcactggatcctgctgactccatggggaacccagacgctggaatggccctgtagattgtcaccacttggggcaaggggaccaggccttcatatccctgcgctgatcagtcattgggaggtaggctgcttctggaaggaaacatgatcttgggtagggcaattttcttcagcgcaggcaatccctgaagagggctaacagctgagggaggttttctggcagctctcccagcagctgggggtattttatccttcattcctggagggaaatctgggtggtgtattgtagcaacagccacattcccacattccattaaagccagtcccatggccatgtctgccacaaatggggtagaggacaacatgctttgcatagaaaagcactgcaagtcacacagcacaggtgcaggtatgtgatactctcctagagatggcgggagcaagctatgtgggaaaccagaagacaatggaacaatgctttcaaatattgggaggaaatgcttttgaacttggaatcctgtgccagccatactgccaatgaaataggagagtagaataaagctgttcaaacagggaaggtctatgcttcagcaatacaagaaagtaaaccaagaaagaggaagacacggaatccaaaataagagagatgcaaagagaggtggagaaaggcagctcagggatagcagctatgcttagctcccgagcaaaaccctccagatcagagccatttggaagaccccaagcgagggttcaagatgaaattgatacaattccaatatgtttgaacatgttggaaatttacacaatttgggaagagtttaaagtacaaaaaaacaacaaggggctaggggcagtggtatacgcctgtaatcccagaactttgggaggctgaggtgtgcagattgcttgagcccaggagtttgagaccagcctgggcaacatggcaaaaccccaactctacaaaaaatacaaaatgtagacaggtgtggtggtgtgtgcctgtagtcccagctatttgggaggctgaaatgggaagatcacctgagccaggggaggttgaggctgcagtgagctgagatcgcaccactacacaccagcctgggtgacagagaccctgtctcagaaaacaaacaaacaaacaaacaaacaaacactaaaaaccaccaccaacaaggtattaactccaaaagaaagaaaagaacaagttgaaacaagatcaaaatgtatgaagcacattgcagtatacttcatggcttgtgaacagtgtttatacaatcacaataatgtatctatgcaaatttatggtacagctatcctgggggcgatgggatacagaaagtgtacacatatgtgtttggatttgaggaggggcaaaagacagctaagtcctcattttccttgttaggaaacagatgatgcctgatgctggaaagtgaaaaatagaagaaagcatgttacttggagatatggatataaacaccaaaataatcagatgaaagagctgaaagttggggcctctggaaatggaaatgctgtcaggaaatgctagaggtaaggagaggtgaactgctaattttataataagcctggtagagtttacttatttattttgagacagggtcccactgtctcccagactggagtgcagtggcaaaattatagctcactgctcccaggcctaggtgatcctcccactgcagcctcccaagtagctgggactacaggcacacgccaccacgcccagctaatttttgatttttagtagagatggggtcttgccatgttgcccaggctggtttcaaactcctgggctcaagcaaccctcccaccccagcctcccaaaattctgggattacagtcgcgagccactgcaccagcctctgataggatttcttgaatctttaaaataaatacaggtatgaattttgtgaaagaacaacaaacatatcagaagaaataattccaagttcacaagcttttccaaagaattaaaaaagaggcaacagcacaccccaccccattttatgatgctagcatgacctccacaccaaagctgaccaggacaaaatgaggacgggcaattgcaagtcagtcttattcataaatatacatgcaaaagtcataaatagtatataaacatatttgcaatctaaatttagcaataggaaagtataagatatgacaaccaagttgagtttatctcaggaatgcaaagttagtttaatattagaaaataaatgtaattggcagggcgtggtggttcacacctgtaatcccagcactttgggaggccgagatgggtggatcacttgaggtcaggagtttgagaccagcctggccaacatagtgaaaccctgtctctactaaaaatacaaaattaactgggtgttggtgtgcacctgtaatcccaggtacttgggaggctgaggcaggataattgcttgaacccaggaaggggaggttgcagtgagctgagatcatggcactgcactccaacctgggcaatagagcgagattctgtctcaaaataaaataaaataaatgtaattcaccacattaaacataaaattcatatgatcatttcactaaagtgaaaccatctgataaaatccgactttatgtcttataaaaagccttaaaactgggcatttaaaagtagctaagcacttgcctgcagtctcagctacttaggaggtggaggcgagaggattgcttgaggccaggggttcaaggctgtagtgcactatgattgtgcctgtgaataatcactgcattccagccagaaggacataacaagactccatctcaaaaaaaaaaaaaaaccaaaaaaaaaaccctcaaagttttagcaacctaggaataaagagaactcctttaatcttaaaagggctaattatgagaaacctacagcaaacatcatactttatggtgaagtatggaaatctttccctttgaaatacagaaaaagataaggatgtctgttattaccacccctagtcaatattataatgaaaggtctaatcaacatagaaataaaagggaaaataaagtaagcacaaagattgaaaaggaagaaacaccccaggcgttatttgcagattctataattgtaatggtagaaaatccatgagaatttactgctgattacactctcaccagcggtgtatgagacttcccgttgttccacattcttgtcaagcttggcaatgttagatttttacatattttcccatctggtgagtatataataataactcattggagttttaatttgcacttttctaattaccaatgaggttgagtaccttttcatatttacatttcctaatttatgaagtgcctattcaaatcttttacctatttttccattgagttctatgtgtttgtcttactaatttgctggagctgtttatgtactctgaatactagtcttttgtaggttgtgattttaatataattgaatttatcaatatttcctttatgatttgtacattttttcatattaagaaatcctttcctatcctggggtcatatagatattcttctatggctttttttgttgtttgatttttttctttacttatttgttttagagaggaggtcttgccatgttgtctaggctggatttgtatttctggcctcaagtgatcctcttgcctcagcttcccaagtagctgggactacaggtgtgagctgctgccaccacctggttagatttttttttttttttagagacagggtctcactctgttacccaggttggagtatagtggcacaatcatggctcactgccaccaggacttcccaggctcaagtggttgtcccacctcagcctttcaagtagctgggaccacaggtgcatgccaccacactcgattaatttaaaaaattttttttagaggcagggtctcactatgttgcccaggctggtctcagactcacctcagcctccccaaagtgttgagattacaggtatgaaccactgtgtctgggctgaaacatgttttatcttgcttatttagatttatactccacctgtaattgattatgtattatgtaaggttggaagtcatttgtctttttctcccacatgaataggtaaaaggcaaattaaaactccagtgagatgctattatatgctcaccagaagggcaaatgtaaaaaatctaacattggttaagtatgacaaaaatttagaacaacaggaagtctcatacactgctggcaagagtaccattgtggaatataatttggaattaccttgtaaaggtgaagaaatgcatacattctctggcccagcaagcaattccacccatagattagactctaaatagactcatgcacatttgtgccagaacagtcttggactgttcagaacagcactgtttgtaatagccccattccctgaactgtccaaatgtctggcagtagtagaatgaattaaccaaatctggaggccaggcgcagtggctcatgcctgtaatcccagcactttgggaggctgaggcaggcggatcacgaggtaaagagttcgagaacatcctggccaacatggtgacaccccatctctactaaagatacaaaaattagccgggcgtggtggtgtgcacctgtaatcccagctactcaggaggctgaggcaggagaattgcttgaacccgggaggcagaggttgtagtgaaacgagatcgcaccactgcactccagcctgggctacagagcaagactctgtctcaaaataaataaataaataaaatgtcagaaactcatacaatgaaatgccatatagcaataagagtgaaggaagtagagctacatgaatgaatttcacaatataatactgagaaaaaagaagtcaaacacgaaagaatccattctgtatgagtccatttctataaagtcataatacagcaaagaattcacaaagtatgaacacatgtatgtgtgtacctatatatatgaatatatgtgttgtatgtaaagttcataacatacaaaagaatttatatcaccaaacaaaggtcatgagcaagcaaacctaaactgttttgttgttgttgttttcggtaaaaactacaaagaaaagcaaggaaatcattaccataaaaatcaggagagtgggccaggcatggtggctcatgcctgtaatcccagcactttgggaggccgaggtggatggatcacctgaggtcaggagtttgagaccagcctggccaacacggtgaaaccctgtctctactaaaaatacaaaattagccgggtgtggtagtgcacgcctgtaatcccagctacctgggaggctgaggcaggagaattgcttgaacccgggaggtggaggtggcagtgagccgatcaccccacttcaatccagcctgggcaacaagagtgaaactccatctaaaaaaagaaaaaaaaatcaggagagtggttacctctgggagaaggaggtggatatgatatatggggtattccaggggcttctggaggactggcaatgttctgtcttgacctggatgcttgttaaactgtcacatttatgtagtatgcatttttctgtaaatatatttcacagtaaaaatggcaaatagaaagcagccagataaaataaaagtaataatctctatattccactaaaactgccaacatgtccactaaatacaataatgaacacagcactgggtaattggttctttgctttaagccttggagaaactcgtggagacagaagaattcttgtaggttaagtcatgcttattcaatgtacttgaaatgtttatttacaggtgggtctgcttgatgtgtgttctaaagcaaaaagaagcccaatgtttcttcatcccaagttttagccttttcttctgaaatataacgagatcctgatttaaagtcagcctgcattaacagaaacgctgtgagaccacaaataagcatgaacttcttacatgtgcaaattactgtgtgctttgtgccagctcctatgctatgacctttatcttataacagcctttatccccagttcatagatgaggaaactgaggaagagaggggttaagaaacttgctcgccagcacagtggctcaagccagtaaagctcaagccagtaaagctcaagccacggaggccgaggcgggcggatcacaaggtcaagagatcgagaccatcctcgccagcatggtgaaaccccgtctctactaaaaatacaaaaaaaaaaaaaaaaaaaaaaattagctgggtgtggtggcgcacgcctgtagtcccagctactcgggagactgaggcaggagaatcgcttgaacccgggaggcagaggttgcagtgagccaagatcgctacactgcactccagcctggtgacagagcgagactccgtcaaaaaaaaaagaaaagaaaagaaaagaaaagaaacttgctaagatgacgtagctcagggtggtgaggcagagtctcacactcagatctggctgactaaccccaggccgcctcttgtgatctcagccaagctgcactgtcttcatgcaccctctgggacagaaagacaccatgggcagctgtaggtccagaaacagtggggagtcacttctccattttcactgaaggcaattggcagcatttgaagagccgggaaaacttaggcgcccagctctcacctctgaaggggttttgaagaaattctatgttcagtcctttatatatatatatatatatatatatatatatatatatatatatatatatatgtatataattatttatacatatatgtaattatttatatatcccatgcctggatcgcgtttacttgaaataaacgctgtcattcgtttgccgtccagtaagaggcaccctttagctgctttaaaaaagctgaacatagggttactgagtgggtgtgttcaatggcgtgagaagtaacagcgaaaagtcaaaagcaaataatgactaaagttttaaaactccttgaaactcagaaaagaatgaaagcagtgacggaaaaatcaattaattcagtttcacgaaccattgctaaaaggcagcaacattttagtggtttcctgacctacccgtatttcttagctccaaattcatgttggtttcatttgtcgcacggaattatttttagtttagggtttgtccttttcacttccacatttcccgaattcataagtctgtgcctgcggcactgcgtagacgcggggagttcggtatcagtttacacgttgccttcagtaaaatccgccagaggtccacccattttgccttttccccttccttgccctgggagaaatcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaagggtaagaaaaagttttcttctttttctgaagtcctgttttggaatgttagtttcttgagtcaccttcttgaaaagtctgcatttagacagctgatgaagccaagtctctccagcagcgtttgttacctgcgcaggacaggggagaggacccgtttctggggaaggcatttaattttctccagggcttgagactcatggaatgacctgatgttttagctctaagagtgtgatttctgtaagctcttggcagaaaacgtatttgcgaatccctaaatttcaggtatcaacaaacatctgtattggttcaaagtaagtttcagtagtcttagatgcattttttctctgcctgtgagaaatgggtaaaggaggaagaagagcaattaaattgttggagacaccattactccttgaaccagcctgacgctgctttgattgtcactgggtttctgggaggtgggatgggtgaagtttatagttttattgagttttcctgcccttttgtgcctttgtaattgtttttatatctagactgttggggagctttttttgtacattctgtagcttttaaattgctcattgaggaaagaactctggacagctagtttgcaatttggggatctagttctatcttgcctgctgaatgaccttgggcaagttacttcatttctctgggatctcaattttcttttctgcaaaacaggcgagaagggtttagacaagatcatctctaaaaacctcatggttggctgagcacagtggctcatcaaccctgagccaactttgggaggccaaggcaggaggattgcttgagcccaggagtttgaggctacagtgagccgtgatcacgccactgcactccagcctgggtgtaaaaataaataaaaataaaaggctcatggtaattttaaaaggctatttttctatgacacttgattgccattgcaggggaggggacaggaatgcttggtgtcatggtacaatttgatgtaagtgacttagttttggataaagtggggtttctaaatctcagtgtggaggctttatctattttgtttgtcattggtaagattgccaactcacttcttggcaagagggatgggaaagagagggaaaggcagagagagtgggagcatggatagacatgtgtttcctgaccatgccttgctacatttctcgtttcttccaggagcctgactgctactccctgtcagttcctgaggcatctatacctttcgcctttctgtttcccgtttttcccctttatttctcttcttaaacctctctctctgaggatgagcaagaaaatgaaagaaatgaaactcaaagctggctggctgggtgtggtgacttctgcctgtaatcccagaactttgggaggctgaggtgggtggatcacatgagggcaggagttcgagaccagccaggccaacatggcaaaaccccatctctactaaaaatacaaaaattagccgggcatggtggcacatgcctataatcccagctactcgggaggctgaggcaggaggattgcttcaacccaggaggaggaggttgcagtgagccgagatcatgctactgcactccaacctgggcaacagagtgagactccgtctcaaaaaaaaaaaaaaaaaaaaaaagctggcaaattgttggttggttaaaaaaaaaatctaaagggcaaaaattggatttaaaaaaaatttaaaaaaatttttttgaataagactgggtcttgctatgttgcccaggctggttataattcccttgctcaaactttcttcccatctcagcttcccaaagtgttgggattacaggcgtaaactaccacgcccagcttaaaattgggctcttaaaggacaatgaggtttgaaaatctggctagtgaatatcatggactcatgttatgtcagagtttatttacatgtgttaggttttattaattttttgttttcttgaagcagttacataatagagacataatatgaagattttacatccttcatcattgacatataaagacattaaaatatatttggatcagtccgatcatgtaattatttaagtattatagattatagaggaattggagttaacactatattgaaatctgacttgttatttgtctggagtttgtatgcattgatgaaacattttaaatgatgaaaaatatatctaagtcaatgaatgcaaaccatcaattgaaagtggaaaacttcagttaagttggcaaatatagtctatacaaacaattacacatttaactttagtctcttttctggcctccttttttcatacaaatcgagtggtaaagtcattcattcatttagctaacaagcaacctgacagaggaaagggcactcaactcagagtaggaacatctgcattccagctgacattaactcaatatctgatttaaccacctgggtctccaatttctcagctgtggcatgatgggaactggtctttagatgccttccgtcttttagattctaattttctagttccaggtattgagttatctgctctcagcaagatgtgaaatgcattgccttaggtgttggaggggatatagcaacaaacacagcactcttcttgctttcagtctatgtcagtggtttaaaatcctggtgatggcaaaccctttacaggtgtgttcccaattttgagcactgcgtaaaattaagtaacattaagttctgactgaactgaggatacttatagcaaaatactgtccatcagaaggaacatggaacaaaggcagacacacttcatagtgtggagtggggcagggtatggtaaactggaaaaagccctaccatgcctgtagtcccagctactcaggaggctgaggcaggagaatcacttgagcctgggaggcggaggttccagtgagcagagatcgcaccactgcactccagcctgggagatagaacgagactccatctcaaaaaaaaaaaaaggaaaaagccataccagaagatcaaggcggcatcaaagaaagtccctgtgttaacagaaatatgtaaacattttgcctcttgggtaaataaacaaagtcagggcagtaagcagctcttctcaaactataagacggtgaagaatggccaggggaagtgattgttaatggtgaagctcgcatagacactgtgaggccctattaggctatagctacactgtacttgggattgtgctgtactgacaaccaactggtttacagttgacctcagtttttcgtgttcaaaccctttctttctttctttcttttttttttttttttttgagactgtttcaccctgccatccaggagggaagagtgcagtcagtggtgtgatcatggtctcgaactcctgggctcaagcgatcctcccacctcagcctcctgagtagctgaactataggcacacaccaccatgcccagctaattttaattttttttgtagagacagggcctcactctgtttctcaagctggccttgaactcttgggctcaagcaatcctcctggcttggcctcccaaagtattgggattacaggtatgagcgcccagttgtgttcaaccgtgagtgacccttctgaggctgtcaaattactcagggcctggtaggaactaggaggatctgggggttgctgtagtcctggtgcatggttgttggtgatgttcagcagcgcaggtgtagattatgaaagccacaacgcttatgtaatttttcatatccttcgggtacaccaggttccatgagccagatccgaattgaggctggagtgagtgcctgtgagccaggggtggccattctgccctaagttccatgcggacagccaggctgtgaagctgaatctagctgagattagactacacagacctctgagaccaatttcaactctgagacttgatgattcttccaaacagtcctccaaacagaacaggttgttaaaaaactttttaattttaaataatataatatttttaatttctaaaattaaaaatgcatgtagacataagataaacaacccagaagggattatgcaactaaaaagtgaaaattctccccacacctcttctattctttctctctcccactgttagtccttcagggtcaccactctgaacaatttgatttgaatccttcttgatcttttgctctagacatataagttgtcccaactactgcctgttagcaacagtactgcagtgggtgtccctgtggtgcgtgtctttgtgaatatgcatatttcatttttatttatttatttattttttagatggagtctcgctctgtcacccaggctggagtgcaatggtatgatctcggctcactgcaacctccacctcctgggttcaagcgattctcctgcctcagcctcctaagtagctgggattacaggcgcccgccatcacgcccggctaatttttgtatttttagtagagacagggtttcaccatgttggtcaggctggtcttgaactcctggcctcatgatccgcctgccttggcctcccaaagtgctgggattacaggcgtgagccactgcgcccggccatgaatatgcacatttcaaaagcacagcttctatctttgtgtgtgtttgtgtgtgtttttcttttttctttttttacagagtttcgctcttgttgcccaggctggagtgcagtggcataatctcggttcactgcaacttccacctcccgggtttaagtgattctcctgcctcagtctcctgagtagctgggattacaggcatgcgccaccacacccggctaattttgtgttttttagtagagacagggtttcaccatgttggccaggctggtcttgaactcctgacctcaggtgatccacccgcctcggcctcccaaagtgctgagattacaggcatgagccactgcatctggccttttcttttcttttaaaggtgcttttgctggatcttgccataggcttccattttccctttgacctatcccttgcttctgtgtccaatctcttgaaaaggtgattgagcggaggttttcttgcatacttttatattattgtgcctttacaatgtggcaacattacattcacataaaacatccatctccttgggtacgtagttgttgctactatagcatttttctcattctctccttacaatatcccccattccatcagccagaattttctctcccttctggtcttgtgtaaatcttttccttgtggaatggctactgctactgtccagatggccaccagataattgtcatgttattacttattttttccagattcctgtcattttacttggacctgtttttggaatgtgagcctagatatttctagaatatcccccctctaattagcatatcaaactttgtagtcttgagcaaaccagttaacctctcagagagtccttttttcttttgaaaaatggggctgtaatggcttatctgaaagggagttaatctctagacatcccaaaggctgtgatgtatccaatagacacatgtgtatttttagtaaaaacctgctttgctatttgaaattataaagttgattttttttttcagtgggggacattaacaccaagaatatatcttttaaagcatttttaaaataagctccaaagctatgagattccacttaagaatggggaagtaacatcctggccaacatggtgaaaccccatctctactaaaaatagaaatattagctgggcgtggtggtgggcccctgtaatcccagctacttgggaggctgaggcaggagaatcgcttggacctgggaggcggaggttgcagtgagctgagatcgcgccactgcactccagcctggcaacaaagccagactccatctaaaaaaaaaaaaaaaaaaaaaaaaagaatggggaagtgatgtgagaaagagctcatggatagtattcactgtggtttgtccaggcacttggtgcgttccccacagagagccttggttcacccagtgagcaccataggactcatcaagaagatccctatcagctcaaactgataatcacactactcgggtattcccataaaaccactgtattgtattgacaaaacaatcaggaaggcaaaagtgtttaatctactgagtcattcccatccctttctggagaacaaggcttagagactcactgcctaaggaaagtggccccaccctatggaagcatgggaattctcaaaggtacactccccaaaggcacattctgcagggtctcagtcatctataaagctacaatggcccttaaaaaattaattaacgtgccttgtttttctttcctccttcacaacacatctcacctgcgtgccctcagcttaggggtgctggtatttgtctggtatgggttttcctttctaatcacgggtgtgtttctcctttactgtaggatttggccctgccaagaaggtgtgggattgttatatcctctgcaacacccagcacatcactgatgttgaatatacattttaaatattgagcatgtagcaaagaactggcaggaaatttcagacaccttaatgtgacaaagtccttgatgcttagtcctgaaagagaccctgggaagtcatccaattgccctttacgtttaatatcctctcaggtgtttgtgaatgaggcttagcaaagaaccatgtcaagtattcatgaaccctgagtacaaccagttcctagcacctgttctctgggggcaaattggtgtataagacattttgcattcttgttcctggcaaggaaaatatgaagctgccagttttatgttgaaccttcatacatgaaacgtagtatatagaatgccatgatatggcagtggtcagctgactcactgtgtaatttctattgaacagctgttctgttgcactggggtgtgctttgagcaggtctgagcacagttctcaatcagaaaaagttatgggacatttgataccttaagccttatcaattaacttcttactgggcatgagggtacaaaggccctgagctctggggccagggatgcctaaatgagaattccagtggccatccctagttgctcatgagcaaatacaatctgcagcttcaagcccggtcatgatggctcacgcctgtaatcccagtactttgggaggctgaggtggacagatcacctgaggtcaggagttcaagaccagcctggccagcatggtgaatccctgtctctactaaaaatacaaaaaacttagccaggcatggtggtgggcacctgtagtcccagctactcaggaggctgaggcaggagaattgcttgaactcgggaggtgaaggttgcagtgagctgagatggcgccattacactccagcctgggcaacaagagtgaaacttcatctcaaaaaaaaaaaaaaatcagcttcagtgttcttaataatgtctcctgccttgcagggctgtttgaggattaaattaatgtacatgtgacattgcacatggcagtctataaatctccttacctatttgataacagtttcatggagcactacagtgcaccagagagtatttctggaactaagtctagaaaaatatgcataagatggcttggattttcaggcctaggtgaccgactagttagcacacaagaatgagatgcaaaccagaatagacatgaaaagttacaatctgagtagatgaaagagtgaaaaagcttgtggagaaagtgtcatttggcttggttttaaaggatgagtggaaatttgacagaaataatggaaaaaagacattccaggctttggaacagtacaggaggaccagagagccatggggaggagtaatgtggtatgaatagggattgaactttactcatcaaccagtggggagccgctaggccgcaatgtgaacagcagattagtactagtcagggagactagtaagaaggcttactagttgagtcaaatgcttctcagcacagatggagctcatcccaggactggaatcagaaggaaggcactaataaggaaagacactgaggaaacaacctgattaaattaaagtgataaggaagccacactggacaggcaaatttggccatccttcctcacactgtactgtgaaatggaacatcagactgccttgcttccagctggagtgtgcaccctgtgggcgagtgcagggctggttggggtagctcagcaagaggccagcacgagggcagtagccacctgaggcggcagggaggccaccaagagatcgaagaaaaacagaaatacaaagtgatctttgaagacaaatgttgctgtcttcccaaagatcaaatgggggagcatttcctcaaccaagctgagccatggttcatttgcataaggtccttctctccctagcctgttgtactatctgaaaggatagggagtcatggttcagaattgcttcattacaaggagcagatacccacttcagcgtgctcaaggaaaccttgatttttctaaagctagaaagaaatctggagtccagatcacagacctcacaagagccagaatcatgtccgctcccctctcctcatttcccagggactgtgcagcctcctgcctctgcttctccctgcacatggcagccattacttttctgcatattgtctataattgttggctctctgcaaattggctgtccttagtgaggcctcttgcatgggctttgggttgctgcaaggtgactgggtcttgactctacatccaactgcagtggcagcgtctcgtgcatgagatagctcagagaaaaacaccaattgccttggttttggtcagatgttcagccctgctccaattaactgtggccaaggggcatggaaggccaagacaaagtgggtagaccagatgtgtctactcacagggcagccttctgggggcctagagtatgaactctgcagcctgtctccttccagggattagatctgttcttttccatctttactctgttggttgacataacctctcacttaaaagaacccccttctttctgtaaccaacacaatacttggaaagggatgacctttggattcgaaaaattaattttcactcctggttttatccctaggagctgggtgtctttgggcaactatatttccgagccttcatttcctcatctacagagtgtggagaataatctatacctcacagggaggttgttgggaacaattgtgataaaatatatagagaacttgtcgtagtgctgacacagaatgtagcatgacaggtgctcatgtcttctggcttttatgccccacttcttcccccattgctgcagggacatacagagtcctgggggacatttccaaggggtggcccaggcttagctgttcagaataaacaggatgctggtcagctgtggctgcacaaacagcttgaaggcattgccaaagtaggttctttgtttttaattgtggtaaaacacatataacgtaagatttaccatcttaactattttaagtgtacagttttgtttttgtttttgtttttgtttttgttttgagatggagtgttgctctgtcacccaagctggagtgcaatggcgccatcttggctcactgcaacctcctcctcctgggttcaagcgattctcctgcctcagcctcccaagtagctgggattacaggcacgtgccaccatgcctggctaatttttgtatttttagtagaggaggggtttcactatgttggccaggctgatcttgaactcctgacctcaagtgatctgcccacctcggcctcccaaagtgctgggattttatttctaatttcttgaggaaatggcctactgttctccatagatcctgcaccattttgcattcccaccagcactgcacaagtgttccaatttctccacagccttgacaacacttctttttttcttctttatttcataatagccatcttaatgggtgtgggcatagtaggttcttagcaactctctgacttggattttcagctcacacttgctgcattagctcagagtgagaattgctgcagtgcaggcctcgtcctcagtgatcagcaggaaggcagctctcctgtgatggaaagcccacctcgcaggagcccagcagcagcctgaaagagcctggtggcctcttggccagtggagcccagctctgaggtccatgtggccagagttgtgctgggaaccatagtagagccaaagacgtgtgggaaatagccttggtcctctgcaataccaggtcttccagttggccaccgtgccgagcctttttttttttttgagacagtgtttcactcttgtcacccaggctggagtgcaatggtgcaatcttggctcactgcaacctccacctcccaggttcaagcaattctcctgcctcagcctcctgagtagctaggattacaggagcatgccacaatgcccggctaatttttgtatttttagtagagaaggggttttgccatgttagccaggctggtctcgatctcctgacctcaggtgatccgcccaccttggcctcccaaagtgctgggattacaggcgtgaggcaccacgccccgccttcatttcgtttttaggaagtaggtattattgacatcttcattttccctatgagggagctgaggcagagacaggtcaggatttaactggattccagatggtccatgcgtcttcactgagctcagcatggatgaagaaacaactcacaacctctgactacacaaccaactcacataaacagttcctctctctctgaacagattgagttgtttagtggttggagtcattaggatccagtctgaaaaaggaagaaagtgtaccaagaacaaaagaacttaaaaaaaaagaaaaagaaaaaaaaacccatcccccctggggtgagtttgcaacagagcaatgaaagcctttatgacatgctgtgactcagaagctcagaggtgacatagcttagcagtgaatcagttccactgatagtcaagtttgagccattttattagtggagactagaaccataacttcttgtaatgtaaagtattaaaaatctaatatttgactggcagggcgaggtccacttcatttcacctccgtttgttagtttatgaccttcatcatctttttcatctcaatagtgcagcttataaattgaaaaaaaaaattccttgcccttctctctctttctttcaataaataaaatgttatgtttttgcttacccctcctaacagactgaattcattgctaggacactccctgtctctgtccctcctatgtttagcagctccttcctcattccaagcatgaatccattcaacaagcattgatccaagcattgattgagagggtactctgccaggcagtgtgcttagctctgtgtatagggtggggaacaaagcaagtttggccctgcccacatgcagcttatagtctaggctgtaaatggggccagcgttcagtgaattaagagtgtaggctgggtgtggtggctcacacctgtaatcccagcactttgggaggccgaggtgagcagatcatttgaggtcaggagttcgagaccagcctggccaacatgatgaaaccctgtctctgctaaaaatacaaaaattagccaggcatggtgttgggcacctgtagtcccaagctacttgggaggctgaggcaggagaatggctcgaacctgggagacagaggttgcagtgagccgagatcatgccactgcactccagcctgggtgacagagcgactctgtctcaaaaaacaaaaaacaaaaaaacaaaaacttctggaaaggagacattatcattattggcaattatattgatggtgatggtttactggctgttaagcactgtgctacatgcttcacatgtacttagttatttaattttaacatattcctttattttctttctttctttctttctttgtttctttctttttttttttttgagatggagtctcgctctgttgcccaggctggagtatagtcacgtgatctcagctcactgcaacctccacctcctggggtcaagcgattctcctacctcagcctcccaagtagctgggatttcaggtgcgcaccatcatgcttggctaatttttgtttttttagcagagactgggtttcaccatgttggccaggctggtctcgaactcctgacctcaggcgatctgcccgccttggcctcccaaagtgctgggattacaagcgtgagccactgcgcccggcctactcctttattttctcaccaaaaaagtaaaaataaaaataagaaagaagtcctcacttgagagctgaacaaactgagtctcgggtagagtgggtgaaatgcctcactcaaggtctcacagcagggtctaggtggagctggaacactaatgcttaccgccaaggctgtaccacctgtgctgtcccttatgcagccctgagtgcttggtcttggtcgcatccaaatctggcccatcctgtggtcaggcacgtgaactcagcccacattgctggcaatctgggctctgctgcttactcttggcagtaacttccctggacaaagccagccctgagggcatctggtcacaccatgctggggcctggggcattggtgcctttgagctggacatctctggtctcagaggccttgtctggggccccaaattccctcttgtttgccctagggtgttggacacattatgatggcttccatgtgtgaaattgccttgcagggtactgacagtgtagaaagctttttcatgggtgtaatctttttttttttttcttcagagatgcagtctagctctgtcgcccaggctggagttcagtggcatgatcttggctcactgcaacctctgcctcccaggctcaagtaattctcctgcctcagcctcccaagtagctgggactacaggagtgcaccaccatgcccggctaattttttgtgttgttaatagagacagggtttcaccaagttggccaggctggcctcgaactcctgacctcaagcgatccacccacctcggcctcccaaaatgctgggattatgggcgtgagccaccatacctggctcatgggtataatcttatctgttctccacaacaacacaagcaggtgctgaaggcagatattcataccgattgtgcagatgaagatatttagactcagatatcaagggaggccaaagctgtgtagccagaaagaggcagggaaggactagaagctgggttttgggatgcttggtcctttgctttttcccactccttcatatatggttggttttctttgtgcttggcgtcttctcattttaattccaccctctgtccttgtcccaggccccactgacaaacaacagctcacaaacactcctgactcccagctctccctctgatctgcagcaaacaaccagcccagcttgctaaagcgcccagaggtgaaagccatgcacagcataggaaggagggttgaggaaagtagattaaactgctggcagggcccaaaattccagtgaaagagatgactaatgatgagacaccagggtctgaagctgaggttaaattcaactggaaattcttggcctgggagggataggatctaattatcaagatttttcactccacgctttgcatttgttttcaaggttgttttaagtgactattttattttctcttgataccatctcttggagcgaggaagggcagaggactggatcctcccaaagcttgcctgaaggaagcagttgatagttctgattccaacacctggtaatgtcccctgtgtcttgggcatgggtatgctttctcatttgatccttgctgcaattctaccaggcgggcttttgtatcccctttttagaggacactcgggacttaagaggcactgtaggccctacctcctcagctgggtttgaaatgtatttgctgagtacttgagacttaattcattctctagcaaattatgtgaaatatactagtcagaagccagagaggttgagtggctccagagccagaagacctatattcaaattctggctttgtttcttactagcaggtaatcctggacaagctacttaactttcttgtgccttgaataaggatcataataataataggtaacatttacaaagcccttagaagagtgcctggcagatggtaaaccctatagttggtaggaattattcctgggcattagataccaatctttattaatgaagaagtctagatatgaagagctggagtaagtagaccaagttcacaccactggaaggtctgaaaaagtgacaggtcgcctggcaccctctgcctgcagtggcagttaagagcacaggtttgctgagaatgatggtttccagtttcatccatgtccctacaaaggacatgaactcatcattttttatggctgcatagtattccatggcatatatgtgccacattttcttaatccagtctatcgttgttggacatttgggttggttccaagtctttgccattgtgaatagtgccgcaataaatatacgtgtgcatgtgtctttatagcagcatgatttataatcctttgggtatatacccagtaatgggatggctgggtcaaatggtatttctagttctagatccctgaggaattgccatactgacttccacaatggttgaactagtttacagtcccaccaacagtgtaaaagtgttcctatttctccacatcctctccagcacctgttgtttcctgactttttaatcattctcagcaaactatcgcaaggacaaaaaaccaaacactgcatgttctcactcataggtgggaattgaacaatgagaacacatggacacaggaaggggaacatcacactctggcgactgttgtggggtcgggggaggggggagggatagcattaggagatatacctaatgttaaatgacgagttaatgggtgcagcacaccaacatggcacttgtatacatatgtaacaaacctgcatattgtgcacatgtaccctaaaacttaaagtataataataataaaatttaaaaaaaaagagcacaggtttggaaacaaggctgacttgggtctgaagctcagctctgccacttactggctctatgatctcgggcaagtcagttaacaaccctgatcctcagtttccttatctgtaaaatgagcatactcatatctcctatttttgttgttgttgtttgtttgcttgcttgtttgtttgagacagggtcttgctctgtcacccaggctggagtgcagtggcctgatcacggcccactgcagccttgatctctagggctcaagtgatcctcccacctcagcctcctaagtgagtaattgggaccacaggtgcaagccaccatgccaggctaatttttaaattttttgtagagatggagtctcattatgtttcccaggcaggtctcaaactcctggactcaagccatctcccacctctggcctcccaaagtgctgggattacaggtgtgagcactgcgcccagcctcccttgtagggaacagacgtgaatgtgtttaatatgcccagcacacaacacaaacaccaaggcagtcaagccaggtgcctggccctcctgggagcccttcccagcagccctggcagtgagcagagctgggacatgaccacgccccagcatcagcttttaggaagcagattctggctgagtcattcaaatggactggacttcactgcagctcccttggaaaatgtgggtttgattcaagagcctgtacatctgaaaggtcattcccagaggccagtggggcactgggtgtggagaggggagcagtcacccctcctgcctttttgctggggcatttctgtttatcagtgatatcagtgactgtttcagaaatgtcccaaacagcctcgctttgtatcctgttgccacttgcccaaaatgcctttctcctagaacctgtttggcagcatcttcctggaacgatagggcagccaaggttggaaagccaaagtcagagacactcctggagaggggtccacctgatgggccctgtgtccctgtgctcccccaggtgtctctcaagtccccagggtggaggcgtttctgccagcccttctcagaaacttctctgccccttgttgatagtagaaattagccagctcctggaggctgccaggctgcctgccagagaggagcagtcactgctcacatgccagctgccccagggaaactcagaagcctggaatggagccacgtggaagaaatattccaccagggcggtcccagcctcacagggcacttcctccagtcacaggggccctgccctccggagctccacagcctgggaactccctggggggatgcaaggaggctgccctggtgctgtaataagaaatcatctagctgtgtgcggtggctcacgcctgtaatcccagcactttgggaggcggaggtgggcggatcacctgacgtcaggagttcgagaccagcctggccaacatggtaaaaccccatctctactcaaaatacaaaaagtagatgggcatggtggcacatgcctacagtcccaactacttgggaggctgaggcaggtgaatggcttgaatccaggaggtggaggttgcagtgagccgagattgtgccactgcactccagtcatctcaaaaaaaaaaaaaaagaaaagaaaaaaaagaaagaaaaaagaaaagaaaaagaaagaaatcatctgatagctctcatttgtttagtgcttactgtgtgccaggccctgggctgggcactttgtattcattctttcatttaatcattaaagccgcctagtaatcacacttatatgaacttatgaagtccaatttactccgtcatggagaaattactatgtagtaagcgttgtggggggaataacaatattaataatacatagtctcagccttcaaggcatcaccctcttgtcttaatcctccaactttggaaactaattgctttttgtctctttcgaccggggtttgaatcccagctccatcacttactagctgtatgacctctaataagttgcttaacctctctgtgtcttggtttcttcctctgtaactgggaatgatcataatagaatttatctgttagagttgtgaagattaagtgagagaatccatgggaagtactgggaacagtgactcagttcagagcacttaataataagtgctagccatgtatgggtgtggttcaggggtgtgtgaaatgttaggcaaaatggcagatgaattcatatggggctttatatatctcaaaagaaaggaggcatgacccagagacctagaaaaggggaagaagtacttctgaatgggagatcaaatgtagactcttggctgaacctagagatcttgttgttctattttgtctaccgaagagctgagttacttagggagcttttgtagacagcaccctaacttttcctgaggccatttcagaaagacacagcaatctaaccgttcaggacttggggggcacatcataaaggttatgtaccataagtctgggggaaaacttagtgattatatatctcgtctgaatgcatcagtttatatatgagggactctgagcttgggggttcagccttatattttcctaagataacagctcaaaggaagagaagtcacagatatgaaagttcagtcagaggggctgggccgacatctgtgcttttccctgcaggatttttaggatcagtgagacggtgtgtatttggaagcatttcaaatgtgttaccatcgtgttacttccgtgggcacctggtgttattggttggactagtcaggattctccagagcagcagaagcaatgggatgtgtgtgcatgtgtttgtgcagagacagaaagagagattttaaggaactggcttatgcagttgtgggggctagcaagtctgaaatttgcagggcgggccagcaagctggaaattcatgtaagagttgatgttgcaatctctagtctgaattccacagcttagaaaactcaggcagggtttctatgttagagtctagaggcagaatttcttctccaggaaaccagtttttgcttttaagaccttcaactgtttggatgaggcccatctaaattatagagggtaattttgctttacttaaagtcaactgagtgtaaatgtttatcacatctacaaaatacctcgacagcaacatctggacttatgtttgaccaaacaattagacaccaccatagcctagccaacttgacattaaaatgaaccagcgcagctgaccaccggcacagatgtagcaagccagtctcaggagtcctgatgtctttcaggccttttttttttttttttttttttgagacagggtcttgctctaacacccaggatgaagtgcaggggtgtggccactgcagccttgacctcccaagctcaagcaatcctcccacctcagcctcctgagtagctgggactattggtgcatgccagtatgcctggttaatttttaaatattttgtagagatgggccgggtgtggtgcctcacgcctgtaattgcagcactttgggaggccgagacgggtggatcatttgaggtcaggagtttgagaccagcctgaccaaaatggtgaaacccccatctctactaaaatacaaaaattagccgggcatggtggtgggcacctgtaatctcagctactcggcaggctgaggcaggagaatcacttgaacacaggaggcggatgttgcaatgagccaagattgcaccactgcactagatcctgggcgacagagtgagactccctctcaaaaaaaaaaaaaaaaaaaaaaatttgtagagacgaagtctcactatgttgcccaggctggtcttgaactcctggactcaagcgatcctctggccttggccttccaaaatgttgggattacaggtatgagcaccgcactgggccaggccttttcaataaggttctgacacactggctggtaggtgaacagcaaaggaaatggttccgcgcaagagggcgggtggtttggctaagagagctgttcagttctcccggaaaccttgtttggaggctggcattggggttaattactgcagtggtgacctccgcagaactgagtgagaggcaggcgtagctaatcggaaaacaggaaatgtcctgaagaacgacttgagcccttgagcacactcagagtgtgctctgcatttgagtcagttgttatgttctgagctgaaaatattttattgctttccataggaagaaacagtcatcttaataaaattagacgcaggagccaggttggggggtaggtaatgtggagaaaggggagggagtttcctgtaattcaatttgatgttcagtgcctgcaggtttaaccttttttttttatttttacagaggtagaataaaataattgactaatataaatatgtgactggctgctgataagaaaaataatttatctactttttttttttttgcctgatgtgtttatgtgtgagaataggttttcaataaaatgtaacatatacacattttgataaacatcagagcctccttcttgaaagagattgagctgggtttctccagaagggtaggagccaatgccagccacttagtttttccttattagctagggaaatgggaggtgcagtggttaaatgcatgggctcaggagtcatactagacctggttagagggcttcgtcctagccctgtgatcttgagcaagttacctaaccattctgggctctctttgcttctctgcaaactgaggataataaaacagtgcctacgtcataggcttgccaggaggattcaatgaaatgatgcatgtaaagggcttagcaggccgggcacggtgtctcacgcctgtaatcccagcactttgggaggccgaggtgagcggatcacttgaggtcaggagttcgagactagcctggccaacatggggaaaccctgtctttactaaaaatataaaaattagctgggtgtggtggcacacacctgtaatcctagctactcaggaggctgaggcaggagagagattgtagtgagcaaagagcgtgccattgcactccagcctgggcaacagagtgagactctaactcaaaaaaaaaaaaaaggtggggggcttagcaatgcccagcctgcagtgagcatcccctagaggtaatgccattagcatcaacctcacacaatgagtgccaggagctgcaggaagttctggttgaatagctccacctggtctgtggtcaactggcatctgcctggactcagccactcccctttgttttcaacacacaattgaatcatgtgttcaggaacatgcattgggagaattgttgggccacttggtttttctcatgagttataaaattttgaagttataaaatccagtttctaataccctcctcctttaagtacttatatcagccaaatgaagcttagcctggtacttgaggcttcacagtgagaccataaccttcccacaaagcccgtttgccccctacccagttctatgctctttggttccagctggttgggtcctggagtgtccccagatgtgacataactggttctccctcctccatgcctgatccacccaccctattgtgtctactggagtgagctcgtcttctggctccacattttcaacccctccttgccgttgaattctcatctagctcagcctctgcatcttctgtgcacacagcctgaagtcacctttctttcctctgaatttttctgtgcattgatacccctctgatagcaactgaagtcctttctctatcagtcccgtatagccacatttcctctccccactagaccccctgagggcaggaaccatgtcttgggtatttttgtgtctcctacagtgctcaatgcctggcaatttcacaaacatttgttgggtggaagaatgaaggagctgattaatgtttgcggaagaactcactcagtgaaccatttctgtgggctgagctgtgaggtctcttggcctgagctgaccagtcattatttctgtttattccccctctgacaggcaggaagaaacttcaggatgagaatgagacaggcaagagcctggtggagctttgtgctatttcttttcttttcttagatggagttttgctcttgttgccaggctggagtgcaatggcgcgatctaggctcactgcaacttccgcctcccaggttcaagcgattctcctgcctcagccacccgagtatcggggattacaggtgcccaccaccatgcatggctaaattttgtatttttagtagagatgggtttcaccaagttggccaggctggtctcaaacttctgacctcaggtgatccgcctgcctcagcctcccacagtgctgggattacaggtgtcagccaccgcacctggcctgtggcactttttttttctttttctttctttctttttttttttttttggagatggggtcttgctctgttgcccaggctggagtgcagtggcttgatctcggctcactgcaacttccgcctcctgggttcaagcaattctcctgcctcagcctctcgagtggctgggactgcaggcgtccaccaccatgcccggctaatattttttgtattttagtagagacggggtttcaccatgttgtccaggctggtctcgaactcctgagctcaggcaatccacccgccttggcctcccaaagtgctaggattacaggcgtgagccgccatgtccagccagcctgtggaactttttaagactaagaattatcttacactcttctgtttcctgttactggcacacagtggatgcttaataaatgtttgtgaatgaatgaatgaacaaatgaatcttttcacactccccagctgctgactctggaacaatcctgtgcctcctgagggcagagaggatccatggtcccaggcttggcctcaaggtagcttgcagcgtgtcttccgtgttctctgtttcctgggtcaggaaccaggcttgggacttgtttcatgttgacaagcgctggttttttctgtgacctccctggagcccttgtccctgccttggctccctggttggagtcttggggacttggagactggaattttgcttcagtgccatctttcagtgatgcaaatcctaccccaagcctgggtgctcagtttctattgcattattttctgccttctccttgctttcccttcttgctgggacttcttggaatctcctatcttctctcttgaaggaccgccatggtctcagggtccagatccactcctttgagactcagttctccacccccccaagccccggttatgggagcagggtagtggtaaggtagagggagattggtggtactatttcatgcttgttgaatgctgggattcctaacctttttcaagcacatttgagaatctgatgagaacaatgagctctttcctccaagaaaactcacagatgcaatattttgtgtattagagcaaataatcttggagagtttcaggataccctggaacgcaaccataaacttccttatggacattttccaagacgccaagcccatcacatgtgttacatttatgaatcttcattatccagcatttctgacagcttccaataaggcactgtggcatggtggcaaacacacacaaacacagattttggagccagagggatgtagttcaaaatctggctgtttccttattagctgtgtgattgaaggcaggttaactactctccattttcttggcttagaaatgggaatgaccatgtttacctggaagaattgtctcaatggttagagacactgtggtagaatgcacagcctggcacctagagatgattctgtagagggagcagctacaattacacatagaaaccattttgtccagttctatttaagttaaaaattctttgcatgtctcctgtttctctcaagagcactttcttatactgtaaccagagaggaggattgggagtttctgttagatgaggagagggaagggtggggtcaaaatggaagtgtgggaggggaagtttccggacagcgtctaggggacctcagagtcagatgcagtgaggggctctgtaggccacatagagagagcacaggcagaaccagccaggataggtctgggcacaagccgacgaggagcgtcacgctgaagcttaggaagggaagccattgggctgtgtgttgccctctcaagtggaaaagttaatgcttagcagagtgaggtccatgactcacggccttgctatgctgaggtcttggaagaatgaggtggttagtcccacaggcagctgtgtgctgggagccaaagcaatgtgacattagctaaacaaaacccactacctcctacattccacagcagcagaggagaagcaaaggctgaggagtgattcaaagtgtggccactaatgtgagactgcctgggtctcaaatcctagcaagaccatttattaactgggtgacttatttgttttttgttttgagactgagtctcgctctatcctttaggctggagtgcagtgacacgatctcggcttactgcaacctctgcctcctgggttcaagtgattctcctgcctcagcctcccgagtagctgggataataggcacccatcaccatgcctggctaatttttgtatttttagtagaagtggggtttcaccatgttggccaggctggtctcctgacctcaagtgatctgcccgccttggcctcccaaagtgctgggattacaggtgtcagccaccgcacccagccaactgggtgactttgaatgttactcagcttctcagtttccttagctgtgaaagggggatgaaaatagtaatatatacctcctagggtttgttttttgtttttggacagggtcttgctttgtttcccaggctggagtgcagtggtgtgatcttggctcactgcagccttgacctcctgggctcaagggatcctcccacctcagcctcctgagtagctggaacctataggtgtgtgccaccacacagagctaattgttgtatttttgtagagatggggtttcattatgttgcctacgctggtcttgaactcctaggctcaaacaatcctcccaccttggcctccataagtgctgggattacaggcgtgcaccacctcacctggcttctcctaggtttttaagattagatgaatgccgggcgcagtggctcatacctgtaatcccagcactttgggaggctgaggcaggtggatcacttgagctcaggggtttgagaccagcctgggcaacatggcaaaaccccatctctagtgaaaaaaaaaaaaacatagaaaaattagctgggtgtggtggtgtgcacctgtggtcccaactacatggggcgccgaggtgggaggatctcttgagctgggaggcagaggttgcagtgagccgaaatagtgccactatactccagcctgggcgacctcgcgagaccctgtctcaaaaaaaaaaaaaaaattagatgagataatgctgacaaagcattttgtactcgaagattagcttttatttgggtaggtatttggggacttggggacccaagagaagcctctgctctttggactttgctacaaggaaactttaagcacttgctggatttgctcgtgtgctcatccaggtaggtgtactgtccaggctcagacacagagaagaaagatcttgtgtcttcagaaaaggtggcctcggagtaaaggaagccccaaattatccgctggtcttagaaagttttcatctactaatgaccttgtaccgaagcctatgggagggagtccagcttaatattgaagctgtgttggcatcttagcacactcagatgcagcatgagcttcagagctgaaattccaggtttaaatcagggcatcactgccaggtgtgagctcagataaatgtcttaactctttgagcctcaatatcctcatctataaaatagcaatatcagcatctcagaggttagctttgttggcttctttctgcagcaagccagagatgcagaggctctgggtagccttggtgagagaagggcagaacatcacatcccttaactccatgtagacctggagatgggaaaaccttgtagaccaaaaaatgccatttcatttggaaaactgtgattcaggtaaacacccatcctaagcgatgaatggggagatgtgggtgcaagtagacccttgggtaatgttcttagaataaatgaatggcccacgctctttaatttttttataaatgattgctgtctcttcctttatctcttttgcagatgagaaaaagaaaacaaagaaagttgataatgaattgaaccctgtctggaatgaggtgacttcattgtttcttcaactttgttttaatagataagctatttctgattgtcctatctttgggtgagaggttacctcttcccttcggaaggagaatctctacatttcacccccacccactccgtttccctttgtgttcaccaagagagcagagcagttcaaggagagtagctcaccagcgaccatcttctgtacagcagtggcgcggcaagggaagcctggactggcaggagagttgagttcttaccaggcaccgccacgagcttgctgtgtgagcttggtccacttatgttgcatatctggggcacatgtgcagagcaagggtgggattagatcatctccagagtctcagaaggaaggcctcataattaaaaacatgtctgcatgtgacaaatcaagagtgtatcacatgattctctgtgtgtctagctgggtaatgacatgtattggttttatgttgataaaagtgatgtccagtatgcttcatgtggaaacttttgaaaacttcaattaatctttaaaaaattaacttgggtcccactctctagaggcaactactattaacatctgtgatgtatcactaagtgtttattggaggaatatatttaatgaaatatgacatctgataacacaaactagcagcatatagcaaatgatttcctctcctacactttcttgctattatatcctaagcatatgcccatattaattcaaaattattttaataattcaaaagtattttaattcaaaagcataaaattattttaataattcaaaagcataaaattcaaaagtattttaatgactgtgcaatattctactgaagacatataacttatttacctccccccactgtcgaccttatatctattttagaagtggttcagtgtttaatattttcacaaataagtgaaaaaatttaattcttcccactgaataggattttcctactctctctctgtctctctcttttaaaccacccaattattcatgaaactttaactttttaacagttgatggccagctccattgtgtttttcaaaagctgggtcaaacctccctggacaagagcaataatgaatgtctttgttattttcaccaagtcactaggccatgaaggctcccctccacccacccacctttctctcccaactagtttcaatatctctataagataaagactagagccttctgggtttttttttatttgtttgtttgtttttgagatagggtctccctcaggttggagtgcggtggcgtgattaagattcaatactgccttgaattcctgggctcaggtgatcctcccacctcagcctcctgagtagctgggaccacaagcgtgcaccacacccaactaattgttttattttttgtagagatgggcttttgccgtgttgcccaggctggtcttcaactcctgagctcaagtgatccacctgcttcagactcccaaagtgctgggattacaggtgtgagccattgcgcctcgctagaccttattcttgaatgaagtgaaacaaaaaactttttaatgccttggggtttttttttgttctttttttgttttttgttttttgtttttgtttttgtttttttgagatggagtttcgctcttcttgcccaggctggagtgcaggttgctcaccgtaacctccgcctcctgggttcaagcaattctcctgcctcagcctcctgagtagctgggattacaggcatgtgccaccacacccagctaattttgtatttttagtagagatggggtttctctatgttgatcaggctggtctcgaactgtcgacctcaggtgatccacccagcacccaaagtcctgggattacacgcataagtcaccacggctggcctttttttttttttttttttttttattaaaaaaagacagggtctcgctctgtcacccaggctggaatgcagtggtgtaatcatatcttactacagcctcgatctcccagggccaagcgatagccctgctttagcctcctgaatagctgggactacaggtataagccaccatgcccagctaattttaaaaaacatttgtagagattacatcctgctatgttgcccaggctggtcttgagttcctggtctcaagccattttcccatcttggcctcccaaagtgctgagtttacaggcgtcagccactctgcccagcctttttaatgcctttctgaaacgcccagcaggtctcaggcaggttgagagggaattccacttatctgtaatttccccagaatccagaacacagccagctggactacaagctccatgagagcaagaggccccttgggttggtcattgtggattcctagcacctgacagaactccaagaataaagcaaataaaaaatacatttatgtgagagtgcttcctacttcagattttgaatcatcccaactcatctcttcaaatttgagattgagatcaagccacgtgaccaatggcagagagagatgtgctgtcatgcgagctggcatgtcctctgcagggaatcagccatcttattccattttgtttccaacatgttttttttttctttcctttcatattgcagatgtacttatcaagtaaactgttttataattgaaaccaaacacaaatgaaatgtcaaccccaaacccactgggattgctggtgctgggtgtgttcttttttttcttttttcttttaagatggagttttgctcttgttgcccaggctagagtgcaatggtgcgatctcggctcactgcaacttccgcctcctgggttcaagtgattctccttcctcagcctcccaggtagctgggattacaggcatatgccactacgcctggctaattttgtatttttagtagagatgggatttcaccatgttggtcaggctggtctcgaactcctgacctcaggtgatccatctgccttggcctcccaaagtgctgggattacaggcgtgagccactgcgcccggctcttttttttcttttttgagacagggtcttcctctgccacccaggccagagtgtaatggcacagtcataactaactgcagccataactaactgggctcaagcaatcctccccactcagcctcccaagcagctgggactacaggcacacaccactgcgctctgctgatttttaaatttttcacagagacagaatctaagttgtccaggctggtcttgaactccttgcctcagcctcccaaagtgctggagttacaggtatgagccaccattcccaggctgggtgtgttctaagagaagctctgaggccacgtgtggtggcacatgcctgtaatcccagcactttgggaggccaagacgggtagatcacatgaggtcaggagtttgagaccagcctggccaacatggtgaaaccctgtttctattaaaactacaaaaattggccaggtgcggtggctcacgcctataatcccagcactttgggaggtcaaggcgggtggatcatgaggtcaggagttcgagaccagcctggccaacatggtgaaaccctgtctctactaaaaatacacaaattagcagggcatggtggcaggcgcctgtaatcccagctattcgggaggctgagacaggagaattgcttgaacccgggaagtggaggttgctgtgagctgaaattgtgccactgcactctagcctgggcaacagggcaagactctgtctcaaaaaaaaaaattagccgggtatggtggtacacacctgtaatccccagctactgaggagactgagaacttgtttttttttagaagtgctaaaaataattttttaagaagttctgaaacaagttttccttccattccaagcccactacaaggaggatcaagtcatcatttaattattacctaatcagtcaaaggcatcagtgacgctttatcaatcttttttttttacttttgtcattaggaagcaacttactgcattaaaatgagagtctcagaaaggtcggtatattatagcattgaccgaccatggtggaacttaaaatgagaggcattttagaaaatgttttcttagattattcatcttctttgtttgatagtagtatgattaagaagagcagataatttaaaactagccattgaagaaaatgttttcacatataccctgcattttattcttttttaatttttttatttttgttattattatactttaagttctagggtacatgtgcacaaagtgcaggtttgttacatatgtatacatgtgccatgttggtgtgctgcacccattaactcatcatttacattaggtatatctcctaatgctatccctcccccctccccccaccccacaacaggccccagtgtgtgatgttccccatcctgtgtccaagtgttctcattgttcaattcccacttatgagtgagaacaacaccctgcattttattcttgcagcagttgtggtagtcgttgagtccagctcttgagtatgaagcaggggtgtggtcacctggttgaagccacagaacctagaaagcaggaagccaggagttgtctacaggtcctctaagtcgacatctggtttgctttcccgccccctcagctgccttcaggtttagaatttaatcatttctgcataacttcaaaagattgtcattggtgaaaataatgacccaacatgtagtactggtgcatcttagtgtaatctctgctccttctaacagcctttttttttctcttttttcaaaacctttctgtgaacagattttggagtttgacttgaggggtataccactggacttttcatcttcccttgggattattgtgaaagattttgagacaattggacaaaataagtaagttgttttcacctgtttttctcattttaggtattactatctcactgttgtttattttgttgaagagacacatctttaataacgtattataatacttccaatataaatgtgctttaattccatgccccgctcccttctaagccaatagcagatgtggctaatccatcacagcactttttcccaatgactgcttttattccaaaaaagctgcaaacactgagccacctagactagtttatcaaacttggcacttagagtgaagcctgttcacatgcctacaacttcttggtcaactgcacttcctacctctggcagtttatctgaactgtagtgatattggatacaacccaaatcacttctgattatttgtggcctatacatgtctcattcaagttttactttcagccccatttccatgttaatgtctccttcgccttttaatcccaacagacctaaacagaccttaatccttgccttactgcctctttcctttcacatggggaagggtcacggtggtgcccgtggtgacactgagggttgtcctctgagtaaaattgggagacttcccaaacaggttcccgtgggacagaatgaccttagtattaataaattcaccctagtcctggatctggactttggccttgtagacccagtcgtatgttaccaattcaaactaaccaagttcacaagagactaaaggtttttttcttttttttgactctgtcacccaggctggagtgcagtggcacaatcttggctcactgcaaccttcacctcccaggttcaagcaattctcctgcctcagcctcccaagtagctggaattacaggcgtgcaccaccacgcccagctaacttttatatttttagtaaagacagggtttcaccatgttggctaggctggtcttgaaccccttacctcaggtgatctacccgcttcagcctcccaaagggctggaactacaggtgtgagctaccgtgcccagctgatactaatacttaaaaccagaatacctgcttattttccttctggtggaagtcaattgcctagtgacagggcatttctaccctccaacccatgaattttccttcaagtcataccacatgggaagccaaattactttgtatactcgatttcaagatgttattgtttataaggtatactatcaaattaataaatggttaggggccaaaaaaagcgtgatatttaatgcccccatcaattgtaagaagcatttcagtttttagtaatgttagtacatttaaaaatgtatgtcttaggcacatctgatataatctgaaggctgcagtgagagcaaaaatttaggataaattagttgaggtaggtggtcacatgctctgattgcttgagacagtcctggtttgctgtcctagcacagtgattaataatgccccttttgcagtcaacgtggctgggtttggacagtaaattattattattttttgtttttgagatggagtctcactctgtcacccaggctggagtgcagtggcgcaatctcagcttaccgcaacctccgcctccttagttcaagtgattcttgtgcctcagcctcctgaacagctgggattgcaggcatgcacctctccacctggctaatttttgtgttttttgtttgtttgtttgttttttgagatggagtcttgctctgtcgcccaggctggagtgcagtagcacgatctcagctcactgcaacctcagactcctaggttcgagtgattctcctgtctcagcctcctgagtagctgggactacaggcgtgtgccaccatgcctggctaatttttgtacttttagtagagatggggttttaccatgttggtcaggctgttctcgaactcctgacctcatgatccgcctgcctcggcttcccaaagtgctgggattacaggtgtgagctactgcacccggcctatttttgtgttttttagtagagatgaggtttcaccatgttggccaggctggtctcgaactcttggcctcaactgatctgtccacctcagcctcccaaagtgctgggattacaggggtacagtaaattagatggtcactccagttattggggtcttctgcttaccggcatcagaataagagagtctgcacagacatggactccctggacagtgctttgataggcactcccatcttcgcctttgatgacatcctttttaccattctctgttgctgaccgatgccccctgcatatttttctgtaactatataaatacattctgggccaggtgtggtggctcatgcctgtaatcctagcactttgggaggctgaggtggaaggatcacttgagcccaggagttagaaaccagcctgggtaacatagtgagaccccatctctaaataaatgaatacatacctgcatacattctagcaggttctggtcccactctcttgcactggaaactattctagctttttaagtttctgtcgcatatctcagctgcgaactattatatgattatttattccccaccccaactcccaaaagccagttttatttcccatatttcaaagttttggggaaggggaggagaggggagggcctcacactagcctcctgcatgttactaagactaggccctcctcttctttgctttcttctttctgcaaatggtaccactgtttatattctagaccaggcctctccaacagaaatacagtgcagggtgcacatgcaatttaaaattttctagttgccagattaacacaaatatgaagaaatgggtgaaatcaattttaataatatatttaactcagcagattcaaaatgttatttcaacatgtaatcaatgtgtttgaatcactgtgatattctgcacacattctttctcttactcaggctttggaatctggtgtttgcttcacacttacagcacctctcaattcagagacttaccacatttcaagtgctctgtagccacatgtagctagtggccaccatattggacaggatggtttcagatcctgggcttaaaacttcagacctctctgcaccctatccctcttgctttttttttgagacagagtctcactctgtcacccaggctggagtgcagtggcgtgatcttggctcactgcaacctctgcctcccaggttcaagtgattctcctgcctcagcctcctgagtagctgggattacaggtgcacaccaccatgcccagctaatttttgtatttttagcagagacagggtttcactatgttggccaggctggtctcaaactcctgacctcaagtgatctgcccaccttggtctcccaaagtgctgggattacaggcgtgagccactgcacccagctccctcttgcctcttatccagtctgtcctcagatcttatgttttcttcctttccaaagtctgtgcttgtgcctgtgtttcttccccaagcccacagccaccagcctggttgaggccttcctcattttatgccttatctattttagcatggcaatgggctggcctcaaaactctcatctatggtttaaagtccttgctttcctgaaggttacgatacttaaggaaagttagaaaataaacaaatacactaaaaaatatatacataatatgtcgggtaccatgaatgctgtgagctaaagaagaaactgttatatcccatgaagaaaagcaaatcagaggaaaagggaaagttgtcaagggtggggggaaaggagatcccattttatgtgaggtggtgataaggtgacaattgagcagagacctaaatataatcacaaaagtaattgcaattttgcaccaacctaatataatgaagaactgagccatgcagttcattggggggttagggagtaggggggaagaatattctgggcagagaatagcaagtgcaaaggccctgaggcaggagtgcactggggatgctggagaaacgtgagaaaggcagccaacctggggcacagtgagggttgaaagtgcaggaaggaggtgaggtcagagaaaccacaatatatgtggctttgggggccaaggcatgggctttggatttcatcctaagtggaatgagaatccgttaaaagcttttgcttatgatctgacatattttaaaaggatcactcaggctttctgtgtagagactggaggtaggaaccagttaggaggcaggaaaacaatactgggagaccattatatatttattttagacccattgaaaacacagtggggccctcagatgacagcagtgatggggagaggtcagccccccaccgtcaggctcaccctggcactcatttcgggcatttttgtgcatttctagagatagagtttgttgtaaccaagtgagttatagagaaacgtcacactttgagactaattcaggagtcctttattagctggcgaacgagagacggctagcgctcaaaattctctcagccccgaggaaggggctagatttgttttataccgtggtctaaatagggaagggggagtttagctgaagcaatttttacagaagcataactggcaaaaagttaaaaaattaattggttacaaaagcagttacaaaaaataaccagttccaggtgtaggggcttaaactatcacaaagagataaatgcaggggctttaggtgccatccaccgagcacgtccccaggagctgctggtgcagcttgcctcaatgtcttatcggtaagtgcattcctggacatgctttgagtcagtttacaccagtcatgcccttaaggaagggaggtaaaggggctgtaagtgaaggaactaaaatggagtctgtctggctctttcagctaagagaaacaatcaggttaaaacaaggtagagtatcacaagttcacgtgcagtctatctgaacctgcacattttcatatttttctgaacctatgacatgcataattctgaacaaagaaaatatgataggtcctcttctaagagggtccttctaaggttcaggggcaccatgcatcgtgctgagctatgttgcacttggtgttatgatgcctattgagtataaagaccaaacgaggctgggtgtggtggctcatgcctgtgatgtcagcactttgggaggccgaggcaggcagatcacttgaggccaggagttcgagaatagcctggtcatcgtggtgaaaccctgtctctactaaaatacaaaaattagctgggcgtggttgtgcacacctgtaatcccagctcaggaggccaaggcacaagaatcactcgaacctgggaggcagaggttgcagtgaactgagatcacaccactgcgctccagccctggtgacggagtgagaaaaaaaaaaaaagaccaaatgagcacgtggttactctgatattatgatgacgggaattgttaggcataacagaaaaaggtaaattctaggccaattatgaagctggtcttggttactttttcaatcttcccccctcccatcttccatccccctgacatttgctgggcacccagtgtctttaagtttcctggctcccactgtggtacccgctgaggcctgccctctgagccacaccctgcatcttctgccaattcttttcctgtacaaaacttacctgtcctgtggctcagtccttcaaggtcctgcttcaaggcactttctgagaaattaatcgggtgatgctataatagctgctaatagttaatttcccggtaacactgacttttggactgaaggccatcagtgacttacttgaaggagtgaacaagatgagaacttcagaccctatggccaggtcattggaggaggtgttttcactaaaaattagaacattatctctcatcctgcagattccactgcatagtttactgtcttgcagtggaaggccgaccctgcgtcagctctgtaatgaacaaggcatgatttcctgcccctccaccgcctctgctcttttgtaagcagtgtgcctccccatcctcagctgggaatcatgatcattagcttagtttccaccaactaaccaatacacacaccttggtcagattacctgtacatttcagaaacaaactttttttttttaaccatctgggaataaactatatgtgttttcaaaatatttgtgtattttgggcccagattttctttttggcttttctactaaagttctggcctttgaggatctgcttactgctcagtgtgggaccgcttccctcacctgaagtgcagggttggggcggaagggttttctacagcttaaggaatgtcctgcctgttgactttcctgttgccatggcgatggcctgtgcaaacatgagccctcactttgcatctgctgctccccggcctattagcaaacagttcccagctgcctcggtcagctgggctccatgcccacacccgcatgggctagacccaggcagtcccaggctcacagctcctgtgggcagtgacacctccccacccctcaggcactgggagcgggttgccttgttcagtgtggactctcctcttcctcactttacagtcatccaaccagccattcagagggaatgagggtgagaaaggagacagaggagcctcttggtcacataaggaacatgaaatgttattttttagaggaaatgtcagagtggaaagattttcccagaggctgaagaatgaaagttccctttgcaggcagccaatggttatagctttgtgaggacttagcatgtgccaagggctgtgcccagccctttgcattcattaccccaattgatcctcacacacacctcatatgatgggtcctatttttcctcagagaggtttagtaacctgctcaaggtcacacagcaggtgtgtgttagagtcagctcatctatatccaggcctgtacacttgacttttatgttatactgaaagcctctgactacctatagtaaacaaaatgtaggtagaatgatcaattatctctgctgaaatagaagtgatttttcttcctaattttgacaaaaaaaaatttaattctcaatatcagtgtattgctaccttttataagctccaccctaggtaaaaattttaagcatttttatactgttgagtaggaagtcacttatgcctatattctgcaatggaccagatatatgaagagactatatctcatctcatttgctcttcacagtgaccttgagaagtagagagtagacttgagcctcagaggggtggaggctgggaccctgatctgttggcatcctggccctacccttgagttcctaaaagtgccatcttcaagaacctgtacatgtagaaataaaagatattgacaagttttcagatttgtgtgtctgtgtgtatgcacacgtggacacacatgcccaggagaaaaaagaggtactgcgtagagtttttgcatttgctgttccctttgcgtggaatgctccttccctcaaactgcaatagatgtaaaatcttgtcattgggcctcaccatgtctgatcatccagcctagagcagcccctccctgtcactctttatcttattactctgttttattcttccaaagcccttcttattagggagctcatgtgagtgtaagaatgggaaaaggagtctgtgtgagcaaatacatgctagaattgtgttttagacaagtactcagggtatgtgctggtccacacacctgctatatgtagctcagcattcaccaccatctgaaatgttcttttctatttacttattcatttgttctctctctactggatagtaaactccatgtcactcttgttcaatgccgtaagaccagcacttagcacagtgcctggcatatagtaggctctaaataaacgtttgttggatgaatgagtgaacaagtgagtttatgatgctcctacgtggatgacatttaccatttaagaagcaccttgcagctgtcctgtcagctcactggtaatgggccaccagtgtggaatctgtccacctcggctctctgaaacagcaccctagttccaacttgggtttaagctgcaaaggggtcaggatacaaaggtcagaacacaagagaaacaaacctctctcacaaagctcatgccattttgtagagagatgtggaactcaaggctgagctcacaggaaggcaggagagcatggtatttgaaagttgggattctggagccaggcagaagccgattagagacccagctctactgattactagtgggtgacctgggcaagttacttaccctctccaggcctcagaattctcatccttaaattgactgtagtttggaattgactgtagttccgttatgctaagggattagatttaccctcccacctgacacaactaaaacaaaatacatgcaacagtagttttcagatgttggactttgctggcacagaacagtgatctctaagagatgggagataaatgaggtgagccctgagagttcccagcttaatgcctggagagactcatttccatgctgcaatgcaagaaaagggatccttgttgtctcccagagttggagaggtgcaggtgggagtctagagatgccaaggttagtctaaagatgccaaggttactagtggaccaagaggagagaaacacagacacacacacacacacacacacacagagagagagagagagagagagaagaaagaagagagaagagagaggagagacagagagagcacttcagagacttgcagagaattccccttgaatcttcagctgagaactgagtgaggaaactgcttgaggcaggactagaaagagtttatgttcccgccaaccgggggaaacaccttgtaattcatagggaaggattttgcctccataatgtaggtagaaaacaatcaatagaaactgacccagaaatggcacacaatcagtagacatggacagtaaaacaagtattataattctttaaaaaaaattttttgtgagacagagtctcactctgttgcccatgctggagtgcagtggcactatctcagcttactgcaacctccgcctccgggttcaagtgattctcctacctcagcctctggagtagctggaattacaggcacacgccaccatgcccagctaatttatgtattttttttaccagagacggggtttcaccattttggccaggctggtctcgaactcctggcctcatgtgacccgcccccctcggcctcccaaagtactgggattacaggcataagccaccgtgccccgctgagtgttggaattctattctatagattcaagaaggtggagaattgcttgagcatgctagtagggacatggaagataatttaaaaaaattaacttggactgctagagatgacaattacaatgtctgaaataaagtgaccataattatctgtctcagaatttgcatgtctagtattctttctgccctccaaatacatgtacttgtgcatgcaaaaccaccattatatatacttccacaccaatgcagaacaaagttagaaacagtttctgaatataaatctcaagcaaggcatctgttttgccgtattgtaggaaggagataacaaaaaggcctgacaatatacctagaaggaaatgtattccagttcttgtgtaagaggtgtgggcatgtggccagctgtacaatcatgagattagacagaactttggttttgcttcttgttggttgggtgactcttggcaaatttcttaatctttataatggggactgtgatacttcctcaataaatagtagatatagggcaaatttgatataattaagaaaaaattacttcaatttcctgatgaacaacaaaatagctaattcttttcttctaggtttactgtgtgtcagggacgatgttaaaactgtttcagttacaatcgcatttaatccttatatcaactatgagtccgtcagacagtctgatcttcaactcacagatgagaaaaatgtggctgaaagaggttcattaaattgtaaaaggtcactcagctctttaagtggaagcatgtggattttacataggtatgttaaaatcctcttacacagagcccagactttccaaggtttattctgtgtgtgtgtgtgtgtgtgtgtgtgtgtgtgtgtgtgtgtgtgttcaggttgagggccagggtgctaaaacttgaaagtgagaggttgttcgggggaatatagaattaaaggaaaaggatatagaattaaataaaaaaaggaaaagacctagcttacgttgtgaaatgtactaactctcggccgggcacggtgactcacgcctgtaattctagcactttgggaggccgaggcaggtggatcacgaggtcaggagttcgagaccagcctggccaacatgggcaaacccccgtctctactaaaaatacaaatattagctgcgtgtggtggcaagcgcctgtaatcccagctactcgggaggctgaggtaggagaatcgcttgaatgcagaaggcagaggttgcagtgagccgagaccgtgccattgcactccggcctgggtgacagagtgagactctgtctcaaaaaaaaaaaaaaaaaaaagatacaaaaattagccaggcatggtggcgggcacctgtaatcccagctactccagagactgaggcaggagaatcgcttgaattcaagaggtggagcttgcaatgagctgagattgcaccactgcactccagcctgggcaacggcgtgagactccgtctccaaaaaaaaaaagaaatgtactaactccctagcttgttttaaattagaaaaaacaaaagactgcgtttggaataaaattaatttggtagggcaaagtgtggtattgcttataagacgtttttcattccctagtatatgaaataccttgtctttaagcttttattacttttatttctcctagttataaagctcatttctgaccttgccccatgtaaatgtgacagtgggagaaggtggtctttcttctcctggggttggttggtgaggaaggataggatagcccatggattgaaacaggttcttctcactggagtagcttctcaggctgtacaaaaatctaaactagaagcagatgttactgtggggcagaactctcagttctgatttctttttagttctgtattagagcaatgacactgaaatgatctgagctggtttgggctggctgtctctatacggggagaggctgaactgcactttttggaaggcagattaagtagctgctgcaatcctgttggtatctgttaagatcttgtgattaaataagattgggccacagccctggagaaagatacccagagaggctgaaagagaaaggcatctcataaaggcaagagctgtaattatcttctgatggctctttggcgggtgatctcttaggacaggaagatttacaacctgtaaataatttgcaaggtcattggactatcttcaatgatgtatcagctaatttattcatgccacaaatatttactaatgcctactatgtgtcagacacagctctagacactgggggtactccataccttttatggagctaacatctgagtagagggaacagataaatacacatatgacataacagatggtgataagtgatacgaagaaaataaaggaaggtaaaggagagaaaacagcagggtgaggtctgagtgggtgctggtttagatagggttgttgtataagggtttgttttgggggttttttttttcgagacggagtcttgctctgtcgacaggctggagtgcagtggcacaatcccggctcactgcaacctctgcctcccgggttcaagtgattcttctgccccagcctcccgagtagctaggactacaggcgcccgccaccacgcccgactaatttttttatttttagtagaaatggggtttcaccatattggccaggatggtcttgatctcttgacctcgtgatccacctgcctcggcctcacaaagtgctgggattacaggcatgagccactgcacccagcctggggaatcttttataatgggttatgaagtttacagacttcattcagattccactaaattggattttatgagaattcagctgcagctgacatttacctctggtctaactctgaaaagaaaaattgtttcccaaaaggatttgtggtatatgtagtattaagggtggggaagggctatttaatgtaggtaagataaagaactggttttaagaactttacatagtgattacatagaaatggatgtgggtagttacaaagggttcttatctattcattcatgcccacctgcccagccccctgctgattcagaccagctttcactgccaagtactagccaggagccctgtcttcatatgctttttatacatctctttttctagcatagtgtctgaaataataatacaaggtgactgttaagcacttgccatatcatccttttaatccctgcaacaataccattaagtaggagctgtcattatccccattttatagatgaggaaactgaagctcggagaagttaacctgtacgcagcctgagtctgaattagtcaggcctgcctgcctccacgttcctagtcatcaggcaaagctgtccctccttatcttacaaggttcaagttcatgaaagagtgaataaatggatggatgaaaaaactactactttgattctaacggttgagggaattaactggagacagagcatcggaactccactgaaccatcagagcaggcaggcaggcaggcaggcacagaattggtcaggtgaaaataacaaaatagcaggtgaccatttcttcaagaaataatattcagcatctcctccatgccagaggagttagcctgctcctcgcagccacagactctggcctcaatgcctcactgacccggagggctttggtgaggagacctgggcttccactcagccctttgcaggtgttacctgcaaaggtaacagtgataccatagtggccagagttgcagaggtgggaggggctgggaaaaagagcacagtagatgctggccacgaaaatcgtgcaaatcctgccacagccttcaggctatgtcagtgattccaaaaccagggcgtggagtgagctaaaagtagaggcgagacttgtgccagccaggtttgggaatcacggttgaggatcagtgtttctaccttttaaaaagccacaccccctttcgatgagcaggaaaagagccgcaaggttctctggcagtcctggcctggagtcaggagcggaagttcctggggggagcgcaggtcactaggccttcctaggaggttttcatggagtttgcctgctacagtttgttctattaaataattggacttcgatgcgtggttctcaaacgtgagcctggattcccatgctgaatgttttcaaaaccactcaagcccccctctccccagatcccgcgttgccttctgccttccctatccctagccctctacctcctccactttactcccacagccattgggagtcactgtctagaccattgtttctcggacttcctgggtattaagaattaccgaaaggaaaaagtcggactcagggatctgggaatctgcagacgccctggtgagggacgtctggggaagcacattctgagaaatgttttgggagacgatgcggaggccgagtgagggtgggcgggcaagtgcaagtggaggggtgaaccgaggcgcagccctttgcggggattttaccttagcaatagtttcctgtgatacgagctgctgccatgggcgtgttgagaaagaattattcagtgacacctggtacagtatgggcaggaaggcttcattcaggactgagttagctcaagtgacccctgcaacggagactcgtgggaaggaagagagatggggtgccactcagatacagcatgggcaagtaggaattgatagccaaggaggagtgtggggggtcagtggatggaaaattcctaagaggaaatgtcacagtcagggggattctggctaacccaacctaacaggattcttgctgaggacatcacgtgggggatggcagagaatgagaaacccgatcagatatggagggtgatcagatctcacggatgggggttgtttgctaaactgaccgagtaggattctctgctaacactggatttcataaggaagcacaggcttaggaggaggctcaggagctccactcaagtttggccaagcaaagactctttgtcagctgacacggcgtctcctaccagtctagttcacagggagcatccttggctctcctgccttttggcgggggatcagggcaggagcttgacagatactggcccaggagagggagaagtgctggggagggagatggggtccagccttggaaccccagggccataggcctgccaaaatgacaaggcacggccaactgagagcccctgcttcgagggtgggaagctcaccatctttttaggtttcctacaggggacctaggagcagcctggaatcgtgtttgtccccagtcaggttgggattgctgttcctgcttagaggtcgggaagttgagaccgtgctgcgatctctagaggcagaaacagtgcaacatgtgatttatttctcagcctccaacacattttttccttccttcatgaaggaatttccaagttactcctcctccagaaatcatgtgggctgtgtctctgctgcatagaggaacaacttcgtatacgtgagctcccctgagtaagagtcagccggcaaagcccttactcactccagaggcatgcggcccttcacatttgcgccgtgctaaaggggagaacattttccatttctcttttgtaaacaaactatactctgtctattttaagaagaagaagaaagaagaaaaaaaaaacagtttaagcggctcttaaccaatacttgcaagactaagttgactggtttacaattaaactctttcattcccccaatcataacatctcattttcaagtagttgctcccattgtgtaatatttgatgtcacatagagactcgactccaaactctatgacattcgtgggctgaaagacaaaggagcatgactggctttttcttcactttgaagacatctgcagtttattaattccacaaggaaagctggagggccagaggacgtcgagattctttcactaaaaaatttccttttgagacagtagtcctgttttagtgttggttggagttcatggggagacttacttttccatgaaaatatagagcaaggcttccccctcactgtcacactataatattctagcatttttatagcattagtaatagaaaagaaaaaagactcttggtttagtgtcacctcctttaaaggaaattggcttatggtcagaccaaactgttcttatcccctgtgtaagaggccaagtcatcatttcccagtttttcacagtattttgtatccaggcaacgtcacagaaaataggcccagccaggagtgctctgggagtcactgcagagctcagacttatccatggggcgtattttcttcaattcacaatgaaaactcctagaagttctgtttgaatttttcctgaagtcagcttgttgtaaaaatgtttttgggattaaagtctttgcaggccgtcatctaaacacactatctttacttcagaaaaaaataataaataaataaatccagttttcttttatgtgtcccccctacaaaagcatcagaattttaggagaaagcaaatctttctttccaaataggatatggaactaaagatttctaaaagaagaaattgaggttagcctttataattggtttctgttattttactcccttcctggtcagtgatctgttactaccctctctgggggaagggaaactagcggatactgattgggtcagaatggaggttgtaaaaccactcaaggccataaaaggtcagcaggaaggctttgtgttttaggtaagcctgctctttccagttaaccataagccccactattgtattacatagcacgagttgcattccacatttctgttattggcctaaccttctctcctgacactcttgtgtgaattctagtttgattcacgacattataagacaatctctttgaaggcagaaaccctgcctagcattctagatggtctaacacgaacatgttctaggagatttttttccctctaaattagagagtaggactttaaaaaaaaagagagagaaaataatttattattattattattattatttttgagacaaggtcttgctctgttgcccaggctgaaatgcaatggaacattcacgactcactcagcctcccaagtagctggggctactggtgtgagccactacaaccagctaatttttcattttttgtgtgtgccaaggctggtctggagctccttggactcaagtgatcctcctacctcagcttcccaaagtggtgagatgacaggtgtgagccactgcacctggccagaaaagaaatatttaacattagatagtttcctgtagacatatatagaaagcatcacatatacaagcctagcaacagattgttagagctggaaagcatttgagaaattttttgcttcaatccacttgtttgcaaataacgaagagttgggtgacttagccaagtacttcaagaaagtggggacacagagttatgaatagaacaggagttgttttcaacctggggcagttttgccctccagggaacaactggcaatgtgcctcgaagtttttgatgatcacaaatggtatctagctgaacagtatagcctcccataaaaataattaacgggttcaaaatgtcagtagtgctgaggtcgagacacgctggtccaaccccaggctggccctctttctacttcagcattgtcccagcatgttgcactgtttgttctaagatttgtttattgatgacagagattcaggtcattttgactttagcagaagcaaatcagtacatattcaagtgtgcagtgttgctgtcttagtcctagggttaggctatgaattatgaaattgcaaggaatgaagtccagtttgtttccacatctttcatcgcatttagacatttaataccagttggatgacttttaaacctctagtttttacgttttgattttcttgaaaactcaatttgctgatttcatgacttaaaaaccatggaaataaattctccttaatactcgtgctgtgtggctgagagagatgtggaagagattttcggggctttcaccttgtttggaggctcatctgttttgtctggtggagatggagtaatgggtgtcttcagtatgtcacgggaataaaaatctaagtaaggagaaaaaaaatactcctgtaaaaaagcctaaaaaacatactgatctaaaaacatactctgtaaaattcccatccaatctttttttctgttaatgtaaaagatagttttatttttaaaatttccttaaaagataatttattgttttgagaaaaaaataataacaataaattatggttttgtaacatgtagaagttaaatgtatgacagcagcaggaaaagcaataacaacaacaaaacaggagaaaattcccaccaattctcagcattgactgagaattaatttctgtattgaccaaaaagggctgaaaagttccctattgtccctctggaggcaaaaattttcttttccattgccaactacagattcttttttgttttttttttttttttgagacagggtcttgctctgttgcccaggctggagtgcagtggcctgatcttggctcactgcaacctctgcctcacggttcaagtgattctcctgcctcagcctcccaagtagctgggattacaggtgcgcaccaccacacctggctaatttgttgtatttgtagtagagacggggtttcaccatgttggccaggctggtcttgaactcctggcctcaagtgatccacccaccttggcctcccaaagtgctaggattacagacatgagccaccgcacctggccccaactacaaattctgcttgtgatattagaagggatgagagtccatcgcagttgttgatcgtcttgtgtggtgttctttacaagaaagtgcacttttccaagaaaccatgtacagggggctcctgtcattgggtaaattgggtgaaacagggtgctatagcaatttcctggtcttgtgcaatatcctattcatagaaagtgaaggcacttattaatattgccaagtctctggacctatgtggttgggttacagaccccagcgttaaaatctagtcctatttctgaagactgaagaggattggggagaataatacagttgctgctaacatctatcacttccaaaagatgtgcctatgctgccatgtggcgtacccggagcacctctgagaaacaacttttactttctaatttttaaatatactgtattatattttaaaataaaatgcatttccacaagatgaattttcctgattatcatgtttgcccaaaagcccagagttacatagaaatgttcaattacagtttcctcacccggatattttggcataaggaatctcttctatcactttaaggactcaatgtttagctttctatttttatgctaatgattttctatgttatctgctagtacaagtcagtgccgatgtagacaggatataagtaacagttaaaaattctaaatattgggccaggcgcggcggctcacgcctgtaatcccagcactttgagaggctgaggcaggtggatcacctgaggttgggagttctagaccagcctaaccaacatggagaaatcccatctctactgaaaaaatacaaaatgagctgggcttggtggcgcatgcctgtaatcccagctactcgaggggctaaggcaggagaattgcttaaacccgggaggcggaggttgtggtgagctgagatcacgccgttgcactccaggctggtcaataagaacgaaactccatctcaaaataaataaataaataaataaaacattctaaatatttcttctgtccgttttcgggatacatactgaaagcatgtgactctcttgtctttctgattggatttcacacaaggaacttcctcgctttacctactctcattcatgtttcatgttataaccccaatttacaggctctttttcacaggttacatttttatatagactggctaatgtgtgttctatatgtgtttttgatcatgttccccaactataaaaatgttttgagtattaattctcaatatatgtagacttatttattctttccttcattcaggaacctgctgttaagtatctactataatctggtactgtgttagagtagtgagtaaaacaggcaagaatccctgagtcgagggggctttcctcatgagcagagacatgagggtacttctgtaccaatatgttaggtatgataggagatagatgggtaagtggcagaggctgatattatccaccaagttctaggaagagagaagtacacacactgaacgtttgaatgctgcaccatcaaacaggggacagcaagctaaccctatcagtgaactagcaacctatttacaaccctagaaggtctacttggggggatattttcacagtgggcaaagatttatgggtccttttacatttctattacagagaaatgccttcctctcttactgaattttgtcctacttttctctcttcctggattctggcggggggtagtggggtgctatatttagtctttcttttttctttttctttttttttgagacaaggtctcactctgtcgcccagcctgggtacagtgatacaatcatagctcactgcaagctcaacctcctgggttcaagtgagcttcccatcttattcttccatgtagctgggattacaggcatgcatcatcacaccccattaattttttaactttttgtagagatggggtctcatgatcttgcccaggctggtctcaaactcctggactcaattgatccttctacctcagcctcccaaagtgctgggatttcaggcataagccactgtgtctggccactctattcagtctttacctcttgcccctctatctcattcatgactgttgaaatttcaggctgagagtggtgactcacgcctgtaatcccagcactttgggaagctgaggtgggcagatcacctgaggtcagagttcaagaccaccagcctggccaacatggcgaaaccccatctctaggaaaaatacaaaaattagctgggcgtggtggtgggtgcctataatcccagctatttgggaggctgaggtgggagaatcacttgtacctgggaggtggaggctgcagtgagtggagatcaccccagtgcactccagcctgggtgacacagcaagagtctgtctcaaaaaaaaaaaaaaaaagaaaagaaagaaatttcataggcaccagagtttgactcttgtaatggagaagtgatggcagatatgtttactgccaaaatgccctgcgaggctaatagcaaaatggcccacatctcattatagtgacttcaatgatttaacagatgaagaggtaggggttgagaggtcctgagtcattggaagcctatctcctacttaggctgctatgtgctttcctgttttccctgcagattaattggcacggcgactgtagccctgaaggacctgactggtgaccagagcagatccctgccgtacaagctgatctccctgctaaatgaaaaagggcaagatactggggtgagtgttttctctcttattgaatggctttgaagtgagatgattgagcaaaatttcattaagaaaaaggtctaaggccgggcgtggtggctcacacctgtaatcccagcactttgggaggccagcacttttgggtggatcacctgaggtcaggagttcgaggccagcctggccaacatgccgaaaccccatcccaactaaaaatacaaaaattagctgggcatggtggttggtgtctgtaatcccagctacttgggaggctgaggcaggagactcgcttgaacccaggagatggaggttgtagtgagccgagatcatgccattgcactccagcctgggtgacaagagagaaactccatctcaaacaaaaaaaaaaaaaaaaagaaaagaaaaatgtctaaattgtcagaaccaattggtaaaaaagaaaaaagaaaagaaaaggaaaaggtatcaattggtaattagctaaccacacacacaaaaaatctggttttgagatttttctggtgatctttctcaagtgtgtgtgctttaaataaaaaactgggcccgtttgcaaacgacatggaccttattttatactttcaatcacaaaactagcaaatttgatagatttgattttctatgagataattctatagagtgagggtgaccccctctaggtgtagctctgtgcttagccatgttggtgttaacatttgtgtggttatgtataattctgtgtgtcagatattctttgaaacattctgtagaaggcagttcattgacataagcttggaatatgaagactgtaatatcataatctttttttttttttttttttgagatggagtctcactccgtcacccaggctggagggcagtggcatgatctcggctcactgcaacctctgcctcctgggttcaagtgattcttctacctcagcctcctgagtagctgggattataggcaccctgggcaacagagcaagactccatctcaaaaaaaaaaaaattaaaaaaataagtacatcttaatattttctgatgcaagaccagaattctctttctctagtgcatgtgctttaaaaaaaaatgactcaagtgtcgcaagtcccagatttcannnnnnnnnnnnnnnnnnnngtgaccccctctaggtgtagctctgtgcttagccatgttggtgttaacatttgtgtggttatgtataattctgtgtgtcagatattctttgaaacattctgtagaaggcagttcattgacataagcttggaatatgaagactgtaatatcataatctttttttttttttttttttgagatggagtctcactccgtcacccaggctggagggcagtggcatgatctcggctcactgcaacctctgcctcctgggttcaagtgattcttctacctcagcctcctgagtagctgggattataggcacgtgccaccatgcccagttaatttttatgtttttagtagagatggagtttcaccatattggttaggctggtctcgaactcctgacctcaggtgatcctcccacttcgacctaccaaagtgctgggattacaggcatgagccaccacgcctggcctcataatctttattacattgggtgctggatgttttctggtcacagcctctctcaataagtacatcttgctgggcgcggtggctcacgcctgtaatcccagcactttgggaggctgaggcgggcggatcttgaggtcaggagatccagaccatcctggctaacatggtgaaaccccatctctactaaaaatacaaaaaattagccaggcatggtggcacgtgcctgtagtcccatctacttgggaggctgaggcagaagaatcgctcgaatccaggaggccgaggttgcagtgagccaagatcgcgccactgcactccagcctgggcaacagagcaagactccatctcaaaaaaaaaaaaattaaaaaaataagtacatcttaatattttctgatgcaagaccagaattctctttctctagtgcatgtgctttaaaaaaaaatgactcaagtgtcgcaagtcccagatttcatataattaataagaagcactcataaagatactgtacttggcccataacttccaaccccttcattttccaatcaatttatttttcttgggagcctgggcaaagggagagaaatttacattaaaagatgcagtccctgtaagcaaagctaggctctcaacagccatatgagagaaaggcagttttgctgatctggtctctaaaacttatagatttgccacaaatcagcattgtaatcaaaacacacatttaaaatgttggctatcatctgtttacccaaaacctagctgagagaaatgattctgaggaaagatggtataagtcaatgatttttctgccttctttttttaaagcacagaagaaagcatatgtagacccctagaatggcagaactgttgtgattcagtggagtgtgttagtccatttggcactgctataaaggaatacctgaggctgggtaatttataaagaaaagaggtttatttggctcacagttctgcaggctgtacaagcatggcaccgatatctgctcagcttctggtgaggcctcaggaagcttttactcgtgggggaaggtggagaggaagcaggcgtgacacatagtgagaaagggagcaagagagaagagggggaaggggccagaccctttttaataaccagaccttgcaataactaatagaatgagaactcactcattactgcaagaatggcaccaagcccttcgtgagggatccgcccccatgacccaaaaactcccaccagggcccaactccactattggaggtcacatttcaacatgagatttggaggcaacaaacatctgaaccatatcatggagtaaggaaagtaaatggcctcaagccctgccccctgtaattcctcttacccttttgggggtccctggagcacctctgggaatcctgaggttatagaacacagcatgaaaaccacagatcaagggggtggttgtctgtgtgttcttctaggtttgaaaagtttgattcttagattcagtttagcaactaagcccttcagtgctccctgcgttcagccatgagatgctgctcttatgattctttgtgtgctgtgaaactgtggctagggtcatattccttatcctgttcagtcccttccagagcagtagttccaagacacacgatgtgccagtatatgagggagtattcactgatgaacagaaaaatggaaaaagggcaatgcactgtgtgtgtgtgtgtgtgtgtgtgtgtgtgtgtgtgtgtgtgtttaccagatgtaggaaaagtggcaaatgaaagcataggatgtgtatttaaattcacatacaggctgggcaaggtggctcacgcctataatcccagcactttgggaggctgaggtgggtggatcatctgaggtcaggagtttgagaccagcctggccaacatggtgaaaccccgtctctattaaaaaaaaaaacaaaaattagctgggcatggtggcacgtgcttgtaatcccagctacccaggaggctgaagcaggagaatcactggaacccgggtgtgaggcggaggctgcagtgagctgagattgtgccattgtgctccagcctgggcaacagagtgagactctgtctcaaaaaaaaaaaaaaaaattcacataaaaaacgaataatttctcagtgtaactatgtcctaaatatgatgtcctgtccagatgtccagattttatctggtcaccttgtgtgtgtgtgcatatgtgtgtgtgtacgtgtgtgccatccttatttgcaaaggactccctttattctgaggtttgtctcttctcatttttggtgttaaaatgcctctcttttataaaatgattgtgatagtagatgatagttgtgggcaggtgtttggcaaaatacaagttagcaacccaatgtcgatttcccctagcaaattgtttgaaattttgtgggtccatgaaattaaaaagtactgtatacagcaaactctgccctaaaataatgctccatgtgagaaattgatctcagctcttataagtaggaataacattgtctcttgtaaggaactagtatgtttccttctgttggtagtgaaagctacataatgttttcagtttcccttttcatttggctctaggcatttcggaggtcacagattatgcaacagaaatggcaattatatttaactttatggtttgcatatttgtttcctctttagccagattcaattctcctttttttatcctattttatgaatcacaactttatatacatgttttgttagtcactttttttttttttttttttttgagacggagtctagctctgtcacgcaggctggagtgcagtggcacgatcttggctcactgcaacctccgcctcccgagttcaagagattctccggcctcagccccctgagcagctgggattacaggcacctgccaccaagcccagctaatttttgtatttttagtagagatggggttttactgtgttggccaagctggtctcaaactcctgaccttgtgatccacccaccttggcctcccagtgctgggattaaaagtgcaagccattgcacccagccttgttagtcacttaaagttctctctgtttttttttgttttgttttgttttgttttaagacagagtctccccaggcacggtggctcattcctgtaatcccagcactttgggaggctgaggtgggcagatcacgtggtcaggagatcgaaaccagcctggccaacaagatgaaaccccatctctactaaaaatacaaaatattagccgggcatgatggtgcacgcctgtattcccagccattcgggaggctgaggcaggagaattgcttgaacccaggcggcagaggttgcagtgagccgagattgtgccactgcactccagcctgggcgacagagtgagactctgtctcaaaaaaaaaaaaaaaaaaagtcctgtggaatgctataaaggtcttcgcccaggtttgacaagaatccactaaatattctgtagacaaaaattccaaccaacgtagattaaaatgttagcctatactggaggaataaaaaatgtgggtcaattgacaaaactgcagtaggaatggtagattatagaagtattgtatccatgttaaatttattaaagttgctatctgtgctatagttgtgggcaagagtatcctcgttcttaagaaatacacattgaannnnnnnnnnnnnnnnnnnnctccagcctgggcgacagagtgagactctgtctcaaaaaaaaaaaaaaaaaaaaagacagtctcgttcttttgcctaggcgggagtgagtggcacgatctcagctcactgcaacctccgcccccttcaggttcaagcaattcttctgcctcagcctctgagtagctgggattacaggtgcctgccaccatgcccagttaatttttgtatttttagtagagacaaggtttcgccatgttggccaggttggtgtcgaactcctgacctcaggtgatccacccgcttcggcctcccaaagtgctaggattacaggcatgagccaccgtgcccagccctaaaattcttctttaaaaagaagcatgaaaataaatctcagcaattcataatgaaataagcaatgagcaaacaaataaattaatcatttacagtgaccctctgtaattgtaattctgtgatgggagggcatctccagtctaggatggaggtgtgtgacaattcacacctgcttgtcacaactttactctgttgatgaggtggccccttagcaaggatacacttggcaacctgtgacagggagctacttccccaccctgccttggctgtcagtgggaggataggaacagtcgagcttgtgtccctctccccgtttccagcctcgcttacctactccctctctcttaccccttccaagactttggctcctgctgaagtcacttgcattgagtctataacatgctggtgccctgcactgataatatttgcaacgaattatttctacccaggccaccattgacttggtgatcggctatgatccgccttctgctccacatccaaatgacctgagcgggcccagcgtgccaggcatgggaggtaagctgacccttctgaaggcccagccacccccagggggaggctgctaaagacacacaggagagtgtctggagaaaccctgccattgatcacaagcctgtagctccctgcccacccagacaggggccccgagaggcaggtggggctgcctgaattgggacattgcaattgtttatgaaatgcccttcaaggtagaggggaagggtgaaccaaccctttactgaacaacctcacggtgagcacaaaaagcacatgccggctccagcagaatgtcccagggctttgcttcaggtttgtggcttccaccccatacagtgtctccaggctgtttggctcaaggagtggcccctctgctctcctctgtgtgtctcctcacctcccaaaggtgccaccaccgggctctgctctcagcaccagtctcatgggcatggctttcgactggaacctccttcactgtctcccctaaccccggccccatcttgtccccaaacagccccaggtcctctaagcaattgcttctcttcagcatagcccgcattgtccttggtctctgacatgggttgccagtcattcagggccatcaggtgccagtctaggtggggttggggctgagggctcagggagggagggcctacaagacaatcagtcctctcatgcagctgagtcggaccccctctcagtgttttcccaggatgacgtgatgctaaaagtctctgtcccttcctcagccgtaagatgcatgaccaaggcacagtctcggcatgtgtcccaggaagggaggggccccttatctcaccacactcacctgcttccttgaaactctccctcctggctgggcgtggtggctcatgcctgtaatcccaacactttgggaggccaaggcaggtgaatcacctggggtcaggagttcgagaccagcctggccaacatggtgaaaccttgtctctaataagaattcaaaaaaattggccaggtgtggtggtgaaggcctgtaatcccagctactcgggaggctgagacaggagaattgcttgaacccatgaggaggaggtttcagtgagccgagattgtgccactgcactccagcctgggcaacagagtgaaactccgtctcaaaaaaaaaaaaaaaaaaaaaaaaaaatggaattctccctcctgggaggaagtcctgcacttgttgctgaggtggctcctcggggctcatcttcttcttgcttctcttggttgggaacttggctctccggccgcccgagggttcactttacacctgcagcagcaccctccctgcctgtcctgcccagtcccacctgacttctcatcttgctcagcctgacctccgcccctgcccctgcttatgcacccattatgaatgttttggcccattttttgactaagtagttgtgagtttccagtgagggttaggtggcttcctcttggtgacaagactgagatggccccagcacatcagcagcatgctctgcccatcgccctcttcctagcggcaccctgagcattctacttggctttggacactcagccctgcgggagcgctgcagtggctcaagaacatccatggctccctttgcttccacagcagtgatgacaaaaaaaaacaaacaaaaaaccacgaaacacagaggacacaggccagcaccagtaacaccatcaggggcagaactgagtggtcccacccatttccctcagacctccgctgccgatgactattgtcaccagcatttgtatctgtgtgggaaaggcactaggcgctttctggcctgcacaaggcagccctcattgatgggctatctggagtagcctctgaattggaaagatcagggcatctttcttcatactgtcgtttctcctaagctagaccctgtttattagtttcctaggtctgctgtcctaaactaccgcaaactgggtggcttaagcaacagaaatattctctcgcagttctggaaatcaaaagtctgaaatcaaggtgtcagcagggctagttccttctggagcctctcagcctttctcccagcttctgttggttgcccgccttccttggcatctgtggcttgtagatgcgtcaccccagtctctgcctctgctgtcacatggtgttctacctgtgtgtcttggtgtctttgttgcttttttcccctctaggatatagctcctgagtggctcaaggatcttcctctctatgtgtctgtttttgattttttggtttgttttttttttttttagacagagtctggctctgtcgcccaggctggagtgcagtggcacgatctcggctcactgcaagctccgcctccagggttcacgccattcttctgcctcagcctcccgagtagctgggactataggcgcccgccaccacgtccagctaattttttgtatttttagaagagacagggtttcaccgtgttagccaggatggtctcaatctcctgacctcgtgatccacccaccttggcctcccaaagtgctgggattacaggcgtaaaccactgcactcggctttttttttttttttttttttttttttcagatggagtcttgctctgtcatctaggctggagtgcagtggtgcagtctcagcttattgcaacctctgcccctaggttcaaacaattctcgtgcctcggcctcccgagaaggtgggattacaggcgcccgcgaccacacccgcttaatttttgtatttttagtagagatagagtttcaccatgttggtcaggctggtcttgaactcctgacctcaagtgatctgcttgccttggcctcccaaagtgctgggattacaggtgtgagtcactgcacccgacccctctctgtgtgtccatgtccaaatttcttataaggcactggtcattggattgggacccacccgaatcaagttaagataaggtcactgtggattagggtgagtcctaaccttctcttaaggtccgtaaccttatcttaactgtacagaaaccttatttccaaataagatcacattctgaggttccagtggacatgaattttgaggggacagtattcaacccagtacactggcagataaaagacaatttcatatgttgattccattccaagagccaaaatattaaatgggtcctcttgtgttaccccttctgccaggcctttaggaaaaaaaaaatactgtggttcattcaagtaaaaagagtaaacttaaagagatcagcgccacaccatttgttagtatttataaagtaagaacattgcttgctgggtttattttattttatttttttgagatggaatattgctttgtcacccaggccggagtgcagtgacatgatctctgtttactgtaccctccgtgtcccaggttcaagtgattctcatgcctcagcctcccaagtagctggtattacaggtgtgcaccactatgcccggctaattttgtatttttagtagagttggggtttcaccatattggccaggctggtctcgaactcctgacttcaggtgaaatacccaccttggcctcccaaagtgctgggattacaggtatgagccaccacgcctggccccaactattgaacttttaaacctgctggcgagaaaatccctgccacccaaggctccttctcctttcctcttggtttaagcctttgtttgtagcaccagtgctcccagcaggacagtagactgaaggagtccaccatccccttaggagtctggctcacagcgggctcagcaccagggaactgcacaagcgcagcccagctctcccacggaagttctttagaatccctgactttgctcagctaagacaggaaatgaaccaaaacttgggttccttgtatttggatttcaaacaaagaaggtcaccaagtgttggtctgcaaatgagctgtgtctgcagggcaattttatttttaaatgcaagatgacagagtgaaatttctatgtttgatcttagccaaaagtctgagaagtaatgtgaaatttctttattacaaaaaataaaccgggctctttgatctggaagtgctgcctttgttctataaaatgaatgtttgccggggctcggtcaaaggtggcattctgtgtgtcggcttcctaatctggctaagagaaactttccttcagcatttaaaaaaaaaaaacaaacctctaatagcctcgactatctagatgtttcaagggaaaacatttcttttccctaacatagtgtcttagtctgtttgcattgctataaaggaatacctgaggctgggtaagttataaagaaaagaagtttatttggctcatggttcttcagactgtacaagaagcatggtgccagcctctgcttctggtgagcgcttcaagaagcttccactcatgggggaaggggaaggggagccagcatcacatgatcagagaggaggaaaatgagagagaaggcaagggtgccactctcttttaaacaaccagctctcaggtgaactcattcattactgcggagaagccaccaagcctttcaggagggatccacccccatgacccaaacaccttccagtaggccccacctccaacactggggatcagatttcaacataagatttcgaggggacagatatccaaattatatcacatggtaattcagttcaactgagcaaaaggtatctttgagcacctactgcaaccccctgctagggaagacaccaggagaaaaaacaacttacaatcttgggggaatataagacaaacaaatatgagacagagaacagcaagacagccatacctcttggcattgcataccttaatgacataagcaggacatctggcccagaatttgctttttttcccttcaattaactttctttctttctttcttttttttgaagtggaatctcagtctgtcgcccaggctggaacgcagtggagtaatcttggctcattgcaacctccacctccccggttcaaacaattcttgtgctcagccacctgagtagctggtattacaggcatgtgccaccatgcctggctaattttttaatttttagtagagacagggttttgccatgttgcccaggctggtcttgaactcctgacctcaagtgatccacctgccttggcctcccaaagtgctgggattacagtcatgagccactgcacccggcctcccttcaactgacttttaaagaaaccctaaaactttaccattctatgtaaaagtaatgtctgcttcttctgatttatatattttcaaattcttaaaatttgagcttgtttttctttcctcgagcaaaaaagaaatatctgcttaataaaatgtaaatgtcacagagatacatgacacggaaagtgaaaatctctgcgtcccatcctcctgagataaccactgccagcaacttctgctattgattttaaaggttcttctccacatagtggctcctgcagaggagaaattagaagtatttatgctggaatacaaaagttaagatttttaggaaaatttgcccctgccatttgtagaagctagctatgatcacatatcacaggaagtgaacacctgagggcttcttttttaaggaattctttcttagagcttttatatgaagatgacaaaaggtagagaccttagggcactggtggcttgactgaaagtgtgtgttgtcaaagatgttcttttcactgacccccctggaagactgttcccatgacagaggggagggctgacccagtctccaggcttgacctgaaaacctgttaccatggcaacttaattcgccagatgtcagtctgcttaactggagcctacattcccgtagctggaagaaactatttttaaaatctcacgtctatttttgaagcaccatctgttaaatttgcgctctgtccaaacatagacattcaaaaactcattcatagccagacttcactgcttcaaatgtctttcattccacgaatcccaaagtcatttgcttaaaattaatttttttaatggagtttttgctctgttgcccagtgatctcagctcactgaaacctctacctcctgggttcaagggattctcctgcctcagcctcccaagtagctgggattacaggcaccggccaccacgcctggctaattttttaaatttttagtagagatgaggtttcaccatgttgaccaagctggtcttgaactcccgacctcaggtgatccgccagcctcggcctcccaaagtgctgggattacaggcatgagccaccatgcccagccttaaaattaaatttgatccagttcagaaaatatttattgacacctgcctatgggacatacagaggtgagaaagccattgttttaccaccaaggagcttgcagttcagtaggaaggtaagagataaacatgaataactatagcccagagctgaatgtaatacattcctccagagagattgaccaaattgttatataggaaacaattgctttcagaaagtactttttcagctgtgtattgcaactctgtattcatggtgcctagcacagcccttgagaagtcataattgttaataaatgcttggttggttgagtgaatgaatgagtgagtgaatgatagatgggcactgaatatggtttaaaaatttttttttaagaagggcattttggggccgggcacggtggctcatgcctgtaatcccagcacttcaggaggccaaggtgggtggatcacctgaggtcaggagttcgagaccagcctgaccaatatggtgaaaccctgtctctactgaaaatataaaaattagccgggcgtggttgcatgcatctgtaatcccagctactctggaggctgagacagcagaactgcttgaacccaggaggcggaggttgcagtgagccgagattgcgccatggcactctagcctgggcgatagaacaatactccgtctcaaaaaaaataaaaagaagaaaaaaggaagggcattttggggaacactagtgaatatgccaaagctcctggctcattcagaagtgtgttgaaagtgaagcatgttcctgagggtagtaggtcccaggctgggatatttgtccttgatgggaagaccatggggctccatgaaaggtactccatgacaagggactgacttggtcagagcctaactggaaaatgatccatgtgccagaagattgttgcaggcactgtttccaggattgggtttctaatcaagtggctttgtctagtaaactgattatattagtccaatttttctctaggatatttaggaaaatcaaagtgctcatcataaacaagtggttctcaacatttagacacagtgaaatcatcaagggatatctctaaacgtgcagtcatctggcgcccatctccagagagtttaatatagctcatctggaggggagccccgagtctgtatggagagcctgatgcaggcagatttcggagttcactttgagaaacgctgcagtcgtacattttgcctgctgaacgtgatgttgtccagagggagacatagatctctgggctttgttatctagactggctcacagcctgattcctcaattgccccgcaggactgcatttgcatccctgcttcttaggttcctccatggtacctttgctctggtctacatattggaacatgctagaaaattcttagggcacatttattgttatttacccaggaattggggtggggtaatgaattgcttacagtaggacacaaacatttatttataaaacttttaacattttagaaattcagaaaaaaattattctacattccagctaagaaaatgtgttatctccaaaatattacatgttttcctgcttcaaaacttaccctttcctgttctgcattgtccttttagcttacactgaagataatatgatatcagccctttgttgtgcttgggcaatgacctttggctcaaagtgataaaattctggcttaaccagtaccaccacttaacaagacttcatcttgaaaagcagaattaggatcaaaggcagaggccaggcaccgtggctcatgcctgaaataccaggactttgggaggccgaggcaggaggatcacttgagcctgggatcacttgagactagcctgggcaacataatgagactccatctctccaaaaaaataaaaatagttagctgggtgtgatgatgcacgtctgtaatttcagccactctaggggctgaggtgggaggattgtttgagcctgggaggagatgagaggagaggcagaatgtttggataaagggggctgccaggggctgaagtggggtctgtgttccagccaggaggatcccagtccagccagggtgaccagcaagtgctccttttcctcagccattcctaggagttgccttcactgggaagctctaacagggatccccctccctggcaaggtgcagacaaagtgggatgatggaggtggggggacaatgacctgcagctctggtgacatctgatatctgagtgactgatatcccactctcttctgcttggtagggagaagtggtgctagagaacagtatgggagcctggaggaagaagggacattgatatgcactggggaaaggcacagttggggatgccaaaggcaaacttgactgtatcacgaggtcctctagggctgccaactcttcagcactgagtgggtggacagatgccatgtaggcaagtgtcattatcacaagtgactgcacacaagggcagttggcaggaatattgctgctgagcgtctggaaagaggatcacaatacatctcaggaatgattacattgctggagctatgatggagaaccatttccaaatgttagcggaaacatcacaagtaaagaagagtggatcacatgcagttactgatattcagaaaggagacaggtcagtgttggatgcagtgagaagctttgtaggatttgaccaagtgacattataattattggagaggcaggatggcattcctacaagggagttgtgaagagcttgtcatagccggagatggacagtgaggaatcttgaaccactgtgaatcaacagatctggatttgagcattggctccactatcaagctgtgtgacagtaggcatgtcacttaacctctctgagcctcaagttcctttcttacaacatcaggaggttggatttaataatatgtagggtctcttccagctccgaagttctatgattctattaaaatggcctggtcatggccgggtgcagtggctcacgcctataatcccagcactttgagagactgaggtgggtggatcacttgaggtcaggagttcaagaccagcctggccaacatggcaaaactctgtctctattaaaaatacaaaaattagccaggcgtggtggtgtgcgcctatagtcccagctacttgggagattgaggctggagaatcccttgaacccaggaggtgaaggatgcagtgagccaaggtcatgccactgcactccagcctgggtgacaaagtgagactctgtctcaaaaaaaaaaaaaaaaagcctgatcaaagccagggttcatatattataagaagatgggatgagagaagtttctttttctttttcttttttcttcagatggagtctcgctctgttgccgaggctggagtgcagtggcgcgatctcggctcactgcaacctctgcctctgggctcaagtgattctcctgcctcagcctcccgagtagctgggattacaggcgcctgccaccacacctggctaatttttttttaaaattttatttttagagaaggggttttgccctgttggccaggctggtcttgaactcctgacctcaggtgatccacccgccttggcctcccaaagtggggattacaggcatgagccacgacgcccggccgagagaagtttctttggtgattacttctgtttgcgaatgccaggatgagcagctgcgctttggttcaaataggctgaatcaaagagcagaaagtgtttcaaggattaaatgaacaaatgctgcagaaagtttgagtaagaagagacctgaggctggaccgttggattttgcaacatgaaagtctttagtggcctagacaagagcagttttggtggactaggagggcagagggctggctggaagaagcatgagaatcagagacagagtgaagaatgtgagtaaaaatgattcttctgaggagtttgctcccaagaggggcaggaaaaatggagcagtaactgtagggggcaccgtggagtcaatgaaagttttgttttttaatattctgggtgatatttcagcgtgtttatattttgatgggaatgatccagtagaaagggggaaaccgatgaacgtataaagaggcaaaactccttaagtagcaacaggagataggatctgtgcaaatgcggaagagttggcttcaagtcagggagcacagatagttcagtgactaattgtagcaggagagaaggcaacagatacaggtagatgattgatttggagttggaaagatgtggaaattatcttctaattgccaattttctcaatgaaataagaagccaggtcattagtggacaatgagaaagatagaaagggtgttggaagctttcaagatgcaaaacaggtggccgttcagaaaggtaaagtgatttgactgtgctggttaattagtggccatctcagaccaggattcaggaaagttttgggatagatatcttggaaatgtggtaagatggccaggcagccctgtgaggacacttacagtttgtgatcaggaaattaaagtgagatcagtccagtgagatgtgtgtgcttcccagccaagttcagctggctgggtgcagaggtgaagtcagtggagggttgaataaaccaggtaagcacagtgaagtgagagggggaaagggatcgaggggcatgcagtggggtggttgcagtgttaggtggcaggatctaacctggggtaggggtaaagcaaagacatggaggaagtggggtgcagggaaggcagtgtgctcattagattggggctgcttgtgggctggagtaagagaggaagcaaattggaaagacacaaaagatggcctctcagccaggcgcggtggctcacgcttataatcccagcactttgggaggccgaggagggtggatcacttgaggtcaggagttcgaggccagcctggccaacatggtgaaaccccgtctctactaaaaatacaaaaattagcagggcgtggtggcaggtgcctgtaatcccagctactcaggaggctgaggtaggagaatcacttgaacctgggaagcagaggctgcagtgagctgaaattgtaccactacactccagcctggatgacacagtgagactccacctcaaaaaaacaaacaaacaaacaaacaaaaacacaaaaccacaaaaaacaacaaaaaagatggcctctctagtggactgaatagtggccctctaaaatgcatgtctatatggaacctcagaatatgaccttatttggaaacagggtctttgcagatgtaattagttaagataaagtcacactaaattcagtgactgtagtttcttgtttgtttgttttgttttttgagacagaggctctctctgatgcccaggctggagtgcaggggcatgatctcagctcactgcaacctctgccttccaggttcaagcgattctcctgcctcagcctcccaagtagctgggaccacaggtgcacgccaccacacctggctaattttttaatatttttagtagaaacggggctttgccatgttgaccaggctggtcttgaactcctggcctcaggtgatccacccgcctcagcctcccaaagtgctgggtttacaggtgtgagccgccgaacctggcccacttgttcttatgagaagacgggaggacacagaaggagaaaggccgtgtgaccacagaggcagagactggagttatgcagccacaggcagggcatgctcaggattgccgggagccactggctaggaagagacaggaaggatttttccctcgaggcttcagagagagaatgtctctgccaacatcttgattttatacttgtaaggtttggaactgtcggggaatacatttctttcttttcttttctttttcttacctttctttttctttccttgctctgtcacccaggacagagtgcaagggcatgatcatggctcactgcagcctcgacctcctgggctcagatggtcctcccatcttagcctcccaaatagctcagactacaggtgtgcaccaccacacccggctagtttttaaattttttttgtagagatggggggtctccctatgttgcccaggctggtctcaaactcttgggctcaagcgatcctcctgcttcggcctcccaaagtactgggattagaggtgtgagcccctgcgcctagccagagaatacatttctattgttttaagtcacccagtttgtgggacttcctgcgacagccttcagaagctaatacaaccagcagcttcctgttcagtgggtgattcctgacttggtgtggccctctgtggttgtgaaagagttgctctttgtagatccacttggctgtggatcacattcaggcctgggtctcacgaacagggcctgccagcacaactgctagcatttcactcatgacacagcttgcacatcagggtgtgtttaacagtgccataggggccccctcattctttgtggaacccatagcattctttgtggagcccgtaccattgtttaatcctctgcagcttcctgccacataaaggggaggtttcctgcttgaatattcttctgctgcaaggcacagaggctggctgtcaccatggcttaggctggtttcctctgacccatccctttagcctaaagtctgaatagcagaagacgttctttgttatctgcaggctgattctagagcatccactgagaatgtaataagtacttgtccagagtccagcattgcaaaggggtatgattgaccctgactttttctcctgcttactgccataaacaatcaccagcctaaaatgctgtaattatggcaaggaggaagtacaaatcaccagcctaaaatgctataattatggcaaggaggaagtaccacttaggcccaggatgatggaaggaagttcgtcttcgttgcttggaggaacccaacagctgtcagccccagccattgctcggtccaggacaggtttaccgaggggaagcgcctggcccccagtgcttccccgaggctggtgccaaggttgggaggagcaccccttcagccatctgggtgttctttcctgagagttgttcagtagtttttccaaatgtgaaggcacatttgtgcctgggatcctgttccccttcccatttatttactcattccacatttatcaagcactttctatatactttgtgtaatgagttctgtaaggcatggggcagaaacaaagaagcaaaggcaagctccttgcttctgaaatgcctgggagtaggggaagcctatgggttgacaagcaggtgcaagactatgtggtgaggactagaaagaacaatgtgtggcgggtaggagagagcgggactaactccatctggaagaggtggggagggcatgttggaagacagtaagtttcatctgaaacttaagaaggagaggaacttacctggtagagagtaggatgaagaagattccaagagcttggatccaggtgccctaagagagacagcaggtaagcccttcttttgaagtctcttcaagaataggcaagaggaggtccagatcatcttgcagaggacaaagattccttatctttgacttccatgaggttttcccagtagcctgaaaaagatgttgaggtactaggagcataacatgtccttcacctacagcctggttttaaacccagttttataccagagaggcagtgtgaaaacttggtcctggttttagctcagcttctaataacttaaccacaggcaagttgccttagctttctggacctcagtttttctgtctgtaaaatggggtgaagggtaggttggatcaaggatctctaaggtcccttctaggacaacattctgtgggtccatggctacttgaaggaagtgtgaagtgaggatctacagagtgttgagtcaaaggatcagaggacagagtagggagtcacactcagtgagtaggagacaaaaacaggggcccacagaagaacctgaaaaagcagatcgggggaggagagctgcaatgatctaaaaatatgtatatgagcactggtgtccaaggctgtggaagatccaatatggagatacagaaaagggcacggagcttggcaaagagaggtgattgacttttgaagaacagaagccaggctaggatgggcgaagcatgaatgaatggatgatgaggagcagggcccaccctgggctaaattgcaaagcagtgcatgtggaggcccccttttcccttgtggctgcctcttcctcactttgggacccctgcctgctgtgctgcccatggactgctccagtgccccatccccacaccccccatagctggttccaggaagtgtcctgtgctccagaagaagccccttccaattgcagtggtctgaatggttgtgtccctccacaattcacacattgaaatcctaaccctgaacgtgatgatattaggcagtgaggcctttagggaggtgattaggtcacggggccagagccctcatgcatgggattagtgccgtgatcaaaatgggctcaagggagctcctttgcttcttccatcatgggaggcagagaaggctccaactgcaaaccaagaagtgggccctcaccagacactgaatccgccggtgccttgatcttggacttccccacctccagaactgtgagaaataaatttctgttttctaaaagccacccaggttgtggtattttgttatagcagcccaagcaggtgaagacaccaaccaaaactgattacacagcaaaactaaaaaataaacagttaatttattgggtgcttctgtatgccagatactgtgctaaaggcttcgcctatagataattacacctttacagtaaccctgtggtaaatactattattttcccctctttacaaatgaagaaactgaagcttagagaaattaagaaacttactcagactcacatagctcgaaagtggagggtggggagtggattgagcctaggccacgtggcttcagagcccaagatttcaagagctatgctacatagtaatctgatgaaactcattcataccaggatgtgaatgactgacaggtgactgtccttggaaattaaatctctttcataatcttgcatcgtagagaaggagtttcagaatccaaaagcagggttctagacagggtggcttgtcttctaggctctcttagattatattgtacagattaccagaagttctaactctttgtgtattaagaaaagaaaagctaaagtttgtcagcgagtttcaaagagctcgtgaataaaagaaagaggagaggtagtaggcagagttgatttttggtttttggttttgtagggagagaaagatctgtgtctacttgaaggcagaggaaaagctgcaatagagacggaacccccagaggtacacaagagagaggagacatttggggagcctgaaaataatcaggaggtagtaggatctgcaaatattcaggaggtagcaggatctaatgcatggcagagggttgagattttcactctgctgagcagggtaaaccttttcctgagtgcagagggaaggtagagggataaaggaggggacacgtgtgtgttaaagtgacaaaccaggaggaggaaggaagagcaagatgatcaccttggtgcttggcaagaaaatgaggagagtttctcttctgccattagggtggaaagagcagttgtgaattaggaggctcaagcaggaaacagtacaaatagatcacgagcagatctctagagagaagatctgcagtgggagggatggagttgaagcttgtcattgcaagactgcagtgttccgtgatgtttcttcctttttccatcctaacactaatgagaactcagcaatccctggctgggtccaacggtgccatctcctctcattgtccctgtgatctctgccattctcttggtctcttcgaaggcaacctgagcaacagccccgatgtactgtgaacacattttcctaaagaatttttccaagtcacaagaagtcccaagtcagtgtcaccaagaggatctccttcacctgccactttaggaacacttaaaacataatggcagacaaaaccgtgtcctggaaacctgagcctttggacatttacaggataagggctatccctcactgggtttctttctgatattttaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccaggtagcaacggcctggcgttctgcttctttgtttaatctttatattgcccatcttctggcaattgcagtgatgtttcagtggacctattccaatggacaatggctcaaccggtaaagagagatgtcagtgtataaacccagtaagaaaagctctccatctttcttctgcaggcacaagtgggtttagtctagccagctgatggtctccagagaaataaaactataattctccttccctttggcagaaggaaagagctaatcaaagaatagaagcgcaaatactgtgtttttcgcagctctgggccctgtcttagatttggaaggcagctatggagttagttcatcactaggctcagcaagaccaggtgcatgactggagtctgagcagtgacctccacctgccctgccctttcccaggccggctttgaatgatttcatccctacagctgctcttggtctctataacccaaccccagttcccatcttgggaatgaccctaggtggctccacccaattggtagcacctggtatagcacaaagctgccctggcctggtgttagcaatcctaataggtgaaggaaatgaagcaacacctgaggatcctaaggatcccacgtgctgggaaaggttgggtaaccatcccccttctgtgctgcagatccgcgtccgagtgattgagggccgacagttaagtggtaacaacataaggcctgtggtcaaagttcacgtctgtggccagacacaccgaacaagaatcaagagaggaaacaaccctttttttgatgaggtaaaggggttgagagggcatgtttctgctcatgagtcccactggggagggaaacacgggagcagcttcactggtgaagacaccactgagttccaagtagagatcacaggaacaaaactaggtgtgaccatgtgaacgcatggcagggtcttggaaaaagccctggagtttaagcttcatggtaaacccacttctgctattggaaaaggagaaataggtaagtaacaaatatagcttttttttttttttgagatggaatttcgctcttgttgcccaggctggagtgcagtggcgtgatctcggctcactgcaacctccacctccggggttcaagtgattcttctgcctcagcctcccaagtcgctgggattacaggcatgcaccaccacacctggctaattttatattttcagtagaggtttcactatgttggtcagtctggtctcgaactcctgaactcaagtgatccacccgccaacaaagtgctgggattacaggcatgagccaccgcgcccggccagcatttatttaaataaaattgttcacttgggacaatctaaaagatatctagcttttagatatctaaaagctaaatgatgtgaagatccaaggctaagcaggtatgggggtacacacctgtaatcccaacactcaagaggctgagacgggaggagtgcttgagcccagattttcaagaccagcctgggcaatatagtgagatgcctttaaaaaaaggaaaattacctggtcccctctgtcagtggttctcagagatgctgttgcctttctggtgtttttgtgataacttcttgatgatcccttcgacccttatgagagaggacatgatgtctcctaaatctacctttgcttattctaattagcagggtgtctctgagggacaactctcgtgactaatccagttttttagaggtgtcaaaacgtacttggctgcaaaaataatatatgttaaaggaaagcagttattagcacacaggggctttgtttgttttgccccccgtactgataaattttttttttttttttttttgagacagagtctggctctgtcgcccaggctggagtgcagtggcgtgatgttggcttactgcaagctctgcctcttgggttcacgccattctcctgcctcagcctcccgagtagctgggactacaggcgcccgccaccacgcccagctaattttttttttttttgtatttttagtagagacggggtttcaccatgttggccaggatggtctcgatctcttgacctcgtcatccacccacctcggcctcccatagtgctgggattacaggcgtgagccaccacacccggcctttttttttttttttttttttttgagacagagtctctgttgccaaggctggagtgtggtggtgcaatctcagctcattgcaacctccacctcccaggctaaggcaatcctctctcacctcagcctcgcaagtagctgggactacaggcacacaccaccacgctcagctaatatttgtatttttagtaaagatggggttttgccatgtttcccaggctggtctcaaactcctggcctcaggtgttccacctaccttggcctcccaaagtgctgggattacaggcatgagccactgcgccctgcctcccatactgagaacttagcctgttctactgccctcttttataacactcctcaaaaatacatgataccttgataatcatctcaaatgccacaaaactccatgactgggctgtggggagaaatgatatatttagggaacttttcagagtcttggccaactgtgctgaggagacacatttctgggattcctcaggcctatgtctcctgctctgttctccagcccaggcctgtcttaccacactacctcttcattccctacggctctaatcccagctctggcgtttgtccttttttttttcctacttctttattcagaaaagaaatgatttcttctatgccgcgtttctatttcttcctcttcgttcaaactggcttccagctctgcagaaggtcctattttcttctcacctctaacctctaacctctcccctcaaaggaatcgcagatgacagcaggcagccaagtacagtagtatacacattctcatgagaggtaggggctgcacagagatggggcactggaaatggacttcagggaaggcagagagattcacgttggagggcaagactggatgcgggggggaggaggcaagatgctggattacttgggcctaacgcgtaaaccctgtctatgcattgataatgcaggcttcctgttgactcagctgcattcccaggagcccagcaaacatctccaccttcctcagaattttcccattttaatgagtttgagggggattagacctcttggcaaaagagaagtccagtacattaatcgataaaaaaattttacgggataggagaaacaaaagtaagatgataaaaacaaatatatatatatatatatatatatatatatatatatatatatatatatatatatatatatatataaaaaagaggtttactaaaaaaatttctagcctggccaggcgtggtggctcacgcctgtaatactggcactttgggaggccgaggtgggtagatcattggagatcaggagttcaagaccagcctggacaacatggtgaaaccccgtctctactaaaaatacaaacaattagccgggtgtggtggcacacacctgtagtcccagctactcaggaggctgaggtaggagaattgcttgaacctgggaggcggaggttgcagtgagccaagattgggccactgcactccagcctgggtgacagagcgagactctgtctcacaacaaaaaattagcctggcatggtgatgggtggctgtaatcccagctactcgggaggttgaggcaggagaattgcttaaagcctggaggcggaggttacagtgagccaagatcgtgccactgcactccagcctgggcaacagagagagactccgtcaaaaaaaaaaaaaaaaaaaaaatcctagcctgtatatatctttttaaccaagtaatattaaacttgttatcaccaataataggaacaaaaatgatgtggtgtcctcatgtgagataatggaagtaatcaacatcacctgtgtcaagtcttgtcaaatggccaatttgcatccgacagtgaggaaacattcacacaaatctagactgtgggatattctacaaaacaacgggcatggtggctcacgcctgtaatcccagtactttgggaggccaagccaggaggatcacttgaggcctgtagttcaagaccagcccgagcaacatagtgaaacttcatctctatttaaagaagaacaaaaggcaagaaaaaacacaagaaacaaaaaaggaaatagcactgttctatatttttatatagcttccttttggaagctgaagagactcaaaaacgaaatgcaacgtatgattcttgcatagatcctagatttctttgaaaagctaaagtttttttgtagggatgattggagaaatttgaaaattgactctgttagatgttaaatttcttggttatgataatggtgttgcaattctataggaggatgtccttgctcttaggagatgcatgtaaatgtattttgaaggggtgaagtgtcatgatctctaaagctttcttgcaaatagttcagtttaaaaaagagataaagcaaatgtccaaaaatggaacaattggtgaacataggtgaaaggtggtatttattttaccattctttcagctgtcctgtagattagaaatattcctaagtaaaaagttggaggaaaaagtctcagttggagtaagtgttcaatcttttaggattaacatttattagcctaacatggttaaacctcctatatacctaatattcatatcccaagaatcaaccttcttaaaattagcttttacaatgtggtcaatattgactttgctgaggcactaacttaatctaatgggcaaaattgtcttgaaaggtgctttcttggagtaaaattagagtcactagacactaatagagctaaagatattagagaaatttaaaacacactccaggtcatgccagctctaagcgctcattttgataagcattgcagcatgaagtcaccttggatctttttccctttttttttttttttttttttgagatggcctctcactatattgtcctggctggtcttgaactcctgggctcaagcactcctcccatctcagcctactgagtgttgggattacaggggtgtaccccgatacctgcttagctttggatctttacattatttagcttttagatatctagccccaggtgaacaattttctttagttaagtaaatgctatatttgttacttacccttttctcctttttccaacatgaagaagtgggtttaccatgaagcttaaactgcagggcttaaactccaggccttgccatgtgttcacatggtcaaacctaattttgaatttgtgttttgcattttttaggagggcccccaaaattatagcatcagattcccctaacccgaatcccctgttaacatttaaacatctgctctattgttttggcagttgtttttctacaatgtcaacatgaccccttctgaattgatggatgagatcatcagcatccgggtaagggtcagcaagtaggaaggtactgctcactcactgccaggcaaagccaatcatttcttcactactcttctttcttccaggtttataattctcactctctgcgggcagattgtctgatgggggaatttaaggtgagtgacaacagtctgcttcattcaacttacagaaagatgagaactttcataatagaaatctgattcctatgtacgcatcttggtggcatcttgggaatgtgtaagggttcagcatgatgacacttgctgaaggctgcttggggcttgtctatttccaaagtataacagtgaacagagctctcaaagcaagatgccctgaagctgccatatcagggcccttcccagggttgtatctggatggaagcaaatccactgccacaaagggaaggggtgttgaccatggcaagaagtccaccatctacctccacttactgggggccccaaagctccatctgcaaagccaattatggtaaattcagagtgtgaaaggaaagccaaacaaggcaagaggttcagggtgcttctataagtagctctcactggaatgaaaggacaaatacttggttggcttcttcccagcaattctacatggaataggctgcctctccaagaaaggagcaccagtcactagaagtcctagaggatgatctgggtcaggcagacctgtgttcataccctgtctgccaccaagtagccacatgtcccagaggaactcaatctctctgatccttagtttcttcatctgtaaaatgggatcattgagaaaattaaatgagatagtatgtgtaaagcacctagtacagcacctggcacattgaagtgcccagtcaatggttatattaatagtagcattagctggaggagaaggaggaggaggaggagaactggacaggaaattgggccaggtgaatttctgtaggatgaccaatggtcccactttgcctgggactttagtggtaaaactgaggataacccaggcaaactgggtcatattggtcactctgcttctgtggtcccttccagccctaagactagctcattcattcaatagtgacttactgagggtcttccatgtgccacacatcagacaaggcactggggatacagagaggataagacggaaatgttgggtctcaaggaaatttaagtgtaatcaagacatgatatttaaatataatgatggcttctttaaagtgactagactgattttaaaatctacttagactactttcgattattgttttcccagattgatgttggatttgtttatgatgaacctggtaagtaatgttctccccatcaatatgaagtcttaaattcattccttctaactctgaagatgattctaagaatcaagacaatttgggggggatcaaagaattaaagttaaaggaattttttaaaaaatattttcttaatgagggagaggagaggatacttagtgggaataaataacagtagcttagaaaaaatgtctaattttttatcttaacattcaaaatagatgatttctatgttttgtgaggatattttgatcttatcaaaattaaattataaaactcgttggtacaacttagagagtcttgtttgagttacacgaggacagaatggtgggggtggggtgtagggagagtacaaaacagaagacctgaaagtggacactcatctggggaatttggtgtgtcgtgaagaggcttccaagaaaatgcagcttatcttatggcagaggaatcacagacttatcagtacctttttagcatgtccatttccttttactccttctctattttaggccatgctgtcatgagaaagtggcttcttctcaatgacccggaagataccagttcaggttctaaaggttatatgaaagtcagcatgtttgtcctgggaaccggagatgagcctcctgtgagtccctacattctctactttctacacttctcactaaaaaagaaggccaagagttaagcatgtgggcatgggtaattgtgaaatggagcacagcttcccgtcaataccctcagattccccctattcttcagaagctgttcttttcttcatcatggaattattgttctagcttacttaaactcttatctgatgtctatgagtgagcatttaattgagaatcgatgaatgtgtttttacaacgtccttgcctcattagaaagactgcttttatctagaaagcatgacctacttgcagaattaggcattgctacctaaatagttagtgattattctaggaaactgggtggcaaactgcagaatataagtggccagagagaagttgaagggacatcaggaacacacacacacacacacacacacacacacgcacaggctcttactatttggtgctcataaaatgacagaatgatacaaaaacatgagcattgattttgtggagcagttttgaggttgaaggaaaactggtggctgatggcaggctgaactcttaagccccaaacacaggaaatcttaatggaaacgattctgaatggtttcattttataagcattaatttggctttttccaagtgctgcttttctgtatgtataatttaaatcatgtgcccctaatagcctgagagacgagatcgtgataatgacagtgatgatgtggagagtaatttgttactccctgctggcattgccctccggtgggtgaccttcttgctgaaaatctaccgagctgaggacatcccccagagtatgtactgatttaatcttgccccagaattgttgattatgtgtgtgatgaaatgtgttaaaaatcaaactttaatagtgattcgtgtccctatcgtatgtttttcttctgaaagggcttcatgggcttattttcattcattctggcccagttgaaagctacctgagcaggctcatggcacagctagttggttgctgatcatgttccttgttgagtacctgcctttggcccatttgactctctctcttgctattctatatcttctctttattctagaggatgctaaagagatatgagcagtcagcacttccaaccccttttatcccaaatgaaaatgtgaactgttattatcaaatcaaggtgtttgctatccagctataaaaaaaaaatagcagaaattagctgggcatggtggcgggtgcctataatcccagctacctgggaggctgaggcatgagaatcacttgaacccaggaggcggaggttgccgtgagccacaccactgcactccagcctgggcaacagagtgagactccatctcaaaaaaaaaaaaaaaaaaaaacatgctgagcaaagggtagtaatgtcccaatgactagaagtctgccactattgtattatgaaatatattcagcaagagactggttgcatttaagggatcgcttctagtgattccatttataggaactagtgtggttatccctctgtcactgctgatggcccagcctcccatttgccttgctgggcctgtctggttcctgctgggctctgggacatgggacccttctccaagtccccaggaggctgcactcactatacaggccatggatctcttcaggatttgctgcttttcttgggaatccttttcctcttttaagatcctatggtcttaaaagatagtattgtagggcctccccatacccacctttctctcaaaaatgtgtcaaatgggctggaggcagtgggtcatgcctataatcccagcactttggaaggccaaggtaggagcactgcttgaggccaaaagttcaagaccagcctgggcaacatagcaagactactgtctctatttaaaaaaaaaaaaaaaaaagaagaagaagaaagaaatacataaaataaggtaaattaaaatcctgatctctatttactttttagcttaactatagattgtagttgattaaatatattatttgtgattatgtcaaattttcttgaatttctctgaaacagactaggactatatcattttgacctagagcacctttctcccaattgaaagcaggcctgagtttgagaatcatcttttactctcactgaatgaactttgttgtattttttttcctccataaaagatcaagtttttgttttattttattttattttgagatagagcctcactctgtcacctaggctggaggctggcatatactggcttggtcttggctaactgcaagattcaagtgattctcatgcctcagcctcccaagtggccgggattacaggcatgtgccaccacacctggctaatttttgtttgtttgttttgagatggagtcttgctctgtcaccaggctggactgcagtggtgtgatcttggctcactgcaatctccgcctcccaggttcaagcagttctcctgcctcagcctcccgagtagctgggattacaggcgcgtgccaccacacccagctaatttttgtattttcaatagagaaggggtttcaccatgttgaccaggatggccttgctcttctgacctcatgatccaccagccttggcctctcaaagtcctgggattacaggcatgagccactgcgcctagcctgttgcaactattttgatgtataagagaacttttaaaattttgccaaatttctgggaattgaatttaatttctgctgtataactattaccttccagtggatgatgccttctcacagacagtaaaggaaatatttggaggcaatgcagataagaaaaatctcgtggatccttttgtagaagtttcctttgctggaaaaaaggtttgtacatgatctaaatgcagatgctgctagtaataaatatctaaaactactgtgctttccttggagtgaattcctgcttactctttgttaaaatagccccctgatgagccaggcactctgcgggaacacagattatctgagtctgaacacgccagacttctccacaggtttattttggagtggaaagtatgcagaacacaaattagaaaattcaatcttttgagagattaaaatagggaaggctaccactgaatttctggaattgcttttcaggtccaaacgttatcttaaccttaggcaagctctctggccagccacacccatccctggtaaatgttgtaggacagagaccccccccagtgccctgttgccccttcctgtcatgtttctcaccttccatgccccagtaaactgttgaaaccagagaatgggtcagggaagccccatcccactcccctgaaaatatctgggagactcttggtgtagggacagctataaccaccacttttacctacagagatggtcaaagattagagagttgagagttgggtgagattctacagtagaataatagcacatcatggacagttatagacaaaaagaactagcatcttttatgtgttcgaaccatataattatgaaagcaagattcggcaaaccacatacacatacacatatgactggtgcttttttctaaaagattcagtgggtgtggtagaaaagccttcagctctggggcaaaatgaggcctgaattaaattcaggctttaccccacttcataggcaggcaaatcgtttaccctctgagtttccatttcctgaactataaagggagataataataatcacaggattgttgagaggtttgattcattcaaaaagtcattaagtaccagattctgtcccatgtgctgggatatagaaacgaacacatgggaatagaagagacagacaataaacaagcaaacaagaaactgaataattttaaatggtgcccagtgctacaaagaaaacaaagcagggacaagaagtgattggtgcaggggaggagtgtttatccaggttatcaggtgagactcctggagaaagtgacagttgagcagaggcctggatatgcagggatcggggagggaggcatccaggcagggagaagggcgatggaagggccccaaggaagaaaatgttagcagggaaggcctgcccatgtggctgcgatagagccagcaagcggggaaaactaggaggtcagtgagaagtagggttgggacagtagggcttcatcagcccagtgaaggattggggctttatttgaagtgtactttgagggccccctgaagatgttacacagaagtgacatgaaagtcaggaggcaagagagggtgtggagttcagatagacaaccgcaggtgtcctggggagaaacatttcaggatcggcttgaagacattccaggatctgcttgaagacggaagtgtcagggtgtggctgattctggttctgagcctgaccacctgaatgaagagcgatggaaagactggaacaagagtcagtttggggtagagggcagggaggctggcgggcagggtcaaaagatctgtctggatgtgttaatggtagatgcttcccaaacggtatgtaacaaatgctctatcaaccttatctcttgcttttttacattaatctaatgttagaagcctgacaattgaaaactaattaaaaaaaggttaaaagcaagctcctagtgcctcgaaacagcaatgattaatattaaacccatgtcatattttacaaatcatcaagaaaaataaagtttaaccaggttcctaagtatataagtaaactgctaaagtcataatctagtatgcatagattgtaaacttttagaaattagaaacttgaaaacctacacttttgctttggtgattttacaggtttgtacaaacataattgagaaaaatgcaaacccagagtggaatcaggtcgtcaatcttcagatcaaggtttgactttattttctttctgaaaaagtaagaatacttacttaataattactaaatcattgagaaataactacttttttctgtctcatttttttagtttccttcagtgtgtgaaaaaataaaactaacaatatatgactggtgagttgaaaatacgtatgtgtctaattcaacataaaataaacattggatattgtgaaacattactctggattgtctctttctggtattttgctttccttccagaggagaggataaattgctcctggaaccgggtgtttcttaaaacaaaatttaataatagtgttactgcaaaaaaagcttcgattatttcggttcaactgctcataaacaaaagaaggggaacgtgctgaaaatgccccaagataagaaatcagggatttaattatcattaggctgtccagaatagacttcagaaatacagtcaagcatttcttgggaagaatcaccaaaacattctgagagcaattcattgttattgtttaaaaagaaaatggtaaaactacctcaatgaaggcaaggaaaagtccttgaaatgttctgatagaatttttagtagaccagccttctagcactgattggccataacaagaccattcttggaatgttctagttggatgtagcattcagcaggcacccttagctccctgacagtggaaacatgacaaatatcgttaccatcatcatgatcatcacaatcataattatgtaatgtgcctataattgattaattcattttatgacaatggtattgagtgtagccataggcacatctcttggcctctctgtacaattgcaatttcataacttcagaataaattaccttactagaccagtgtttccaaagggtgactggaggaccatctgtatcagaatcaattgggatacacttataaatgcaaattcttagtccccactctaggcttattgaattaaaaatgtgggcaggagatgagggtgagaagtctctagttgattactaagtacaataaagtttgaggcccactagacgtgattatttctgaagtctggggtattttccagctctaacttttttttaattgttgaaatgaagacatatcttcctagatggagctctgaaccttttattttttatttttttatttttattttttacacagggaccgtcttactaaaaatgatgtagttggaacaacatatctacacctctctaaaattgctgcctctggtggggaagtggaaggtaagtcactcaacagatctagaacaagactggatacagaacttttctccagtctgagaaaaaaatgaactggggtagccacctcacagtaggtttggtttcttagaagccaaatgtgatgaacctagtgaaccatttcaatgatgttttggtgatggcctgcaaaacaattaatcattgaagtatataagtaaactgctaaaatcataatctagtatgcatatattgtaaacttttagaaaaaaatgaaatttacagtttgaagattttcagctttcttgctcccatccaaaacttctttcccaatagcggttttatgaaatttttgtgtcaacacagagagctagcaccttattttttagagtggcattgacccaagtccacccaaatataaaataatactcccttctcaaccgaatcccttggcaggaacagtaaggtcagatgccaatgaaccatgtagtcctcactccctaagataatgtgtatttggtctttactctgacaagcattgatagccaacacattgttctttctgttgttttccaaacaattttcttgagaactatttgcctatacctggcattatggttttgtgcatatgccagaaattgtaacagggaatgaaggaaagcagttaagatgataagagaaaaaattaatgttaacacagtaataccagcagcttatttattttttgagatagagtctcgctctgtcacccaggctggagtgcagtggcgtgatctcagctcgctgcaacgtctgcctcccaggttcaagcagttctcctgcctcagcctcccgagtagctgggactacaggcgcatgccaccacgcccagctaatttttgtatttgtagtagagacagagttttaccatgttggccaggatggtctccatctcctgacctggtgatccaccctcctcggcctcccaaagtgctgggattacaggcgtgagccaccgtgtccagcccaggagcttattttttgtgaccaaaacaaaaattattgtaattgccaatagattaaatatattgagagattaaacacatgaaacaaagtgagagactttgagacaaaattttatcttgggcaactcaaggttcctctcatccttaccttgtttaaggtctttttataggttttgaaaaaacattgttaattcaagcaatggataacataaataagaacctggttattatatatatacatataatactatatatacatgcatatatatatacacactatatgtatgtatatatagtattagatattagagagaaggtaaagaaggtattagagatatggtgaagaacatatagatttcctctctccagaagtgaaaaaaaaaagcaatcagaagacgaggtggtggccgggcccagtggctcactcctgtaatcccagcactttgggaggctgaggtgggtggatcacgaggtcaggagatcgagaccatcctggctaacacggtgaaaccccgtctccattaaaaatacaaaaaattctccgggcgtggtggtgggcacatgtagtcccagctactctggaggctgaggcaggagaatggcgtgagccagggaggcggagcttgcagtgagccgagatcgcgccactgcactccagcctgggcgacagagcaagactctgtctcaaaaaaaaaaaaaaaaaaaaaaaaaaaaaagacaagatggtgaccaaaggagatatagtacaattataaatgtacatggctgggcgcagtggctcatgcctgtaatcccagcactttgggaggccaaggtgggtggatcctttgaggtcaggagtttgagaccaggctggccaacatggtgaaactccatctttactaaaaatacaaaaattagccgggtgtggtggcaggtgtctgtaatcccagttactcaggaggctgaggcaggagaatcacttgaatcctggaggtggaggttgcagtgagccgagattgcaccattacactccagcctggacaacagagcaagaccccatctcgaatgaataaatgaatgaataaacaaataaatagctatatgtggcattattttaagcaaatggtagaaggtaagaaagagattccatctgaatgttctctgctgagtagcatagtgattataacactggagctgcaaggaaggaaatgtaatcacagacctttccttttctctgcagagaatatttatatggttgctagaatgtaagcactatttattgtattttgatttttaaaatttaacctatagccaaagctctgaacaaagtgtagatgtcatcacccattacagtgtaaaagtgtggaagatagagatgagaagcagaaggaggaaggggagtggaggtagggcaggggtgctaatagtctcttctcttcaagtcaggaatctaaatatgactatagatggaatcacaaaggtgaccattacacgaaataaaaatcatgctggaactatatggggggagggtaaagatgactgaaatccattattcatgagaagtcattaaataatatctaaagataattattcagaaatagtggcataagcattttgcttagtgacatggtggtaacatccagaagaactaaaaacagagattgctacaagcagttttagcttctgtctctggggcctctcattgcaggccctgcagaccatggggttacagggccttaaaataacaacgagctgtcaacatcgccctccccccgacaaagaaacaaaccatgctttcaatcaaataatgtgcaataaactccaggcctttgcttacacagcctcagaccacatttacttggattttctgatgttggtcccaactaagccgtaagataagtaaatgttttattaaaaacgtgaaatgctggtaacttcgccaggccccctctgtccccgggaagctagctcttctgcttcctggctgccttggtgctgggtgagattgagttattcatgtgtggtggttctgcccgggtcattttgcatttaaccgatgagaattgtatacattacaaaagggtcatatgtgacttgggtctgaatttgggatttttctggtgttgctaaatcacatacctggcactggatttgattaacgttttcaatgtctgttttataatgcccgtgttcttcttgtttaaccagtcatatttttactatatagatttctcatcttcgggaactggggctgcatcatatacaggtttatgcttcgtaattttgctctctgttatatcttcctagctaatattgtcttattaagaatgtatcgactgtctttagaacttttttttgacattttgctgtctcaacatagttttgctaaagtaataatttttgtgtaagtgccatacggttgtcctgcacggctaagcttaaaagaaatatgctaaccaggctttgctccatgtcccatgctttcagctaaatgcacaccatcgtatttggctttattgcaaataattgattgtgagatataacattttctgttattgtttatgttcagtaagtagagaaatggaccactaaatcaattgttctgaaatgtatcaagtaactttcccccaatttcaacgtgaatctctaggttgaaaaatactgaacgttttttactttgcaccctgaagatcttcacctcccccaaaatgagggatcataacacattctttggtttgcacagaactcgtcattttttgcaagtttgctcaatactgtcacacacttgaccatcacaattctcctagggcagatgtttttgttcccctaatagatgaagactctgaggtttagagaggttcattatctgtcagataagcatgattcgccctgccataataatctcccagggttgtggtaagaagggaaagagatattgcatgtgggaaagctttgcaaactctgaagctgtgtgcaaatataaggtgatatcatgtaattatgtaattgacacaatgcccaattcttatttgctttaaacaatctatttcattataatcagactttatatgaatattaagtagtccttagatttgcagtgaacttggcagatgtgcaagcactttattcctttatttgtttaaccaatcaatgaatatttatgtagtagtatcacatgatagaaccagtagtaggtgtttaggaaatcaaaataaaacatacttaaatcctgccactccccctgaaaagtgatactttagtcacagagatgtgcagctatgtaggattctagaaactaaaacatacagtaattatttgtaggaatccaaaacatgaaggggattcaaaaaggtaaaggaggcatggaaaatattgttggaaagtgggttgtagctaggtcagaggaaatccttgatggccagggtaaaggatttttattttattttatataggcttttcagcaaggacattgggaagtttgatgtgtccactgtgcattaaacggactaggaaactttggaggcaggaagagatttagcttatgagagaatgggttttctttttttgtttctttcttttttttttctgagatggagttttgctccagtcaaccaggctggagtgcaatggcatgatcttggttcgctgcaacctacacctcttggattcaagtgattctcctggcccagcctccctagtagctggaattacaggcacctgccaccatgcctggctaattttttttgtatttttagtagagatggggtttcgccatgttggccaggctggtctagaactcctgaacctcaggtgatccgtctgcctcagcctcccaaagtactgggattacaggcgtgagccaccatgcctggcctagagaatgggttatcccaggagactatactaagatgtgagcacatagaaggtgagttccttctgttaatgcacaatgaaacaagtcaaaggggtaacataccagaaaagagatttgttggacaaaaataattaagcccctggcattaagctgatatgcagtggatcattcttgacaatttgtgtttcaatccctggggatctttaacaaaaagcaaatacacatgacagcacagtcattcaagggaaccaggtggaggagaagtgaggttagaccaaaggaatggatggggtagtggagggtgtccttttctgagctttgaaactcaagatctggggttaaatctgccaatttgtgggacttttgacaagttgcatcacttctgtgggctttggcttgcccatccataatgtgacatgactatggtgccatagctttaacatccattcttactggaatattctgtgattcaacttcttcctcttttttttttttaaatcttttttgtgtgtgattcagcttctaaaaataacttccttttctctctgtgagtctctgctttaattctctattcgcacccaacatccctccactaaaacaaaatattctagcacacagaaagaagtccaaaccctacttattagtgatcaattaatcgtctttgcaatgttccatatgccacaatggataaagccaagccaatttatatgttcatgtataatagtcattcctcctgtttatctgtcttgaagatgataacatgattcagagaaatctctgttggagaaactgttggtccctctttgcgtttcataagagatttccaaacaagtgtgacatgtggcatcctaggctgttaccaagtctcaaccttaggctgcgtgcactagttttgtacatcttaattttctaaattttcatttaaatgtttctttttttcttgctgtcttcactgagattgctattcagctcttttctgcctgtgtccatgatttctgtctccccacaaatgtgtacacgcccatttaaacatgcagagagcttcacgtaatgaaaatgactgtgcagtatatgtctatagggttaggtaaattatttattaatgggcatcattctgatgacgctgctccacatttatctttctcccttagttttaagcatagagttggaaagggccatagatatgatctggtcaacctcatcgatagcaggaattatcctgagaacatgctgaaagataggctgaagcctttgcctcaacatttcttctaattgtccctaatgcagcctgtcccattgtttgtcatttcgaattcacagaaagttctgccttatacagagtgaaccaaagctgatctccctgtagctcccagcagtggtccttactctgcttctggagacaagtccatccctctcccatggggggccattcaggctattgaaggcaactcttatatttccccaccctcacccgcagtttccccattttcagctatttaattatattgcccttagtgcccttcattgaggagttgtcttgctaagaccaggtagcaaaaataaggagcttatcagatgaccaccagagatagaaagcaatgaatgggaatcttcatgtcatttatgaatatcacatggtcttacaaccacaggcaggcagtttattattacatataaaatttaaaaatgtcttatatttttaacagcatctgctagagttatactaactactgaagattaaatgacactttagaagaacaaataaagttcataaaatatgtcatttaagtgacttcccaaaacaatataatcttttgccccaattggcaatggcatgtttaatacaatgcccattataaacttgcaaaaatgtgaaggtcaacttcaaagtctaattgctctttatttaaatagcattatctttttataaaaataagtttatctgcgctacccccaaatgtttttatttaatattttatgtagcaataagaaaagagaaatatggcaaacctcatggtgcttacaacttgcattaatacaactaactcccaaaatggaggaaaatagtctcacctaactaactaataactaatatttatttcaatagattgaatgttaaaagcctaacacctcatgatgatgtttctctctcagtaaacacaggagaaacagaggtaggctttgttccaacgtttggaccttgttacctgaatctttatggaagccccagagagtacacgggattcccagacccctatgatgagctgaatactggaaaggttggtttctcaattaaggtggttattaatcagcattggttaaggtgattatttcttcttataatgtctgatcaagtattgcaggatagaagtttcatactccctaagacttagaatgcaaagataggaaaagactgtggagatcatctcactgggggatggccaatggccaatggccatttcccccaacttctatgcttatggtagacatcaataatcaatgctggctctctttcctaataagcccctgggctgccttggaattcttttcaacatcatattccaggaatttaccaagcactaggcagtggcatgccccctgaaaccctttattacccttgatctgatcaatcctttcatttcatagatgaagacatggaagcccagagatgggagatgctctttttaccacaacagaagccaaatgtcttttaggttatctcccaaggctcaagaaagagaccaagctagagagaaaaagccctcagaggggaagggtaaaagactggctgtggaggtggggacccttccgtcctttccagaaggttctattgccagcactgctgggtatggtgggagaagtatccactcttcatcctcaggctcagctgcacccagaacttcttcctcctacatcttcctcctttacttcctggctattctgagacttgccctggttgccagcatggcagcctccctattctgagaagaggagaaaagcagccaagttaacccagataaatgcagagcttccctgctgaagtacggtgaagggagacttagagccccatccaccccccaccccccacctcccagcctccacaaactccttctggagctagagcatggtttgaagacctctgaccttggtcacagctaagatctttttcagccctagcatcccaaggtactctttgagatctgtcctaaagccaatggctctctttcaaacaccagagacctgaatccagctgggagagttgccgactgattcatttcgaaggttagggccatgggaaggagaaactttttgcagttgtattagcctgactagagacacagaattctttttgctgttgctgcctagaggaataatcctggattattgcctttcagggggaaggagttgcctacagaggcaggatcttggttgaattagccacttttcttgagaagacaccaccagataaaaagcttgagcccatttcaaatgatgacctgctggttgttgaggtaaatgttaaagtgtgagtaatgcatggtatagaaaaggagacctccagggactgaaggggtagctgggggagtcggaaggcaacccaactcacaatgaggccctcatctggatgtttctacaacagccctatgaggatcgcttcatcctttgagatgttaataccctattgaaaactggcaagaacactgatacccacaaactgaatgacctgtttgctaactggcgttgggggtcatggggaagtggccataacagccacttcttgctggcaccaagagctgtaggtgccacctctactcatttccattttcagaggtggctggtgggcctcaggcttcccagcacaggagggcaggtgtgctgagggcccacactgcaatggctgtgaaccccgcttcctccttgaagacaggaaatcttcccagttgacttccccaaccatttctgagaatccaggtcgatgcctgtgtgttccacaaatctgaatcatttgccagcacagccagctcatggatgcccctctgcccgcggccctccttgctgggttgcaaatcaccgccagccccccagctgccccaggctgctgttgccctctgttccaagcacacaggacaggccctgccctgatttcaccactttacagcagaaaccaaacagcaacttttaaaaagctttcactttcagtttttgggataagaatacgaaaatacagtaaaaagggtgacaacgtggttgcgaaatgtggctattctcaaagctcatggggtcaggctggtgttctgggtccctgacagtcagccttcctgtctactcgcagcctgtctccttgtggcaggactgggttctccatgctctcccccaaactcccgtggtacccagaacacgttttcatctgagtccaggcccaactgccgtgagttctccagcgagccagggccttctccctctagtcgtctgatgtctgcctgttacatctgccccctttgcaggatgattgacagggagaatagccacaccctttaacagaaactatcccttcttccccagagcaatgtggccttgctcattgactcccagaaggcagccgtatcaggaggttagcatccaaagcagtctgttctggattcctcagcctttacatgttgggaacatctgtggtccagtgcttgagctgcaccaatttcattcctgtctcctcctttgagaggaaaggagcaggctcctgagactgccctctctccaccccccagcctcaggaaggaacctagcatcaccacagcagcaagccacggggcatccgtgtaacttcacatggggaaaataaatagttcttccccatgaattactacagcaaagatgatcatttgttttgtttttttactaaagagacacggagccaaaagtcaataaggtcctggtcatagtctttctattccacaacattacccactctgaagtccaggaattgcaatagatcttgaggaaaaattaagaaaaggaaaaaagagggcgggagagtgagaaaagggacagtttgcatgctagttacagccaggatcatgcaaaagaatagccagaaaccacttggaggcctccgtggagacacatggtggttcttgacttgagtagttacagattggagttagctcttgaaatattggttggaattcagggttattcagaaatgccaccatggacactcaaccattatagtacctcttttatttggttccatcaccagaatgtaatttaagttcatgctgcttctctttgttttaaataaccatagttgcagggagaaggagaaagaggcccaagaaaatattttttaaatgctttattaactggaatgcaaaaccaaattagttttcttcactgcaaatagttaaacacatacaggcaaagaagcttatttcattaatttagtgtaaaagcaaaaaaaaaaaaagtcaacaatatatattgcccacagtatatgtcaacagaataaaagaacagctttttattgactggtaaaacagaattcattttctttgctctaaattaaacacagacagcaaaatagctcatctttttaattaaataaatataaatcaaaagtgaaatgaagcaaaaattttaaaaacctaacagtgttacagaataggagagaaatgaggattctgaagacatagccacacttcaagcaacaggagccccaggagagagtgaaatgagcagatctgtgcacctgccagaaggacttaacgaatgcagtcaacctacaaacatgctcatgacccttgtctgtcttgcaaaggtcctctgttctggattatgtgcagctaacaaaactttttggtaaagctaaagaggctgcaacaaatgggcaaattttttgccaaactgccaagtgctccccatctttctaaagcagagctgagctattgctcccggtgggcctggtcaagagaggctgcagtgcaggagggatgcagcagattcagcctggccacttccacagtaagaatcaggcagacagaagatcaagtgttgccaacccagtgttattctaatacccgctggcttctggaacctctgccctgccactaaaggactccattttttgtctccaggatcaagagtctgttcttggactgctttctccctgctcctctttccccattttccttggatgtgaccgaatgtattttgggagcattctatgcacttgcattctctctcctactcaactacaatctccttgagagctctcattggtctggcccacattaagggctcaaaaatattgctagaaacagcaccttcaggttcttccagctgctccatcaggtatcagctcccttcagtagacataccgaaggtggcatgctgggcagtgttcattggtacctgatcttgtcactgacctttaatgtcccatgccttgtgtgtccacagccactttcaacaactcttagcccttatcggtatcttgcttgacagaaatcacctccttttgcaaatcgactgctgaaactctactttataccaccttatctacaaggtgcactagtcactgatgatcagaaagagagccccaaggccctaaccccacctaagtccaatagactacaacttacattcttcttttttttttttttctgagacagagtttcactcttgttgcccaggctggagtgcaatggtgtgaccttggctcactgcaacctccacctcctgggttcaagtgattctcttgcctcagcctcctgagtagctgggattacaggcacctctcactatgcccagctaattttttgtatttttagtagagatagagtttcaccatgttggccaggctggtctcaaactcctgacctcaggtaatccgccgccagcctcggcctcccaaagtgctgggattaaaggcgtaaaccaccacgcccagcccaatttatattatttcattttctcttgttgtaggcagatcttgtcccaggctctgtacttctctgaatggtgtttattgttccttcctctctctacctctttgtgccctgagggcagagaggaagtgggaaaggtctgagggagcggcagaattctcagctgcctgaatcatcgagggtagcctggctctggcacaggtgagcagatggtagcgttgctcctcctggaatctgggcttgcacggtgatccagcggctccatcttcagcggcttgctcatagtgagtcccttctctgttgggaattgtgctgatggccagaagcccaaactattgcttttagggctcagactctccagggtgagggtcctatcagggattctgtgggtcattttgcaagctctgcgtgagagctaccatggggttctaatggaatcctggctatgtggaggcctacggggtagagccggcccagctgggagtatcatccccgtagttcccaccccacctccaagcctccccatgatccttctccatcctgtgcagtccctggcttaacagatggctctggcttaaataccggtcattttctcctgggtcctgactcaggccacaaattatgtttcctatttttagctctttcccttttctcctatcatcctagttggtttacaaagaagttatgctgtatgtagttatgactaatccaaataacttcctactttttcattttgacacaattcaaacccaaacccagaatttccacatcattctggaccacgggtattccagggggcttcgctgtgggtagttaagcagagctcttgacaagtagcgtgcacccccaatcctcccttatcaaggtgacagtggactaagctagggaggcttttagactcacaatgctcccgtcaaagcttcctcaggtcattcaatgtgcagctcaggttacaaaccagtgtttagagagactttttagaaagattgaggcctagaggggatttgacaaaaccctattggagggttctattataccatgtcaaaaactcctttaaccaaaatggagactctgtaatagaaggatgtccaggggttcttcaagaccacaagcttcagtcactgtcagaagttcttaaaacagtccttaaaaatttaaaaattccagccaggcacggtggctcatgcctgtaatcccagcactttgggaggccgaggcaggcaggtcacttgaggtcaggagttagagaccagcctggccaactatggtaaaaccccgtgtctactaaaaatacaaaaattagccaggtgtggtgacacacgcctgtaatcccagctacttgggaggctgaggcaggagaatcacttgaatccaggaggcagaggttgcaatgagccgagatcaagccactgtactccagccagggtgacagagcgagacacagtctaaaaaaaaagaattaaaaattccacttctgggtatatacccaaaataattgaacgcagagactgggtaccaccagagttctagaatagacacaggatgcggatcgtattgcatggcagaatgcacgggacataatgaaacacagcaacctaaaccattgcatggctctttggtaaaagaaggcacagtgcctgaagatctgtggagatatggctcataaagaaggagatatgccagctgagcaaggatttggggcaggatatggattcaagagattttatgtgcccatgaaggaaggcttgaagggctcatggtcatttctggtaggctgataggcactcaatgtggttatcgttgaccctatcttcaactctcttagtaaaccagtaatttaaaaagaaaaaggaaggtttaatttcccatttcaatttaaaataaatttacccagtttccttatttttatttacatctgacatgaaaatctttattgttatttctgattagaaaatcaatagtttagctgggtgcagtggcacgcacctgtagtcgcagctagttgggaggccagagggtcacttgtgcccaagaagtcgaagctgtagtaagccgtgatcatgccattgcactccaacctaggtgacagcatgagaccctgtctcaaaaaaaaagaaaatagagaaaaaaaaattaatgcttcattcaaaatcattaaaaatgtataagttagaaagtaaagtttgccataatctctctaccttcttcaacataactactgttaacaatttgagttatattcctccagaccttctttatgaatatgcctttatgaatattaaaatatctatttaatagatttacttaaaatatactctctttttttgagatggagtcttgctctgtcacccaggctggatgcagtggcacgatatcggctcactgcaacctctacctcctgagttcaagagattctcgtgcctcagcctcccgagtagctgagattacaggtgtgcaccaccacgcccagctaatttttgtatttttagtagagacagggtttcaccatgttggccaggctggtcttgaactcctgacctcaagtgatccaaccacctcgggctcccaaagtgatgggattacaggcatgagccaccgtacccagcccaaaaaatatactgttttttcatggttgcacatatggacctaattaagtctttttatgaaccttcattctattttatggatataacataacttgtttaacaagtggtctactgaaagacttgtgtactgttttcatttcttcccctccatttcaatcaatgctgccaggaacatcctagtgcttctatctttgctcacttgtatgagtgcaagaggaacagctgggtccaagaacattctcccctgtcatttaattcagcactaattattaggtgtagaattgcgtctcctagaaatccacatgtaaataagaacaaatggcctttcactgaaccttatgtctgctcatactttatagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggtaagattggcactaacagttctctccacacgtttacaatgggtgcaccacgggaccggaagcaagcactgtgtcttccctctggcactgttctacgcagcctatggttagtggaaaggaaaaggttgaatgaggaagagagtgtggttggggttcaggcaccttaaagactggccagacccaagaagttgcaggtcccattgccagaggctgaaccccaatgctaccctctccccacccagctttaacaatggttttgccatgtaagaccccaaggtagccactgtgctaagttctgagctccgcaaagcagctcctacccctacgaagccccaaatctttcttaggctgagtagtggaaaatgaatgggactctggatcagctactgggaaatcatgcttctggtcttcactctgttactcaccagcttgtgaccttaaccgtgtcactgaattctaaccctcagtttcttcgtcttctctggagttgacatgaggattaaatagctgtatttgaacaaagatgggtgagaaacagtccctgattttaaggagcttacattctagtgtataaaataaatcataatagaaagcaaagtatgagaacttccaataaaactgtcaacaaatggtttgagagtacagagaagggagagaggaatactgatcaaatttcccaacagtattgccagagttttaacttaatttttgtacaagcagttttaaaatgtaagacatcctaggaaacatcagctaataattcttaatcacagtaaggctctagtaccaaaccctatgtagccagctaaagctttccaagaacagaaaattcttttcttttgccccagttccaacaaaaacatttatttagaataacagtttttagggactaacatgttcagtctagcttcctatgtcatctgtattttctactaccacgttaagaaaccatctttgatgttcagatgcatggccctgaatcactaaacgatcctgagattgctgtgctcagtttactagggtgtctcagagaaaatttcagaacagcctgaatgaaaaagagcttcctagtcttcagttgcttaattgagtcaaattaaagaaccagaccacctcaagctattccccaagcctgtggattaatcagcagctcagtctgcacatctctttaataaacatgctgtctattttaagtgttcagtgttcattgacccccaatgttttataccaggcaactactattattacttgccttgggcccacaccaagccagttgttaccctgacttcatactgggaggatattagtcatcgcctggatgcggtgaacactctcctagctatggcagaacggctggtaagtttctctttttctgcatttccttttcaccaagcagggtgaattaggtattaggatggaggccaggccactataacacaagaaagtgcttagtacagtgatcaataaggtaagagcaatgtctctaggaacagtggaggtagatggtcctaagttagtatggaggttcagtggtattggggacccaggctcttacccccggttgctctgccatcactcaggagttatcattgtctgcatggtagaggcagctcactactacatctgccctccagcctgaggggagggctggtaaacagtggggagaagatgacataggcctttctcttgaagggaaggatgcagaagtcatactcttaatttctactcactttccactggccagaatccagtcatacagccacatgtgactccaacgaaggtggaaaatgttagtcttatgcctgggcaggcatatgcccagataaaaattttcttactttggaagaggggaggattaaaaaggtaggagtggggtggaacaggaactcatagtttctgccgtaatttttgtgtagagagaatggttcattccaatagcaatatgaaactctgagaactttgcagtggaaatctccactgcaggaagaggtagctttgaggaaccagtgtctgacacattccactcttgctgcagactagaggaacttcttttgtttggaggttggggatttccttgggtgaaaactgcatacatatgatatctgtgattatctgtctagttgacattggtcaactagattggtgaggagaagggggatatgtctgtgatatttctaattaagcaaaaatactaagttacttgggccaggtgcagtggctcacgccagtaatcccagcactttgggataccaaggtgggcagatcatttgagatcaggagttagagaccagcctggccagcatggtgaaaccctgtctctactaaaaatacaaaagaaattacctgggcatggtgatgtgagcctataatcccagctactagggtggctgagacaggagaatcacttgaacccgggagacggaggttgcagtgagccaagatggcgccattgcactccagcctggacaaattgagactctgtctaaaaagataaatatatacatatatatatatatatatatatatatatatatatatacacacacacacatacacacacacatatacacatatactaagttactcctatcaggtagtgctaaaatccatctggcattggtgttttgatttcaacattatgttaatattaattttttaaagatctaatctctaccagggctggaccaaaacatatggggtttcaggagtatacttgatctaaaactcgacagcaaaatctgaaatatcattttatgttataaaggcaatctgggaggataactataggtttaaattgacttaatcataactgtcctgaaaataaagttgcaattgataggcaatgtacatctcaaaggcatttgtggagaattagttgcacctgtgttctaattgtgtttgagatgctcttcagcaattttcatcctggttcttcttatcagctctctccactgaccaggctgcctaatctggacaggatggtggctttcccttttccctgattaggacttttgacagtcatggtaggctcttcctcaacttctctgttggcaggtgctcaatggaatagaaccatatgttttgagcttatcttgtactttctctgccccagtccgtaaatcgctatttctccaagcagctttttcctttgagtggggaatagcattttagaaacaaaatctgggtatacagtgctcactactactgaaatatcattgcttctaggccttctcagcaaacgaatttgcacagacacatgtatgtctatttatttctatatctatcaatatattaaaagctatgacttcataaagatacttccaattccagtccaataccacaaggtttatcctagtcctctgtatttctatgtctctaactttcttctccaacagtgagaaatctggcctttgttatcctcaatatatttactccttggttcaatcctaaaatctgtagataaaccactgtgaaaaataagcctactaattagagttcaatatgtttatgggttttttttttctgccttttaacaaagtgtacatagtcaaaatactgtgttccaaaagttacttgggttagtttagtgtaattatgttattcatctgaaatgtaattagatctgttttatttctggttatattccactttagggttccctctcctatctttgctggtttcattttatttgttttttgaatatacaaaaatatttacatgatttcacaggttaaactatatgaaaaggtataatggcataatgaacaattatcaattatttcctctcttttcaaattcttcagcaaacaaatatagaagctctaaaatcagggatacaaggtaaaattcctgcaaaccagctggctgaattgtggctgaagctgatagatgaagttatagaagacacgaggtacagtgatcttacgcctatctcagaattttcatccaggcgctcctccctgaaattctaagactgtaaatcctgtggaattgtttctagtgtttgtctaagaagtgattttgaattattcaaacttcgtaaaaagtcctcactgggaggagtgcctgaatcaccaccaggaaaagctccactttctgatttggtgccagttctcaagtagcctagggaggctgaggccccactcccagaagcacgtcccaggcagcctcaggcaagggatggggagcggagaaagaagcaagcctgagcctctgcttctcatcaacccaagaatgacccccaccctggagaagggtgacttctggctcctacggagaatgggatctgggagtggagcattgattttaccattcagaacaatatctctaattcataaacatatttttagaaaccgcccttttacttgctcttttactgaatgcctgatgaacactgtggccaagcctctgttaggcaaaaccagtagatttgacttgaaccagcggacctttcataactgattcggggaaacagctcagatcttttagcatatggaaatcaaagggggaagtgattcgttccaaactcattttaaatattggttaataaagcagtggacagggaagttccgaaagaaaagcatattgaatgctttccacaagcaaaaaggcctttattccccacactgggctaacaccctaagtcaccctgtcttcttgtgcctcctagtggtaaagccaggtaattgaaacgcaaccaaaatcaaagtactgctggggtgcttgtttaagttctgaatgttagagctgggtcctaagggatcatgtccttcagtctccttatcttgtaaatgagaaaacagaggcccaaagaggagaaatgacatatctgatgcccagagctgggtttgccaactcagcccctcttcctgccatgtatttcacagtagacatctatttgttcaaggccccaagtgtgacttttgaactaacagcttccagatatctttttgcctcagagtctcactctggggaattaacccttcaaatacaatgccgtagttatttatgaaaccaaacagaaacatttggtaataactttcatggagaaaatgtctgtgaattttaagatttgcagagcaaaccacagtcatctatttatacttctgatatgagctgtttttgaggaatcaaattggaatctttctaaactttatgtaacaggaaattcagtgtctaagggaagttgtgctaggattttcttcattgaagaagctaggtgaaattcaagtgagtggaaattctaggtaaggacactgtgaatcagagcttcgtgaacctggtggaaatcctcaccctgtgtcccaccagatgccatggtgggaggcaaggcctggcagcagaaggctaattctggctctagctcagccattctcaggaacccttgggggtctcatcacaacacatccaagttctcatattgaatggagatttggcctacatggttggttcataaatctttctggagttcatgggcccctttgagaatctgatgagatgatggtgataataaagatgacaacaagatgatgatgaggatggcaacattgtttagacgttgctatgcaactattctaaatcctttccatacagcaactcatttccttctcacaacagccctaaaaagcatgtcccacatttgaaaataggaggacaaggaagtaagtgactggtcaagacaatagaactagtaaagaatggagccacgattagtacccaggttgttggctccaaagcctatgttcatcattacatcacactacgtgttgacacagatagacacagttttctttataagttccagagtttcacagaccttcgagacccacccatagattgcttaaaggcccaggattccctaagttaagtatgcttcagctaaatggtctctagcctcccttcttcttccatcattttgtggttctgtaaaatgattctaggaagcaaaagaagggaaagccagtttctctcagctgccactgtttccatcttctttccagtgactccttgggccgtaggttaaaccctaaggcctaaaatggctttgggattttaatctccctgtattccttatgaacatcaagagaccggcaggtctgctctggcaatgccagatacactctactccagcgtaaaccaggcagtgcttgtagattcagttaggaggttgatgtggtttgcaagatggaaatccaacataaatgtatttgacagttctgaagcctaaaattaggttattcttcaaatcctctgtttctttttttcttcatttttctagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagaggtaggacttttaaactacacaaacgtcacctgatatggaagaagggctctgcgaaatggcaccaagaataggatggtggaaagagaatctactacattatcttggatattgagcagctctgacagattgtaaaaatcagggagtaactgggctgaggatgctaatgatgaatgtgattgaaatcagagcaggggaagaattttgagttggtgatcttggaaatgtcttcaaaagtggacaaatcattatcattttcatggtactgtcggagaatattttgaatggtctttgcagttcacaggattaaaatgtcagctttggctggggttgggaagacctgaatttgaaccttggttctaccatgtataacattgggcaagttattcaacctctctgagcctcagtttccccatctgtaaaatggagataaacatagcacttactagttagctttgttgtgtgaagattttaaaaagatggtgggtgtacaaatgtccatgaatgatagactggattaagaaaatgtggcacatatacaccatggactactatgcagccataaaaaaggatgagtacatgtcctttgcagggacatggatgaaggtggaaaccatcattctcagcaaactatcacaaggacagaaaaccaaacaccgcatgttctcactcataggtgggaactgaacaatgagaacatttggacacagggtggggaacatcacacaccggggcctgtcagcgggatagggggctgggggagggatagcattaagagaaatacctaacgtaaatgatgagttgatgggtgcagcaaaccaacatggcacatgtatacctatgtaacaaacctgcacattgtgcacatgtaccctagaacttaaagtataaaaaaaaatggtaggtgtaaagggcttagcacagttgagggcatacagtaagtgctggataaatgctggcctccactaacttcggtggactagaagaatgaggaagtaaggagacgactcctcctgtctctcagaaatcagagggttgggtaggtagtcatatatttgtgggtagaaatacgcttgaaaaagcacacaggattataggtaatttcattttctactttgtatgctttggtactttcacagtgttctatagtggacttaggcagtttttttataccactgtgtgccaatagggacatttgcatatccagctctggaagctggattatcttctttataataaaaaaagaggtttttgaaaacaaaattaatatttcagatttgacaaatattggatggtgagccagagactctttatcctgtaaaatatatgcaatctgtaaccttttgactgctgctggtggctttcttcaaatgatgcttgagataagatggaatattttctaagatacctcccagagaagagtaggagggacttttgctaggtgaagctgcgcctctgcttctcgcccttccctttggccagccacagtctgcctcccagccctgcaaactcacagtgcggtcctagaagatgggagctcaggaatttgagacagagccctaaccacagcgtttctttgctaaatgaatccctgagggtccagcctgcagggtcttcagtccctctccatttagactaaccatggctgtgcttcctcttccatccaatcctcatgaccagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaaggtacatatcttcactgtgtcatgtgaaacacactaaatgcaaaagctgtattcctgagaagggtctgctttatatcatttgcaaatcattgaatggtaagggtgattgggatcaattctagcccatcctggtccctctctctggggcaataattctgagagagagtgatctgaggttggccagctttcaatcaaggacacctccttagatgtctttgtgacattaatataaacatggcattgtgaatgctttgctttctggcatgaatatttcacttctaatatttcacacaaggcaatgcctttcttcctttcattctagtgaatgttggggaaagaaagagaaagcagtagggatggttcatggaatctgttgctctaacctaatgagcaatagattgaatcaatttcaatttgatgaaccaatcaaattgaacatttttgacaatcgtaactttagggaagagattctgaatacttttagagtcatagactctcttaagtgcctgacgagagccacaggccttctcctccagggaaatgcacactgcatgttcagctaatattttgcatagaatttaggagcttcatacaacccataagcctgttccagggccccgtattgagaactctgtgtgtgtatatggggaatcaaaggtgagcctagggccgaaacaaagaaatcagaatagttcccatctatatgttttgacgtcatctctctggccaaccccaactggagttctttgcatttgggacagagaaataacaattaagaagagaaaaagcagagttggagagagtgttctcttcaaacaaggagattctgctaacttttaataaatttactcattgctctttaatcaggagggtgtaaatagaatcagagtgattatcttctttcaagtgtctcttggtagaataaattttacttaagatagaaccacaattataattgacctcagcagtgggtggaagcaaactgattaataaataaagcttcacagggggtgggagaggagacaaaggcaccttctctgtgttaggttttagaagttagtggataaacagcaaaatgcttttaagagaatgttttgtatatttattgattttgttaatactcattacacagtttagggagctgtttaactcatgagtttttttggtcttgagatccctttatactttaaaaaaaaaggttgaaggccccagagagctttggtttatgtgggttatacctatgaatatttactataatagagatcgaagctgataaatttttaaaatatttattgatttaactgtaacaataacccgttactaacataaattacatcaattacatatttaatttaaaatgttaataaactacatatttttacaaaatacattttgtgtaaaaaatcagaaagcagagtgagactgttttgcatttttgcaaacttctttaatgtcttgctgaacagaaacataactggattctctcatcttcttgtgcatttaagctgatggaattagttatttggttgaagtatatgataaggatctggcgtcacatagatatgtagttggaaaagggaggagtattataataaccttttcagataattatgaatattcatctttgatataacactaaactcaagtggtagcttttaaaaggttaattgcagtgtgacatctgaaaccatatcaatgaatttttcatactcagctacgttaaaatccttggtctttcttggactttgaatgactcttttattcatgcatgattttgtaacataatgtacaatcatttggaaaattcactgagttatgtagatcactgagttatgacacatttcatcatacaatattgaaaaaaacacactttgaaatcacatttgttaatatcacttatcagaaagtctatgtgttgggaagctatcaaacttattgttacagattcatgttttccaacactctattattttacgtgaaagctggaattttgtcatcaccaacaaataaagagttattttccttggagtgagaggttcactttgtttatgtttaaaaaaaaaatccttgccccatactcaaattggaataaccatgtttacctgtcaatcgcagttttaagtaaaagtgatatttcatttttcaaaaatctagttcaacttacaactcaaaaaattgcacaagagctttttctcaagacaaccatcatatgccaatatgcagcagaagtgcttcgcatgtacttcccatctcatcacacaaaatattaacaagacatgtattcaagggtcgagatttaataagattggtaatcttggctgggcacagtggtgtacgcctgtcatcccagcactctgggaggctgaggtgggtgggtcgtttgagttcaggagtttaagacccaccagggcaacatggcaagacccccgtctctacaaaaaaaatacaaaaattagccaggcatggtggcatgcatctgtgatcccagctactctggcagctggggagggaggatcgcttgagccctggaggtcaagggtgcagtgagccgagattgagccactgcactccagcaacagagtgagactctgtctcaaaaaaaaaaaaaaaaaaaaattagtaatcattactgcttgatcaacagaatccttttatttttatgtttttgcacataaaaagggaaagataattctttagtgaaactggaattttgtttctttactgagattgctgttattattactattacttttactgttactactaggtccagtttggcaatccggccttgattcctgctacagtgcaggagttttttccactgttgcttttgcaccaccagtgcaagtgtcaatacagtaaagaagataaataccatgttagtgttattagaaaaattgttttgaccttgtggacctcctgaaaaggtctcagggacaggcaggaatctatggatcacactgtgagatctgctgctttaattgtgattttaatctttgctgtagggtcatctggaaatgttttaactgaagcaaacataaaattagactggtgaaagcaatgattagatgttccctctgtttttggctttaacttaatgtcacagtctttgctgtgcctaatgtaacatcacatgctattgttcatctcacagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatggtacctttaatgatttcactatcttttcttctttggtcgggggaggggcacttttacttttcacctttatggaaaacatttacataccaaaaacaaccacagccctccttaccatcccctaaaatcccatcgaagggatcttaacctaagggataagagaagatgctcctgagattttatagtcaacattggaacacaccatggtgattaacacttttgtgtgataattccaagagatgacttagatgccttccacttctaccacaatcttactagcaatactgaaaatgggtgtctttctagctctcaaaactagaactctgtaataatcttattggttcctgatgctgggacactaagtagagtatacacacacacacacacaccaacccaggagaggggacacttgagatgttcagatcttgataagcttacttggggtagagtgtcttaaaacccctgaagacccatttcacacttaagggaagcctcagataggcttgtccaggggcaaaaaaaaaaaaaaaaaaaagctgtctgaatacttctaaaacaatagagataatttgtaaaaccttcactgagcttaaaatccatgtagttaatgaaaagtctcattacaattaaaccaatgaaaataatgttcacaaatgtttacagctaaaagtagaattgttttgattttttatgctatttttaactcaagtgcttattgacttaaatttaccagatgtatttggtgggtctcttctgataactttcagatgaacaccactctacagataggccttcatgctccaagaaatgaggtgaagactgtcatcattttagctagtctagaaatctattcctgctactcactgctatacctgacaactggttcaggattgtggctctgatctgcttgctaggcaagacaacccttgaccatcttttatttttactttttattcattcagcagttcctggcacataacaggtcccaatacctgtttattgaatgaataaataaatgatgacaatttatctgtcctactgtccacccaaccattcattcctccatccctccatctgtccatcggagcttttagggagtggtggcttcatgctaggcactgagccaggtaaccagctgctgaagatgatgaagaagccaagcctggtcctcaaggatctcacaatctattgcaatgattgcaaaactaggtctcttgttaagcatgcagactcccaggggcaccctggggattctgattgtgtagcttgggttagggattagcagcagtggtgattccaacatggggcgagagtggggaccactttaagaaacagtagaatgtgtgggaaacatacaagcccttgcagctcaggcttagaggtgctagtgaagatagagggtgtgctggaggccactagggaggccctgaatggaggatgttgatgtccagccagctggattgtgtggagtaggggcttcatggcataggtaaggagaggctcattcctgccttcctgtaggatttcttggcatctacctgccctccagctctgtggctgggtctaaactggagaaagcagccctgagcaatgatcgaccagcccagggcttccttccactctttcccatttttggatccttccctgcatagagtgaagcctgagcttcaacttatgtagagagatgatccactcatttctgttgttctgtgtgactcacctgttgagtaccagcagaggcacattaataataatggaaattttactggctcttgccttcatgtgctaataatactagcacgtaattttctacaaaattcccccccacccccgagatttctgggagtctatgaggtgcttcacatgtgcttgctcatgaatacttttttcttactgtcctgccccagtcctgctgactaaagccacagccctcaaagccacttgaggctcccatctccactgctgctgataccctcttgtccatgccaagtctttgcctggattttactaaggctatgctggcttccaagcagaacaggaggaatgtcttgctctccattctgtgtccatgtcatgtgaccccaagccttaaggtcccttaggataacagttcctttagtttctgcctgaagctcatctcccctccaggctgacagccagtatctgagataagcaccattgtgtcctcttgattccaatttcctaatcaggcccccactcaaatctcctcctttctccttcagccaaaagctttcctatggcttatgcaaatcatcttctcagtggattcatcagcagacaattggaaattctagtttggatccaaacatggacacccaccacactggcaaatctctaccctttccatggttgccatgatgaagagcagaccgtcatagatttatagattctaacttggaaaggaatgccctaaaagccagagtctgccattgccattcagcctgcttcccagagaggccttggtctccttgccacattccagatggaattaaggctcataacttttaggtctaataagggctgggtattaaaggaccttcatgtttcagatgggttttttggtggactgcctgggaaatggcaacattaattgtatattgtttctacagggaaatgtgccccaagttctcagcagtagacttacaaataaattttataaaatctgctcattcataagctgaggactttcataggatttaaaagataaggttcgcgaactatcttgagccattcaaaattataatagaagcaactaggatgctatatcgctatttacaaagcacgttcgcaatcatttgcacatttaaactccagaatgactctataggagaggtagcattatcctcagatttcagatgagaacactgagtcctagaaagttgaatgatttatccgaagttgcataatcagtaatagctcaagttaggtccataccttctgagcataaagcttttttctgctttctgtagttgtctagcctaagtcctcgatgaacttgaaaatgtatgtgctagctttattttttgctctctgatggtgtttctccaattttatctcttttttaatagtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaaggtaagttgtccattttctgagtaaaaaggatagcaatgaaatctttctctagaaattgctaaatatattatatctccgtcatcatcttgataatagttatgtaacacccactgagcagaactaagtccattgaaatttgtagaaagttgaaagatgttccaccataagacaggctaatataaaaagcacctggtaactaacattttgagaaattattatgcttgactgtgtcaggcagtgtgctgggcactggcgtcatcttacttaatctttactacagccctacaagggaggcagtggcaagaaggatctgagatttgaccctacttgcaagcgaacaaggtcccccgtcacagtttcacagatgccggcacatgactcctgggttagaataaaagaactttattgcccacagcaatagcaatgccagagtattgatatttgctcgactttttcatgcccgaattcccacagagtaacatgaagagggccagatgacacttgtacacacagtggattgagttatatgagagaactctaagcttaggggacttgaattttttataatgggcagtaagcaggctggccctttgctgtgcagagagagactatcttagtgttccccatataaacatctttgagaagatagcccataacaaaggtagtcagtgcctgagctcacaagatgcgcagaaacacaagagactcgcagagaattatctcccaacaagtagtagtattatctccactttgcaaatgaggaaactgagatctagaaagattaaataacttgtccaaaggcacattgcttgtcaatggtatagtaggggctagaatccaagtctagcgtgggcacccaaaccagtactcaactattatgctagaatgtctgcaagaaatggtaggaggtatactgtaagtggatgaatttcatatatgtgaactacatctcaaaagctgttattaaaaagaaagaaaaaaataaacagtagaaggtggtaaagatggttcccctggagtctgggggacactgtagcctgtttgctaaatgttgccagtaacattagaaccagcattccctcttcttgccatcttatgacagcagccttgagttgggagggaaaaaccttgtgaagttgaattttaaggcctccaactagagtttggtctctctgttgttcatttcctgtaattgcataggcattagggagggaggagggaagagaaaatactgctctcttaagacccaaacgtgcttgcttgcatgtgattgctttcaattcaggcagcttgctctgggtggagttgggggaaattggtgagggaaaggaaaatggggtttgaattggctggaaggaaggaaggttagtgaggacagggaaagggtagggaaattgtgatagaaaaagcagaaggtcaaagcatgtcagggctggatggaatcctacaggcagcagccagggcttttattctccttttttgaggcccagagacgtgatgcccaattcatataagtgattgggactgtttgtttttttgattcctttcctgtgctggattctaggggagaatacagcagagaaaagatgcagaaacaataaagggaaaaaaaaccctcacttgagtaggtacctggcagaagacttgagtcaaagttggagcctctgtaactttcctctgcgggttgtccaaagaattccaaatccaagaggaaaattaacatggcagagagtcagtatggatttcccaaatgcccaaatggagtttggagtctgaaatgacctggtttggctgtctacctaggaactctccagaaaacttaaactcctcccttcagtttgtgttatgtagaccaagcaagccacatgtggcttcatgagaccgtctacactctgttttaaaaaatagtggggacagctcccttttcttttgaactgttagccaagagtttcattgagataaagctgagcagcccggaactgaaacagaaacatggaaggcgttgtctgtggtctctgtaagaagctgcccacaatactgttttcccagaccccatcctcattactgagaaggagcaaccttgttaatttgaggagttctttatgatttaggtcacattgttccagcaggctctttcttcaaaggaatgtcaaaagcgattagtacaaagaggaatttggagtcagaaccaacaggggtaaagcgaggagggaagtggtgccactcccagggtgtagatgcttcctgagtgttggcaatcgccgaggctgccggttacccggtctccttgggtaacttgagccctccccgccccacagcttgctgactgaggcagatgcaggtcacacggagttcactgatgaagtctatcagaacgagagccgctaccccgggggcgactggaagccggccgaggacacctacacggatgcggtgagtggcctgctccggagagaaactctcacctgtcacctctgatcgtgatctgcggggaacccagcagccacctggcttgggctttaacctctcctccgctccatcttatgttctgaagagtcttccacttatagcttaagccacacaagtgccacaataagtattttctttagaatagaaatgaggcctatttaactcgatgttggaacatggtatagtttggattgtgcaaattttttaggtaaatttttattattatctaattagggttctgttgttgtttgagggttttttgagataggctctttctgtttcccaggctggaacgcagtggtgcgatcatagctcactctaacctcaaattcctgggctcaagcagtcctcctgcctcagcctccccagtagctgggactacaggcacatgccaccatgctggactaattttttatttttttgtagagatgggttcttattatgttgcccatgcgggtcttgaactcctggcttcaagcaatcctccagcctcagcttcccaaagtgctgggattataggcatgagacaccaagctcagcctagtttttaatagtataacaaatgaaatgtttctgtctttaaaaaatccaagcagcattaaaggaaatcaaaagtagttattctccccaatccatattccactccccaaagataaccattgatgtctgttttctgttcataaacaaggatataacttcctttttccctgcctaaatagaattgtgttgcacacacagtttcatagcttgtatttttcacttaacaatatatcttggacattttttatgtcaatgcatatagatctatgagcttttaaaaaatggttgcagaatgttttattatatgtacctactataattcatttaatcccctctttctgggcatttaggtgcttttggttttgagtcgttggtttttataagcaatgtaacagtgaacatccttaaacatacatttttgtatgtttatgaacgtttttctgtagggaagatccttgcatttggttggtctaggtttaaatgcatataaaattttgataaaattttataaccttcaaaaaggttttataaattcatattttcaacaaaattacaagaagcccatttgcctaaatattcatcatcccgctttataatctttgccacatgaataagtggtatcctgttatttcaattttcactctcttaatttaaagtaaagctgagtattttttcatgtttatgggccgcctttatttcctttacttaggaactttcttttcataactctcttcatttttatgcaaacttaattcaatattttagataaattttgctaattgtatataattaacattatgaacctccagtagcatttccccatactcaaaaacatgtgtctgccgggtgtggtgggtcacacctgtaatcccagcacttcgggaggctgaggtgggtggatcgctgaaggtcaggagtttgagatcagcctggccaacatgatgaaaccccatctgtactaaaaatacaaaaattagccaagtgtggtggcaggtgcctgtaatcccagctacttgggaggctgaggcaggagaatcgcttgaacctgggaggggaggttgcagtgactcgagattgcaccactgcactccagcctgggcgacagagcaaaactctgtctcaaaaaaaacaaaaacaggccaggtgtggttgctcacgcctgtaatcccagcactttgggaggccgaggtgggcagatcatgaggtcaggagtttgagaccagcctggctaacatggtgaaaccctgtctctactaaaaatacaaaaattagctgggcatggtggcgcacacctgtaaatcccagctactcaagaggttaaggcaggagaattgcttgaacccaggaggcagaggttgcagtgagccgagattacgccactgcactccagcctgggcaacagagcgaggctctgtctcaaaacaaagaaacaaacaaccatgtgtcttgaatgttttacccattctctgatgggttctatcccatgtaacccctcataaagagagttgcaccatttcataatattaagttgaaccataagaaattgctgagattcaaccactttgacctataacaacagcaatttcacatgattgaacctagtactattccctaatagtaaaaacaaaaggtagtttaaactaatttttatttagcagttgtgaataaataaagattagagatttttctgagtgaaatggatctctaagatggtatctaagtaaaggtgtgaatgccatagttaaatgaggaactatattggaccctttgcctcttactgacactatggcttacctctcttctttgtttttatttttgttttgtaagaacggcgataaagcagcatcacccagcgagttgacttgtcctccaggttgggaatgggaagatgatgcatggtcttatgacataaatcgagcggtggatgagaaaggtaacattgtacatctgtgacctgattggggctctgcagcagggccttggttaaccaggataaagtttcctggagggaggggcctcacttctgttggtctatggcaggagtccccagcccccaggccagactggtaccagttcatggccttttaggaacaaggccgcacagcaggaggtgagcggcgggcaagtgagcattaccacctgagctctgcctcctgtcagatccgtggcagcattagattctcctaagagtgcgaaccctattgtgaactgcacgtgagaggggtctaggttgtgtgctcctcatgggaatctagccatcctccctctaccccacaaccctgtccatagaaaaattgtctcccatggaaccggtccttggtgacagaaaggttggggaccgctggtctgtggcatctgggtcatgtggtaccgtctgtgactaatcaaatgtagaatccaagggaaaggcaagtgtatggacaagtgctaagtgagcagggggtgttaagagtgaaaaacatcaggtgatggggccaactggtcaggttttgagatgcttggggatccaggatgagaatttgggagggagctggagtcaagattttctctattctaaccacaccccataacctccctgggaacatcacattcagggcccccctgacgcagaaaagagaactgtaaactacccttaaagtcttcctatgcagcaatgatgcagactactgatatagcttctgatatttgtctttttctgaaccataattaaagttaagtgaacaatagcatttggaattctcaaaagagaaaatctgattcattactttccttatgcatggtgcatagaactggcattgacccagaagatttcaaatcaattataagctcctcactgatctcgatgcacacaccagatctcagaataatcgttagcattgactgagcaatagctgtgtgctaagtatggccctaatgctttgcatatgtcattttgatagtgttaaaatactgtaaccctataatcccactttacagtggggaaattgggccataggcaggtttaccaacttgctggaaacttatttagttaacagccaacatgtggcgatgctaggatttgaacccaggctgtgcaaccgcacagtccacacgcttacctgctgtttcttcctgcctcttgaactgtgctttattcctaagtgcactcagttaccatgaatgactggaagcataaaagtaggggagaacatggccaccaaggaggcattttgaggagctggatgggaatgaggctgtattcagtttggctgaataacccagcaaagtgaaaacagccacatattcggtcatgatagtacagaacatctgagggcagggagagtgaacaaatgtttcctcgaggtttatttggtgatctggcaaatgcatctcttctgggtaaccattcacaaactctgttccaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggtaagagaagcaagggaagggagctggactggggagctctgccctcctgactacaaagtcccagctaactagccatttctgcagaaattatttgcaaatccagagcctaacactccactcaagggttctcaaagtgagcccaccccagccagcaatatcatcatcacctgggaatttgttagaactgtcccaccccaaacctcctgatttagaaatcctgggggcaggcccagccatctgtagttcagcaaaccatccaggtgattcccaggcaggctaaatgttgagaactgctacagaggtgttaaatggaaatgattttggcagcataatctagtagtggtaataggtcaggacttggaacaagatgtgtaaagattcaaaccctgacttccctttctttctcatctgcaaaatgggaataatatctatgccttttaattagggtattgtaagctttaaatggaataataataaattaaatagaacagtaacactcaataataagtggcatgtatagaagtggctttctataatgctaggtactgagtatgcatcatctatgttctgtaaggtttggattttatgctcattttatagataatgctcacagagtttaaatagacttgctctgggccaagtgtttagtaagtgacaaagctggtgctggaacccgggctaagtccaaacaggaactctctctattccacagaatgggtaactccggtaggcactatgacattatttttattagatggtgagcttctggaagcaaagatggagccacagtcatctttgtatcctccttgctaactcagaaatatgctcccagtaaataatctagtcaaataaatgagctaatgaatgaatgagtctttttttttttaatttaagttccgagatacatgtgcagtacatgcaggtttgttacacaggtaaatgtgtgccatggtggtttgctgcacctatcaacccgtcgcctacatattaaacccagcatgcattagctatttatcctgatgcgctccctccacccgccggccccagtgtgtgttgttcccctccctgtgtccaagtgttctcattgttcagctcccacctgtaagtgagaacatgcggtgtttggttttctgttcctctgttaggttgctgaggataatggcttccagctccatccatgtccctgcaaaggacatgatctcgttcctttttatggctgcatagtattccatggtgtagatataccacattttcttcatccagtctatcattgatggacatttgggctgattccatgtctttgctattgtgaagagtgctgcaatgaaaatacgcatgcatgtatctttataatagaatggtttatattcctctgggtatatacccagtaatgggattgctgggtcaaatggcatttctggttctaggtctttgaagaatcgccacactgtcttccacaatggtggaactaatttacactcccaccaacagtgtaaaagctttcctatttctccacagcctcaccatcatctgttgtttcttgaccttttaataatctctattctgactagtgtgagatggtatctcattgtggttttgatttgcatttctctagtgatcagtgatgttgagctttttttcatgttttttggccacataaatgtcttcttttgaagatttatctgttcatgtcctttgcccactttttaatgtggttgttttttccttgtaaatttgcttaaattgcttgtagattctggatattagacctttgtcagatggatagattgcaaaaattttcttccattctgtaggttatctgttcactctgatgatagtttcttttgctgtgtagaagctctttagtttaatgaatgtctctctattgtttaattatccccgtctgacagggtgagaagtttctgaaggtgcttgaacgctcttcttccacacgagggcaccaagttgaagcgggaagaacactgagccatcagttagaaggctcaggatatggtccagttctaacgagtatttctgaggttttgatcatgtttcctaacctgccttactcttggctatgtgaaatttttcactgctactatttatgttactagagggtcaggtacaagattatgcttaacctgcattttacatttatttaaagtgaaaaaatagacccaacaataattacccacatggagctctcacttctcaggtcttgaatattattccacattgttttacgtttattaaatccagtcatatttttaagattttaaatcaaacttctgccatgaaaatgtcagctgcatgaaagcaaagaccctatctcttcttcactgtgtcctcagcccctaacacgatccctgtcacacagtgggcactcatatttgtcgaatgaagagaatataacattgaaaactgataccactggtaaatcaatagttcttaagctaaaaagtaccacacgaatttgttattagttattacagaaataacatattctgatcacttaattatcagttatggcagctattagctcaggcaagacatttaaacctgggagggggcatttaatttttttcctacatatgtaaaatggagatactaatgttttacaaactatatcacaatagcaacatttttatgaaataatgaagtgaggaaacagaaagcaatttgagaaagaatccacttgcttcacccacccccaaatctgaatgaggtgcacctcctgagggtatgtccacgactgtgctgtcattgcctggttatctctctgcactcctgcagtccatcagctctgcaaggcagaggtcctgtctgtttttttcttttctgtattcctgactctagctcagtacttggcacagagtagattttgaatactgtgtatctgttgattgatcatataacctgttttatcaaaataaggaatatcatcatcatcatcgtcatcattaacatgtttacttctgttttaggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttgtaagtactaggttgccagagcgcagatcatattggtgtagagaaaatatatgagtgttggatacagcactgccaactccatagaggtccctgtaaccctggtactataagatggcaaatattaacaggttgagggaaagccacacatcctgggtgctcaatacctcgtgtagaacgaatagaccattaacacaggagtgttctaagaaatactgctgtctacacacctgctttacctagtgttttccaaatatatctgttccaggacccttgtttcaggtgacacctattcacatcccaggcacaagttctttgaatcacatcttggaaactgcaactgttcaacaaaatattcatatgtatattcataaatatacagatgtcgggggaggaaatcagaaggctagctcacaaaattagagagcaatacggaagaacatactgaagcacagtaaagaagtcgggggaaaaagcaggcaggtggaaggaaggaataggagaatggcagtgggtgatctaaaacaatagggtggtcaggagccatttcccaacagcctatgtttgtatttctgcactctgaccccacagtattctgctgctgctgctctttctcttccttatcccatccttttactccctgtttatcctctacatttttcctttttttccctttctttcagtagcagggtttggcaaacctggactggaggtaggagggctggctcccacttcctgctcggctgctttccagctaagcgacttcagggaagtcacttgctatcctgggacttattcatctttaaaaatggggtgtttgcacgataacatctttaaaaagctagaattccatttgttattcttgcctcttggttggttgatttgcttttaggcagtgtttattgacttctctgctaattgactctgttaattgacttcagggggcagacactaccgaagatggggatgagaagagcctggagaaacagaagcacagtgccaccactgtgttcggagcaaacacccccattgtttcctgcaattttgacagtgagttttgttttatttttgatttattttattttattttattttattttttcaagactgagtctggccctatcacccaggctggagtgcagtggtacgatcttggctcgctgcaacctcccaggttcaagcaattctcctgcctcagcctcctgagtagctgggactacaggcgcacgtcaccatgcctggctaattttttgtatttttgcatttcctccatgttagccaggctggtctcgacctcctgacctcaggtgatccacccgccttggcctaccaaagtgctgggattataggcgtgagccaccacacccagccagcagtgaattttaaacatgactttgtgaattccacttctgtaactcttatcttaaggaaactcttcaaatcactgaatatgatttttaaaatctcttcatgcaaacatgactttcattttcatccttgatgaaaggagtttttaaaactacagttgaaaaccatatcacatataaggtgaagggtggtcagatcactgatattaacagtctatctcatatgtgctcattctgtctagtaagcccccaaaattgaaattttaactataggaaaaaaggcaccaaaatttaaataatggttgatttcaataataattttcaggatttttggaatgagacagacctgctctacaataatattagcaaatgcttatataggtcttagcatgggctaggacctgtacatattataacttgtttaatcctcttaacaaccctgtaaggtaggtgctattattgttcccgttatacagaagaaggaaccaaggtacaggaagattaaataacttgcccaaagtcttatggcttgtaagcactagagagatttgaactcaggtagtagagctcccagaatctgtgcacggaatcataatgctctgctatctcacaagagagagagagagagagagagagagagagagagagagagagagtgaatgtgtgagtgatagagacagagagaatataataataaaaggagtatgaatattttgaaatgtcaaagaatcttttagatgttaactgtttcccagatctgatgctgaagtagtatagaaagccccgtttctatagctgctggagacccagtttcattttaaaggtctgtgatgataagcagtaccctaaattcagttagtttataacaaaggtaatgttttcctgattgatacactttgcattgagcttactgtagtattttttaaaaataggatttttgtttttaagaccgagtctcactctgtcacccaggctggagtgcagtggtgtgatttcagctcactgaaacctctgtctccagggttcaagtgattctcgtgcctcagcctcctgagtagctaggattacagacgtgcaccaccatgcccagctaatttttgaatttttagtagagacacaagttttcaccatgttgaccaggctggtctcctaactcctggcctcaaacagtctgcctgcctaggactcccaaagttctgggattacaggcatgagccactgcacccagcctaaaaaataagttttattttacaggaaatagaactactttgggaggccacatcatcactattctatgtgctctttactgtggggaactataatagattcaagtgacccatttatcagaaacatgtattttttccaaatattccagtaaaatagcagtttacagtgttacgcttcttgtaagtaatctttatcctgtttttttaggagtctacatctaccatctgcgctgctatgtctatcaagccagaaacctcttggctttagataaggatagcttttcaggtaaaggaaaaaaaatctacatgctacacatgattacatagcatgctattttgcttctgtgtttcgagtgaatgctctttgtcatttctaacaacaaaaaccctttacatgttgaggttatttttgcatgcttgaagcaaactgctcagtcattagataaatcatcactgaatgctttaggcaccattgctgggtcctagtaatacatagaagatacttttggtactaatagatattaattgattaagtaataagaagcaccgagaaagtgatttctcatctctgtttatatacatggctgtgttttcatccctggaccctcaggttgattggtaagttaagatcctttaagtttttttgcaggctctttcaaggtatcaaaaagatgataagtttgcccatttgcctacagcaccaggctttgagcagtttggagttcattttaacctcctcctctgcctgctccccacattcccaataccataaaaccatgaggctttttcttctcttgcactgacacccagctgcttttgttgcttcggactggttctgagaggaaggctattggcaagggacaggggaggaggggagaacatgcctgtctggggatttgagtccttgccgctgaaccatggatagttcaggctatctggggagaattccagtttgggactcaaagcccagcagagtttccctgggccttctatgaaaacacctcttaacccatttcccatttgccccgagaaatgagtgctggcagcgagctgcacttttttattccaaacggaaagtttgttaaagcatttgactgacactctcatgtgctcacatcaattttgaagcgtgttccaagcactaatatttaccaatatttgtgaatggtttccttttcttagaaatttgagcagattcaaggttatctctgcaatatacatctccaacagggtctttgaagacattttcaaatattttccaccagggggcactctatcactgaaagttaaaaaaacatctttccaaagttcttgactaaagcttcataaaactctaagcacattccttgcagtttgagatagaagaattatcatcagggcaaaagcaaagggttcatatgatggctccactgctagaaaccaagcacttttggcttatacaagagtttcaggctagatattgtgttatttttcagataagtcagcccccaggcaactgcaaaaagtttgatgaaattatttagcaaggaggagaacatggattatttctccatacataatattgctttctctccattcttaagtatagtgagacaaagttttctgctgtcacagattgtaaactctatgagcatctgagcttttccggctgctgttatactcttgagacctggaactcaataaatatttgctgaataaatcgattaccatcaacattagaaacaactataataaaaactagcatttatcagatacttcctataggacaggctctgtcccaaatagctaacattccttatatcatttcatcctctcaacaccgtgaagcagatattactttcattgcatggaggaggggatcaacgtttaggaagattattttttccctcaaagttatgcagcaggggtgaagtgtgggtgttgaccccaggtgtatctgactgcagagcctcactcaaccatgagtgcagtacttttgcagagaaaaactatgggccccattaaccttggtggggacatactctaaagagtgacctctcagtacacatcagggtctcgcttcaggtgcctctgctgcagtgccagaaccttccatggggaactccctgctccctagaaaccctatctccaggcaggttgtcagagcccactgtcattatatccagaggaaaagaatatggttgcactgagtggttctggggagttagattttagccgtggccccgttgttattctctttttctgttttagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtggtaggtcgtttagaatttctaagataacttggggatgatggagatttgaagggatgattgtcggggaatttaaggatcactttgtttctctagggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggtacattgctgtgttcttcctcatgtattctgtcagctgcttaaaatgcatgttaattctaggcactgtttgcttgaactaaagtgaggcattgacatatccatgtttgtttcacaggatggctccaaccttcccattcttccccctcaaagggcgccaaatctatacatggtcccccaggggatcaggcctgtggtccagctcactgccattgaggtatgctgctccccacgtgttactcatcaaatcaaacggatgtgactgcaggacaggaatcttttgtatagaacatagaatcctgctgcatattttcttgctatctccaacttcctttacaacttgtccaaaaactggaggtattcatgggagtagaaggcttgttgaagcaacaaggacaggtcaattctaacattcctgagggcatctaaactcctcatttactgggagccagcaggtttctgagtttttcaggtcaactggagacctgggagagggaagatggacgagaagagaatgacggtgtatatgctgagagatgggggcatggcagggaggcagagatggaagttggatgggagcagtgagcaatgttgacatgtcagatacaagctgatgaccccaacaaggtggcttgatagacagtgtctggcccactctcaagactttccccgtccagtcaagcagctgttaacaccccaagatttcccttctctggctgtcctgctaagagttctcaaaggctgaggctatcacttcgaaatgcttccatgtcagacaccgtgttaagaagtttacaggtgggctggatgcagtagctcacgcctgtaattccagcactttgggaggccaaggcaggtggatcacttgaagtcaggagttcgaggccaacccggtcaacatggtggaaccctgcctctactaaaaatacaaaaattagctaggcatggtggcacacacctgtaatcccagctacttgggaagctgagacatgaaaatcacttgaactcagggggtggaggttgcagtgagcctagttcgtgccaccgtaccccagcctgggtgacagagtgagactctgtctcaaaaaagaaaaaaaaaaagtttacaggtggtcatcaatataaccctatgacagataatacgatcagtcttgtttgtagatgagacatagggaggtgagttaccttgtcagcattgacacagctattagatggcacagccaggatttgattcctatactcttaactgcattgcttttttaggggctcaggcaggagaaagaaaggggcaaaaccactttctttggatgacctacaagcttactaggataatgttcaaattaatcttaaagactttgccagtaattaagacagaatttttccttttgaatattatttttaaagtgctgagttaccttcccctctctttaaatcgttttcatagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtggtacagtatcgattctctgtgatcacccatgcgcgttgaaatatgaaagtatgtgcctcacacacacacacacaaacacagagtttatttccaaaacctgacaaatagaaaaaccctgccttatattcagcttgtcagtgactttttccccttaaattctcccactgtagtgatgatttcttaaagcttcaaaataactccagtggcacagaaatatctgtgagcaatacttacttatttctccagtaaactttccatctattcagctatctattacaagctgttggtcaaccccatgaaggcagaatattaacccccagtcatgcatggaccagatataccccctacaactgtgcatggaccagaaccttctggataaggactggctgtctggggaaggggcagctgtgggggaaggtatatggggtgatagggccatgaccttggcagcccataactgtgccccacctccaggtgcccctgggatggcaccttctttggtccattgaggctaccctctggttgttaaagatgtgagagcatcagatccagttcacagctctccatcacagaccccataatacctggggtgagaagaggccacccagtctttccatttttaaagcagttaatttcttaactttaaaaaaaaaatctttcttttttactctattatataaataggtgacataaagacagtttcttaccttgaagtgttggaagacctagaaccttcctttccccaccccagtcattttcctgaccttgatgtctccaatacagtgctcttgaactctagggtcacgtgctttaacctcttattttacattacagaggaggaaactgaggcctaaagaggggaaatgatttatccagtgtcatagtgttaggccacaccttctataccacagtgactatgtcctaactagtgacagctgcagtgtagggcttggtgcattcttacttggtacacctcgtctttaatcctgcggggtgaacattttcacctctcttatgcccaccttggggaaaagcaagaggtaacagatttacacaaggggatgtcgctagcaagtgagtggccagagtttgcacataggtccttacaaccccaatgcccatgctcccctccctatcatgcgacagacggcgagccaccgggatgctgccagccagggtcccaaagtggttgtccctgggccactccacctatccttgtctactccccacacctccctcaccttccaagttctagtctggaatctagccttggtcagcagagatgagaaaaaccactcaggtgaccccagtttctattcctgtgtcaagccagagatagaaattcacctgaaccacataccaaatgggcccctaggtcagctcatgattccccaatcaggcattgtcaccaaagccaccaaattccatgagagggagccagggggagttgaggagaaagtagcaatccatttttacactgaatttccagggcaaagagactctcagccacagttatttcccttagaagttcagttttgtcttgaccatttctaaagtctgctcagaacttggctagtagatgaccaaagccctgggctagttagccttgtgcatgtcccctcccaggaagcagagcacagggaagagtatagggcagtgactgagagtaaagagcatgggtcagtgattccacacttacaggacacagcatgggtcaggtactattctaagtactcttcacatagagtaattcaacaatgttactattactcatgaaataatgggggcatggaagggttagccaggtagttcatggtggcagtgccaggatttgacccaggcagtctggctgacagctcacgctcttaagcacggagctccttgcctggcacatgagtaactgaactattgcgagtcctctgggctgtgtggcagagagaatctggactggtccatctggggaatttttctcaaagctgccctcgtctggtcttgagaaatgaaacctacctttgtgacccccagttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaaggtaacatgcaaggctgtgcataagtctgggggcttttcttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgtctgggggcttttcatgcatggctctgatttactctttacaaacctactcaaggtaagtcctggattcattgtctacattttacggatgagcaaactgcgtgagttgcggtgggttatggcactttcctaaggttctatcattcgtaagtggcagagctgggctggaatctcggccttgttttaggggtgggtggcatgctcgagggattcctctctgaagcgtcctgctcctgggtgaatgtaagacttcttttgaggaagtgttaagtgctcatgaatgttccctattcacctttcaacaagcagcttgcaaagcagggagagctgttcccacatcagtgatggggatgaagtcatttcctctgcctttcactgaatggttaggaagcactcactgactgccacgtgctgttctagatatctggggacagtggggaccaagaaaggcatgttcccctctcacaaagcaaaagtccagcagggaaggcaaacgaggaagtgtgcagttgcagtccagtgtgataaatatcttgatggggaaaacaggaagctccctgaccccatgaacactgagagaggaggagattttatttcagattgctttccacctgttggcctacctcattatcacatataattaatatgtaaatgatagagcagggcataatacttactttagatttccataataaataatagctagtgatacagcattttgcaattacccattcaatagttacttgcttttagcttaccatgtgctagggactgtgttaggggctgggggctacattgcatcagtgcaagagatcccagggcccctggcctcataaattagacaccgtgggagggctggaacagcctcattcggctgatccttggtggcttcaagactgaagcagatgtcttctatttaagcagctgtgtcactaactagttccattaaaactttcataagtgttagtactgattttacagagcctctgaaattcatctgctgtgtaggtctgactaagcatcctggatccctgattcagagaagaggaaaaaaatccacagtcacatttaagcaaaactctacatgtgcttattaagaaatgtcccatataaaacattttatgctgaattgacggtgcctaaaatagcatttttgataacaacaaggattgttgtaattgcaggaattgtttcatttgaggttactaaatggagagaaaccactttcctggctttttttttcttactgttttcatgagagaaggttttttggtccaaatatgtgaaatcacccagagggtacaaatgctacacgctttctctggccccagaatcacttacgtggacctgtttgtgtctattgctcaggggtgggctgggtctaaggcagactgccctggctagcaattctatgtaatcaatgtagagtgtggtcaaggcttcagagagccccagaaaaggaaaatctggtcctttcataaaaccagtgataggttaagagttgagggcacttggatggcctcatgttggaagcacacagaataactttctcctcctgtcccttgggctttgtttccatgaggagggtgaagtggagaactgatcctctaggaaagaacttatgttcagttgtgttcctgtgaccctgccctctggttgtcttgttctgtactgttggacttgtcaggatctgcaggggagcttatcttggaagtgtagagactgcttacaggtctaggggtgccacgtggatctaaaactacctcacacagtaactgatatatcacagatgctcaggaaatgtcagtctcccctcctccccgctatccccctgatggttcctccaggctctggtgtggtggttaaaacacaagctttggagtcagccaaacctaggttacttactccccaacttaccactaattgtttcacctgaagcaagtgacttgcttgctgttagcttctgtttgttttaaaatttttaaaacagggataatggcacatattctacaggactattgaggtattaagtgaggtcatgtaagtaaagtgtttagctcagtgcccagcacatggtgggtaccgaaaaaggtttgttgtttctcctcctttatgtcctgtatgtcaattgccagggtggttaaacagaaagttctgttggcttggcagagtttgttctgtctaggttctggccttctgttaaatgtcttcctgtttggtgcttcctcaataaatgggagatgtacctctcatcctacccccgccccagggtgaggctttggtatcccccacccctttagctgaatcaaatgtagtaagcccagggactactcctgagtccatgctctaacccccaaatcctgagtcacagatattctgggaattgtacataaagtcagggcatgtgtcttctccctctgcatacgctgttgagaataagggctgaataagccactgcaacctcaggcctgaaatatacaacaatccaccctgcttttcttttcctttcctttcccttctttttttttttttttttttttttttaatttaagttctgggatacatgtgcagaacgtgcaggtttgttacataggtatacacgtgccatgttggtttgctgcacccattaacctgttatctacattagatatttctccttcccctggcctctcacccctcctttcccttctttttcttatttttctcttctttattttctgtttcttaggaacaaacttcaagaaaagaagactcctttagatgtaggctctctgtatgttctcacttataagtaggagctaagctatgggaatacaaaggcatgcagagtggtacaatggacattggagactcagaagggggagggggataaaagactgcatactgggcacaatgtacactactcaggtgacaggtgcactacaatctcagaattcacaaccatataattcatccatgtaaccaaaaacctcttgtaccccaaaagctattgaaattaaaaaatgtcggttccccacttactcctgcaccctctaaagacatgtattgacacaattgttttttgagcactttctgtataggcactggactaattgtctaaaaacagtaatgaacatataatcccctagaaaatgtctaaaaccatattatgtttggggaaacgtgatggattgttggtttattttctacattcaggagttgtcctctctattctgtaagtcccatccaagaataaactctaccatccaccctatggctgttaaacttgaacttggagtagaatgttcaccactgtatttctctaagtatcttagattaagaaagtatttgtcttgcagcctcccttctgtctgccccaccatgccgggacatcgttatcgaaatggaagacaccaaaccattactggcttctaaggtaggcttcagagctgatcagtggatgctgtcagttttatcttctatgcttagatgtctaagcatttggtgaattcagtcaaacaacagtttgttgcaattataatcatcagccaatccatttattgaggactgagtacagacaagagtctaaatcttgcactcatcaacagttatgatgacattgtgtagactagtagtcttcaaccctcactaataagtcacccagaatacttaaaataaaacccatgcccaggccccacctcccaagagggagagggatctagatatcagtatgtttttaaatctcctcaaatgattttaatatgctggcaggtctgagaaccacaggtgtggacagtctgagaaagatcatttgctagaaagcgaagtctgagaagcaaatttatagcattgcaacattcagatcagagataacatgcaacacgccagattcttccccctacataaagcagaattgtttgataaatttctaatgaccatatttatcagtgtatgggacacccaggtttttttattttcactgtggttttgaagtgaagaaattggttgaaataatcactcaaggccctattttagaactagctattccagccacttctacacgaaggaaagggggcaaaaagcctcagcccagaaaaaaggaaacaccaaatatctccctgtttctcttggcagttatgatgaacattcacagcgtgttttaatgtgcaaactagcccaaaaatgcacatgattgcactttaatatgttatgtccataaacagtgccttaaaaaaaaaatctacttccatcccactgcattaaactcactaacaactggaccatataaaatatagtctccacagccagcactgtgcagcagtgtgtttgattctactctctgtgaatcctacacagtcacaaacgacaatatcaaatttccaatctcatgggccaaaactactgtgatcactttgtaaaccaccccaaatatccctaataagatagtagtagccttggcagaagttaatatacttaagatcttttctgtagatttttacaactgctctagaaaaagacagtttaagatctcgctgtataatctgcctccaggtttgccatctctcatcgtcagtcaattcttattacatgccttcagtgtactcagtagccctaagaacaactgaggaacaggagaagaataaagtcaacaagctatgccagtattttcgttcactttttaaccatagttaagaaatgtgactatgttactgtagcaacactttatgaaagttcagtttacatcatagagttaaacattgcaacatagcaggattggtgatggtagtatcagtcattcccactgtattgtaaattgctttaatcagcccgctctcctaacatctaattgaggtacactgtgttgataagaaaggctggttgaaatctctaaaaatctgagtccacttgttcatcacagtagacatcgcacatctgtacaaagtcaaatgaacaaagttgcactttgaaagagccaataacaagcttgctgatgtcctgtattacatgtatatgtaatgtacatgtaatgtgcatgtattaccacttcctcaattcaggccttgtatctgggtaaatggagggaatgcctcaaaaataactatgctgttgctgggggctggaggctgtgtctctgagtgacagtgtcacactccggaaactcatggcattactctgtgatgtccatggaaattcttaacaaatgggctgagcactatcacaagaaaagtgagaaataagtcttcggggaaaattggtcaagtgctagccagataacatggacatgtgtacatggccatctcaacaattaccttccaattccagtgcttaagcagtatgtcaacagcactcagcaaaatggcttctccagcgacagtgcatgtatgtatgataagcaaatgcatgaggctgcctgggactgtgggaccttggcctaaagacttgaattattcttacaactctttccattagtagattttggagtgaaaagtgatctttaaacaaacgtgattgttttaagcctaaaagaagaatcttctgtgccatttaatgatttgattcccattgcaagtttattattagatataataaagcaagtcacatcagttgcttccgtaacctttccacatgaactaatgatcatgtaggcatgaataaattctcccatactaattctaaagtttaaaatcagcaacttgtcttaaataatgccttttaggccaggcacagtggcttacgcctgtaatcccagcactttgggaggctgaggcaggtggatcacctgaggtcaggagtttgcgaccagcctggccaacatggtgaaaccccgtctctactaaaaatacaaaaaattagctaggtgtggtggcaggcgcctgtaatcccagctactcgggaggctgaggcaggagaatcgcttgaacctgggaggcggaggttgcagggagccgagatcatgccattgcactctagcctgagcaacaagagcaaaacttagtctgaaaaaaaaaaaagccttttaaatcatgaactattattttccttgaaatggtttgaattgtgaacaaacagattctaaaaatctgatctcaggaaccattgagaatgtaagagtactttggaaataaaatcactctctccaaaatctcaattcagctgtgatgatttaacccttaatcttgctttggtatgaatctaatagaaagaattgatatatctatctgtccctctgcctctcttggcaattgcattgtgctgaacaaaaatcaatctggaaaataccaaggggcacctacggaagcagctccatggcctctcacatggcaaccggaggaagagcccttcaggatgaacataaagttaggatctcagaaaggggtctaggcagcatgtcttcaaactgctgctgaggacgagcttggctaatgctctaacagataccagaaccacattcaagccccccttcccagttcttcattctctcatctcctggatgggccctcagattggggtgggttctccattaaaaaaaatcacatgaaaggatttggccaatggaaacttgacatcctcataataaagcagttttgatggatgagtatttatttggtgctgtaacataggcatggctggggggtacctgtatgataacattgcagtcaaacatatcttgtgacaggacagttttttgtggggaggagaattagaccaagttcggagatatatttaaggaactaaaacgaacgtaagatctggggtagggggatgagcagctccacaccctgctcctgtgtgagctgtgtgctcccgactgggaaatgtctaactccatcgaaaacatgagatgaggggcagggaaggggctacttccaagcctttcattataatactgtgtgtaaccttttgcatattttcagaaaagaaaccagtaaggtgggttcagttgtgggctcatcctgacttagaaaattttaaataatttagcccattgaaatgttgataatataaggcatgcatgaataataatttttgcttctttctctttaaacttcatgttcctggggtctccatatctatgtgacctgttatatggtttgccctcttcctcacgggacatgtgcacgagcagctgacagaaaaggtaactatggtatacattttgctacatttaagattcatgtattttctgcccagaattttttttttctttttttgagaaggagtctcggtctttcacccaggctggagtgcagtggcgcgatcttggctcactgcaggctccgccccccggggttcacgccattctcctgcctcagcctcccgcgtagctggaactacaggcgcccaccacctcgcccggctaattttttgtatttttagtagagacggggtttcaccatgttagccaggatggtctcgatctcctgacctcgtgatccaccctcataccttctcatatagctgcaagaattggagttggggccaggcacggtggctcacgcctgtgatcccagcactttgggaggccaagacaggcagaccacttgaagtcaggagttcaagaccagtgtggccaacatggtgaagccctgtctctactaaaaataccaaaaaattagccaggtgtggtggtgcgtgcctgtaatcccagctactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgaggcaggagaatcgcttgaagccagaaggcagaggttgcagtgagctgagatcatgacactgcactccagctgggcaacagagtgagactccgtctcaaaaaaaaaaaaaaaaaagtggtagcctttcttgtcccttcttcctttcccccaagaggctctactgcaggtgacattctgtgtttttttgtttgtttttttttttggcgttattatttccaaggtaggttaaaataagcaaagggggggtctgataagaatctattcttgttataaatctgagtgggaggccttctatagtttgacaatattccacaagtgactctgacatgctgtcccttctgcccaaccaaggactacccattcaaaccagagattcccaacactgtctacatattggactctcctggggaacttctgaaagcttattggatgccctggtctcaccccagactgattgcatctcctaggataggttgggagccctggtctaactgaaccatgatgcctcctgcctttcgtttcacgttttataattttcaaagctctttctcctaaagatcccatatgatttccagaacaacttttggaggtacatggaggcaggtagatgaaggcagcatgtgaatgctttgtccattgtgttattattgcattcagtggatgaagaaattgatgctcagagatgttaaacaacttgcccaagccagtacagcttgaaacataagggtatggcttataacataaaggaaggaacttgaattaaaaccagtttttccaatttttagctagtgagtattgtattacaaggcattactggctaaaagggctaagaaaatgagatagtagaaaacacatattggaggttttctttaaatttatatgtatatgtaaatatgaagtcaatagaataaaaatgtaaaaaccaacaaattaatagactgtgtgtaaaagacataagaacattatctagtatgattgtgggcattaaagccaaacacatttcatcggcccagaatggccatttcacctctagcttctgagtaggagagtcgtgaatgctttgtccattgtgcatgtaaacaaaagtcatataatctcacttttaacagggtcagaagaacctatttcttcttaactattacaaatgcattttcctgcatcgattggaaatccaggacatcactaaagatttttccattttggcatgtctttaggaggaagaaatcgtggactggtggagtaaattttatgcttcctcaggggaacatgaaaaatgcggacagtatattcagaaaggctattccaagctcaaggtacctggatctatgctgctatgggtggagaatcgacatcctttgaaactggccacaggcagagctaagaggatgactaaaaggtcccttgggtgggtgctaatgagcagggcccaggaaaacctctgtcttcccggagagccctcttgcatgagtttcggctttgccaagattccagggacttgaggacagctattgagttatggttacgtgactgccacattggggcttggaggcatctggcagatggttgggaatgggctggcaccacactaattaggccacgatgatccagtttgactcagggaaacccagaagtcatagtgctctttgcagaatgacacaagatgtcaacatgctttgttgtgtactttgaacagggattggtttcacaagctgaaaagttgaatctgtcacatgtatgcagcataaaatcacagccgtgagaacatgtatacagcaggaagacaagcgactgagctaggcacggctgactagctctgagctttctgttcatgttttgaattttctaattcttcattcaattttcagcctgtagtgtcctcaagcagaagcagtgctaaagttttcagaacagtgtatatgagaaaaaaaaactttagaatgagaaatatctggtcattgaaataattttccccatcaaagcaaaaaaaaaaaaaacccacaccttttcatgttattgtcataacctctcagtgtagcttaagaaatactagcatataaaggaccattcattcagaaaaatgatccaatgaggctgaaggatcagcctcacactccatcctccctcactccctcttcccttcctgcctgccttcttttcctcctgcctgcctgtcttcctacctttctttccttccttccttcctttccttcccttccttcctttcttctctttccttcctttcttctctttccttcctttctttccttcttccttccttcttttcttcctgccttccctcccttcttcctccctcctacctgcctcccttccttcttccttttctcctgccttcttccttccttctcctccttcatcctcttcccttcttgctttttaaactgagaaatattttacatacgataaagtgatccattcaacaagttgtgattattgtatataccctatgtgaaccaccacccaaaacaagacagaacattcccattcccacagaaaacttccccgtgtccctttccagtcaattttccactatcctcatccctcctaggagcaactgattggatttctctcaccacaaactgattttgcctgattttacacttgctctaaatggacttgtatgatttatgttttgtgtgtctggccttttatccccacgttgtagttttgagactcatcatgtggttgtgtgtattcatagtttttcccttgtcattgctgagtagtattccattgtgtggatatgccacaagttatttttccattctcctgataatgaagctgctgtgaacattcttctaccatgtgtacgtgttttcacttgtcatcagtaaatgcctaggaatgcaatctctagatcatagaataggtggctacttaactccaaaagaaactaccagacattttccaaagtggttgtatctgtctacactcccgccagcgatttgggagttccggtcgccccatccacaacctcaggcccacttgatactgtcagcccttttgattttagaccttacctgcattttaatgagaaattaagactctgttggtggttttcagatatataattgtgaactagaaaatgtagcagaatttgagggcctgacagacttctcagatacgttcaagttgtaccgaggcaagtcggatgaaaatgaagatccttctgtggttggagagtttaaggtgagtaagatgtgtgttggtcccgtttaaaatccaccttcattttctatataggcctagaataaaggacaaccagggtctagggaggggcacatcctgcagcctctgagggatgctggcattttctatataggcctaggataaaggacaaccagggtctaggtaggggcacatcctgcagcctctgagggatgctggaaggtgccagaaaggaaaagggggaggggggccagagcactcgagccatctccgcatctcttcctgcctccctgctcacgccaagcagccttgactgagccatctccgcatctcttcctgcctccctgctcacgccaagcagccttgaatcctaagatacagtctctccaagatctagttcctctcttcatcctactgcccctaccatgctttcagcaggatcatcgtgacaacttctcacttgacagtccttgtcacctttctcgtcacactcctctccagcctccatgcaaccaaatctgatcttctctctggactactgaaaggctttgcttgggttttcacagtcaagtcgcaactcctttcaaaggcagagccagtctttcccaagctacatggtcccctgcctccctccccctcacacactccaccctcctgcctgggagagcctcgcccaagccccggacacaccttgtcctctcaataagtcggaggcttgggacaggctcttcttccttccctgggtgccctttctacctgctttgtggtctgacgaagtcctactcattcttttaagcgccagctcaaatgtcactctctttgtcaagtgttccctgattgcttcgggcagcgtgactcactcctgctctgggctcccacaggtctgggttcatgcctccatgaaagcatcttacacatggaaagtatctgctttataattgcccctccctgcaaccacgcttggcaaagtcatggcagatgtgctgctgctgctttataatcctttgcctgtagcagacattgctaagggacgagaggatgatgcctgatgtgtggtctcaaatccttctcagtacagcctcccaccaagcaatcacatatggcacaagagccaaccctactgaacatcgctgtgccagacgggagtctttgagttcttttgtgggtccctagtacctggcacatagtaggtgcttattccatgctgcttgactgaataaagaccactggaactaagacctgtatgttctgaatccggcttcagtgctttctcctggttttaaggcaaaatatgtggcctctccagcaggtcttgttggctcgctccttcaaaatacaatttttgtggcgttactatatgcctagtcctgtgttaggccctggagatagggtgatgaacaagactttatgctcccctcacccgtctctagaagcccacagtctaatgaaggatctagagaataaatagattatctcaatgcagaggccagtgctgtgccaggggtgagtatggggttggatgagagcacccagaggacataccaagcccaggagcagtcagggaggtttcctggaggaagtgacacctttcagctgagatttgaaagataaacaggagtttgcctgggagtgggaggtggagtacagaggtgctacaggaaaagcggaatcactgttggtatttcgttgggtttaaaatgtaattattgttattcctatcttcaaagaatgtgcagtatttcactctttctcaccaccacctcctccatcacactggcccatgttctcctcttgactcccaatttctgctctgccctctcttctcccctgtgagctctcaaataattacttgagaatcatttcactttccctactggaaatatgcaaagtgcaatatacattatttctttcacaaaaggcagccttccatccttcaatcccacacccctggcggaggaggggacttcccaggagccctctacctgggccacccagggccctgtgagtccttctgtctctctcttttagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctggtaagagtttgggtgtggggccttctcctgtagcaagataattacagtcatcagccacaataattgtcatgttctttctttctgggcgtctgttatctcactaggggaaagatactccatcaaaacaatgtattcaggaggattgtccccatggggatttatctaagagcttgcggggggcttaaggtcccctggttcatccttctcattttacaggtgtgagccaggactccccccccgccccctgccaccacccctgcacccacacaactggctgcatgccacccaaaggagagcattgctcccttgtcttaggcacggggtgccatggcggccaccttgtcatcagctgggagtgggtgtggaggcgagctgagtctgtccctgaacttgacttcaccttgcgccctacaatgatgtaacatcccgtctattttgtcccacagtgtgacccttacataaaaataacactgggcaaaaaagtcattgaagaccgagatcactacattcccaacactctcaacccagtctttggcaggtaatatacattcttaaatgtttttctggccttcatttctccacggaacatgcatgaagactctaatatgtgtccaaccctgtcctaggctctgaaactgtgtttgtgaactagataaacattctagacaggggagcaggtaataaatagataaacccaaaataaaagaacttcacagaagtgaagaagcttggttctgatagcttgcagggtagacagacagcattagtactagtgttataggagcacaggccagttggagtttttccggggacccccctcccacctggctgtctgcggagctgtttatataaaacatctcaaaaaaatctcgcaactctgaggtgctattattattcctattttatttttttttaagacagagtcttgctgtcacccatgctggagtgcagtggcgtgatctcggctcactgcaagctccgcctcctgggttcacgccattctcctgcctcagcctcccgagtagctgggactacaggcaactgccaccacgcccggctaattttttttgtatttttagtagagacggggtttcaccgtgttaaccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagagcaagactccgtctcccaaaaaaaaaaaaaataaaagaatgaggatttgaactcagaccatctgaccccagtgtctgtgtggcacgccacggtctgatttccatctccatgtcaaacttattagctgctcagggcagggattaccaacccgactgtacaggtgcagaaaacagggctcccagagctctattaatagaggtggggtaagtgatagagccgagatttagctagaaattctgctgactccaagccccatgcttttccaaccgccttggtgatgtttcacatttgtggcaaagccatcacctgtagaaaaatgttctctgtctgagacatttgtgaaaatgatgttttgttctcagaaccttgctgagtgagagaatactgtgttcttatttgctgcgtggcatatatttttatttctggctttattatcttgcccatatgcttctttccttctcgggtttgttggtttgtagccttacgtattctttctctgtcatgtgtcacacacacatacatgcacacacctgcccatcccccaccccccctacgccccccgcatgctgcacacccaaggccatgcacccgggccagggaatggaagtaatcctctggcaccgcaatatgatcgttttccttttcttccactgatccagccccgaggtctagacaggaaaaggcacgcagggcaggaaggagggctcccgtgagggagacagggaagcagggaaagccagctttgaagggagaaaggcaaccctgtctgaattgctcgtctcagaggagccaggcacaagcttaattaagtggcaggaaaagtcttgctcggaggcaccctggaaggaaggggtgctgtaggctctgctcggccaatcgctgtctggcggatgggcagacttcccctcatccagcagggtggagccaaggagatgccggctctgcagcccccagatggctccagtccatggcctcagtcttagggggtagctttcttctccgcagagactcttggggactctggaacaggaattcaggaaggaacaacctttcctatgtgcgtggccgttactcagagtcctatccatcatggcagatcaccttcaaaagaatatcggtgtcttccacaggatattaattgatgttccaagaaaaaaaaatattccttagtaaaaccaagacacttgggtttaaaagttataattgcaggacttctcagaacctttagtttgtccagaagaactgcaaaagaagtggttctcaaccttatttgactgaagaattctttccagagaccacatatgatttgcttcttggaagttgggattggaaatgtgatgtttgggggcacatgtgggtaaggtgcttcatgtgtcatgactcaagcaccttttctcacatctgttttctgctcaaatggatcaacattcctggctctttgggcagggaccagtccacacaccagagtgcaaggagaaggggaggaggcagagaggaggcctctcacagcttctccttcaatagaacatattgagcaccttctccgggactgtccctctgtggatagtgcagatacagagcccaaagcccaccctctagcatacatcgcccacccaccacagaagcactgtctgactctttctcttcatctcaggagtgtttgcattttcatatgggttctatagaaaagccttaaagaactggagccaagggcatacccagtgggtctgggagaagaggggagcctttggggcaccctacatatcacaccctatggtgaatcacactcactcccctcccctgtgcttctgtggggtgagtcaaagatgttccatggggcagtggtctctattgaggcagaggagggaacctaggaggggcacaggtagggggctataagtcagggtacttgtgccttactcatctctgagctgggtggaggtgctctggtgaacagctaatgggcatgtgatgataaagttaataatataatacatcattattattatactggcattggagcgatgcactcatgtcagatgctctctaaatatttcttcacttgacacttatagcgacactgatgggagggattattatcaccactttacagatgagaaaacttagcacagagaagtaactggtctagagtcccacagctggtaagcagcagaggtaggatttgaagctaggcatttaaagcccacaggtttccctgagcaagcatatgttctcttcttgttcttatttctagtatgtactatttatcaagccacccaccaccacccaccctggttatcctgctcagatgtcctccagcagccatactacacacagcctgggaattctgtgcacagagccccagtttttgtgaggtactcagatggatcatgaagattctgaccttgcatttgtttatttaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtgtaagttgctttgactgtacaagaggcactttgctgcctctgacattggcacctggggaggcctaggccctctaccttagtgccttccttcactgagccactgctcctgtcactcagttaggtatggatttcaatcgcaggattattctagggaatctccgggccacctcatggcccctattcacatcacagtgtgtgtaaaatggtggcagctggagcagtgctgtgcgctggggaatggcacagttagcagcccagagaccagttcccttgctccccgtcattgagcccctcctggatgtcaaggactgaggactggcaacgtttgatagcagggatttcctgtccttgggaaatagggattctttgtgccctctacttaattttgtgactccctcttcccctgcctggcatacagtgtctttccacagtatctgattaagacatagcttgcaatttctagtttatgagtttgcctattatgactagagtgatctcaactcctcacttttatggaggaggaaactgagggctaaataatattaaataaataaatacatttgtttctctgaggccaaaatagcatatgggtttttaggactctgaaatagatttctaggccaaagtcagagtgtagcgcagattttctggacccactatatgggagcacctaagagtacatgagcatgtatgtgtgaatctgagaagaacctgcaggctcctccgtaactccgagccacgtgatgctattcacagttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttggtgagcacctagctgtggattgtaaactggtacaaagtatagtaacccatatatattgctgggtttgggggagtgaatagacagagccagtaccctaattataccacatgagactgtgcacgtgacactaacaacagccacgtcagagttctgctgtcttgtcaagtgtcaaagtggacacattttcttgtctgctgtttcacttgccctttttagattatagccattagagctttatacaaagtactagtaatgaactaatttccatgtaatgcataattagctaaaaaaatgcccatacagtagtgcaggaatttcccttccgggtttatcccatcagttgttctgtcccttctcccagaagcttcagggatgctatggttggcttgaagagcctgctatgttcccatttggctcatgttcaagcttggggtcttgctctttcccaaccagcaatttataatccgacctgtcctgacgcatcaacagctagctacactatgacaaagactgcagtaagcatcatagagcatgcgaactgtgcttccatattttgcacgggggagggttacccagagggggcggtggcaagggcatgggatatccaggaggagctgaacaaacgtgcacaggaagaaaagtgctttctgctcctcagcttgattcgtgacattgtaaaaaacgatgttttgaggccgggcacagtggctcacacctgtaatctcagcactttgggaggtcgagtcgggtggatcatttgaggtcaggagttcaagaccagcctgaccaacatggtgaaagcccaactctactaaaaatacaaaaacaaacaaacagaagagccgggtgtggtggcatgcacctgtaatcccagctactcaggaggctgaagcatgagaatcgcttgaacccaggaggcagaggttgcagtgagctgagatcgtgcctctgtaccccagcctgggcgacagagtgagatcctgtctcaaaaaacaaacaaacaaaaaaacttatgttttgtctttccattttaaagaggacttggtatcagggatgattagatgtttaagaaatgttgatgctgcttctaacatgtgaacttgcaaacaggattggaaataaattgggaagcatcatggtctaatggttaagggtacccccaaacaatcaaacaactcccccgtcatggggattgttccagttactattgatatataacagatcaccccaaacttagtaactgaaaacaaccattttgttttcctcacagttttgcggggtcaggaattcaggacgggctcaggtgaacagttctggccgaggctggccatgagcttgtgccacaagagtatatacagaatgctcccacttaccggatctggagttctggtccctttgctattggcagtccacaagttaggtttgagcctgggtggctcatctcctgtggttgcagtcagatgttggctgaggctgcagtcatctgaaagccctgctcgggggagcagtcaggtggtccacacacacagctggcagttgtgttggctctcggctggggctgatgaccagagcacctacacaggcctttccagcagggcagactgcagacccaggctccttacatgtggatggtgtcccccagagtgagggtccccagaaaaccaggcaggagctgtgtggccttttgtgtctaagccttggagtcacacagcatcttttctccatactccagtgtttgactacgtctccagattcaaagggaaatgacacagaccccacctcttcatgggagaagtgtcaagagaatctggggcctatgtttttagaatatcacagtggtggccagatacagtggctcacacctgtaatcccagcactttgggaggccgaggagggcagatcgcctgagcccaggagttcgacaccagcctggccaacatagtgaaaccctctctctactaaaaatacaaaaattagctgcgtgtggtggcacatgcctgtaatcccagctactcgggaggctgaggcacgagaatcgcttgaacccaggaggcaggggttgcagtgagccgagatcacgccattgcactccagcctggatgacagagcgagactgtctcaaaaaacatacaaaaaacccagaataccagtgatgccagctgctgtaaaaactgaacctccaaatttccgtgttctaacacaaaaaaagtttatttctcattgattctaagtaggtattcctccaggtgggtagctgtcttccaagcagtgctccatgaacccaggtccctgccgtcttctagctctgcagttcttaagtgcaggagtctgaggctgctgttcctttttgcagccagaagaaaaaggcacatagagactcctacccaggagggatttatgggccaggtccggaggagatacacatgtcacttctacccatgttaccctctggctgaacttggtcacatggcctcctctaactgcaagggaggctgagaaacaggcaggccatgagctcgtgccacagaagtaaatatataacgctcccacttacccgttctggtgtcctggcccctttactattggcagtccacaagttaggcttgagcctggttgggacagggctcctggtcagaagctctttctgtcaactcttccttcacaagtcaaagtttgcatgttggcactgcctgtccattttggcaaagtctgggatgaagtgctggaagcagctctaggcaatctggctgaactattcccaaatactcattcctgcttcaatgctgctttccattgcagaagccaacaaaatcctgcaccagcacctcggggcccctgaagagcggcttgctcttcacatcctcaggactcaggggctggtccctgagcacgtggaaacaaggactttgcacagcaccttccagcccaacatttcccaggtaaagggccttccctcccttgaagaccattatccctgccccaaatgcaatggcagtagttgacatttttgcgccttttatcttctttgaatactttgagatgcacagaaatagaaatgagactcaaattagcgtcatatcaaaagggaatttttttgtaagaattttcaggtaactctctaaatctagataggagattggccatgactcagaacaaaccagaaccagggtctctctgtgtctcatctgtttctctgagtctatttcatctgccctcttgctgtgatcaccttcctatgagtccagatattacagagagtccttgagtgcttgtgtgttgtaatgcagccccatctacttctaaatgcatagggatttgttgcccaaacttggctcctttgcccaccatgggaccactgagctccagcgaggtgggcagggtctgggaaagtgattgagctcggcccagttcaggaggtgccatctgagactacagtatcagggaggcgaggaccatgtggatagcaatgggggacattccactccagaagatggagagcagtttccacagaagcaaagcaagacatggccactgacaaaataatctatgtggaagcttgttataatgaagatgtccaggccatgtctgcagagatttggatccagtaggtctagggtgggtccaggaatctgaattttaacaagtacctgaagaggttctgatcacactttaagaaatattaatctaggccgggtgcagtggctcatgcctataatcccaacactttgggaggtcgagacaggtggatcacgaagtcaggagttcgagaccagcctggccaagatggtgaaaccctgtctctactaaaaatacaaaaattagctgggcgcggtggtgggtgcctgtaaccccagctactcgggaggctgaggcaggagaatcacttgaaccagggaggtggaggttgcagtgagtcgtgatcccaccactgcactctagcctgggtgacagagccagactctgtctcacaaaaaaaaagaaaaaaagaaatattaatctaatggatgcaaatattgttgaccctgacagcaaaactatggacacgctgattgcaaaagggttggcctgggctttctaggttgttttgtcacttccttcttgcttttattttgttctacatttccatttcttccttttcttactcttcctttcaccaaagaacttattcctccttctttctctcctctcaccccttagccatatgaggagtttcaagaaatgacagagtgaggaagatttctccccgggaatccacaaacccccatcacttctgcctccagcattagccacagactgtggctgggtttggggagacactggacgcctaatattctgtagagtgcttgatgaattgtagagccctgagccctagagattagttgcaggagagtcaggatcatagtaaaatacatccttttcaagagctccacttaatgtattttgatcacaatgcattaggaagccaatctagtggtttccttggcaactttcttgaagatcagtttgtttttgtctgaagacagagtctacagaacactcaaaaacagtttgaagaatataaattggtttgtacggttgatatagttttttcgtggcattcctgacctgtctggaagaacattcgagtcagatggatgggccaagtctgtgtcagtcaaagagctgagcaggacctcaccaagatggagcacaaatgtcagtctaggctttcacctccccttcctgctagccacttacctggtggtgggcactaatgaaccaatggccaggaatccttaccttttgggaactgtaatgttatcattgtttgagctcctcttttgaaaatgccatgttgtttttcttttacaaaattaaataccattttcactaattgcattcattactttgattttatattttgaggtaagtagagaaacccttgggtatggcaaaatggggattggtgtcaggtgggcaatgtgatggatagaatgacagcctgagaactgctaaaggcgaaggacccaattttaagtcattgtaagaggggggatgtgcgcgcacgcgcgtgtgtgtgtgtgtgcacgtgcgtgtgcctgcctgtgggatgtgtatgttggggttgggttagtgatgggaagtctgcagttttattaaccaggcgagacccagactatgatacaggtgggcatgtgcagccatcagagacccctgagtgagaatggaaagtgggtggcctaaatgacattgtacataaaagattaaccttggtttgctctcttccacttcttgccttccatgtggactaataaattagagagaccaaagaaatagtttcatctaagaaatatgaaagaaaattgtgacttctgctacccatcatataacttcagtcctcttttcattttcaaatggtttagggaaaacttcagatgtgggtggatgttttccccaagagtttggggccaccaggccctcctttcaacatcacaccccggaaagccaagaagtaagtcagtcatcctgagaccctgatacatacactgggctggggacttggtccaggaccagaaaaaaaagtaccttccaactgtgcttcttgcagatactacctgcgtgtgatcatctggaacaccaaggacgttatcttggacgagaaaagcatcacaggagaggaaatgagtgacatctacgtcaaagggtaaggttagcatgtgagagactttgccaagctcagggaaacagactctctccttcgtgagttttcattactgaatatgcccaagataggattcttggttttttgaggttattttatctcattaatgtgatctacttaggtagctcctggaaagcaaaggagagagagcaagacctgtacagactttgtttatgaggaaagctatataaggattataagaactgataaatatttctttgtttcctttttgacaaaatggattttcttcagtttcttaagcagatgtattatttctgggacgttttagccatgtagtttctttttattcctctttgataccctgaataactagccttagaaacacaagtaaagctcccaaaatttcattttctacatattttattaccagcagcccatgtctatggaaaagaggaaatgttcgcagatttcaaaggaagtaatttattctcccaacctgcactgagtgccagcatccaacatgtcaagtgtcattgttgttcaatattctcttacttgcctaattcaattaaatcgtctctgtggatggctatgccttgatcatatgcctcgatcatagatgttgcgtgcagtacagcatagcgactacattctggtgctttccctactgtctgggcaaggtagttagctcgctgttcctcatctgtaaaatggtgataatgattattcttccttcccagggatattcaggtgatccagttatccaaagcatttaggacagtgcctggcacatagtattgttgctattccacgtggactgagtttgattccttgatacatgaaagataagacttgcgacatttaatatattcataaagtgagaacaaagtttcacctataatcccatgtggccttcaatcaaaactttgttaaagatataattagtatcatttaggttcactataaacagggaatgtttcatcaagttcttcattattatttttggatctcattaccattctctagggaaactaatctcagctaattatatatatgcaaatttatttgactatcataagcattattttttttttttcaaatcagggaaacaaactcaagtaattctgaacggagagaaaactcctctaatcagagaataaagctcaacttaaagtaccttgcaaaatttggaataaaaatctaaatacgacatgtgaaaagatgaatcgtgcataaataccatgcctagtgctagacacagctgggtattatattacataccaagctatacatatacatacatgcacacaaatacgtatacctataggagctgtttgacttgtcttaaagtatgaaaagatttatgtttaaaattaaatgtgaaaattcaccaaaaaaagagaggaagagctgtaagggtgagcagtctagggtaggatgatggtgacccttaggggtgggtcaggaggtgaggccaccaaggtcatggccaagagaatgtgaactctcctcagtgagttaccttaaaagttaatagtcaaaactgggcatggtggcttacgcctgcagtctcagctactcagaagtctgaggcaggaggatcacttgagccccgtagtttgaagtccaggctgggcagcatagtgagaacctggctcttgtaaaaaaaaaaaaaaaaaaaaaaaggttaatagtcaaaaggaatctttcaactcatttatctagtcagttaattgactagcaaaaaggaaaactactgcagttgattggtattaataccactactaatagtaggacttaatattttcaagtgactttgcaatctctgtggttctttgaggcagagtaacagatgtggacttcgcaatcagactgacctgggaatcctacttagttctgtcagttctgggctatgtgaccttgtgcaagttaatatattctctctgaacctcagtttcctcttccacaaaatggagatagttacgcagttgttgggaagaataaaataatgcatgtaaagtacctggttcatagaagatgataactgtgtgttaaaggtacctccattcccactctgcccctgctaaaccataatcttttcagtctgtgtgtcgaccatgtgaagggcgcacatatcattaatcttattttacagatgcgagatgaggctcagagagtttttccagccaggcctgcctcctaccatgaatctctatctatctgtggggtccaggcatcaatatttttaaaacgtccccagtcgattctaatgtgattctaatgtgcagtttcgagaaaaccatgcgctctctattgctttgacagtgtaaaatcgaatgttaccccctggtttcaaactagaagtcttcccagtagcaacaacttctttctgggcacactcattcattcattcattccttcagtaggtatttatctagtgtctactatgtgccaggcacaagcagaagaaaacttctcaaacgttaaaagttaagatgttactgaaatgaatgctcatagatatgcatgtggaaataagagctgacatcttccttgccggtatcattaatattatcatagtgaatttaagaataatttataaaaaggaagctgtaagattacttgatttgtgcttctttggtttgcttaagtaaaatatgggaaaggaaatgctaaaattttgagctaactcatattcatttaacctatcagcagtgctgaaagacactgatgagttatagttgtgaggactaaagtcatagccagcaggcttcattgtacccaaaatagaagctacattgttgatattttccagaaaatttcaccttagccctgttaactgaagtctaaagggtttcctgctttggttttaggggaatgatattttatttggccacaacctgtgttggatgcaatagagcacctcccctccataaatcacccccagctccgaagataactggaatctgcccaagaaaagtgcattaattctcctgctctttgctcccctaattactgcacaattttgcggctacatgacttgtcaatcacgtgaagctaagtctgtttgcctctgcctttcagctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagtgagctctgaaatatgccgctgggaagtgggtatcatggatcttccttaactcagaagctcatagaatgctggagctgctcaggatctcggaggtcactgagtccggctccttctcagcagagatggggaatctgccaccttgacacttgtccaaggtcacactgctaggacaggtatttgtgtcattaggaagcatgaggagcacaactttctttcccctcacatactcacatactggtggcgaaggataaagggtagaagtaacggttttgtattagtataaacaacaacccaagtgtgttctttatgtgatggggagactgatgtcttcccatgctaggcagagtcaagcagaggcccagtattaaagtgggtatccttccttatcaaacttccacatctgctttacctccctcagaggcactgccatgagggctcagggccctcctggtcttaactagttagactttcagttacagaactcaactcaaactggctgacaccagaaaaacgatgtattggttcacattaccaaaaagtccaggcttctgctggctttaagcccgtctggatcccacagtgaagtgataatgactttagaaattggtttcaccctccacactcttccccaggagacagtggcagcctcagctcacatcctgtcctccccgcaaacctcagcagaaagagaagagcgaagccctcatggggccaaccagagttctgtaattgggcctcaatgtctctgcttttgggggtcatgtgcctatccctgaaccaaccattgttgcccagggatgctctgattgtccaggctctagagttagtgacagaggcagcttctctaaaatttggggaaaaggggagtccgctaaggaaaatctgggtgctttcattccaaaaaagggggcctagaacctgcatagtcaataacaacagatgtcttctataggtgccctgttccattcctgcctccacattctgtcagcttcctcctctccccacacctgatcagaatgtaccagccaccagccctgtgtcgcattaggcctaccctctgctggccctactcagtgctaatgctgtagtaagcactattttttgtttttttgagacagagtttcactgttgttgcccaggctggagtgcaatggtgcaatctcagctcaccacaacctctgcctcctggattcaagctattctcctgcctcagcctcccaagtagctgggattacaggcatgtaccatcacgcccagctaattttgtacttttagtagagacggggtttctccgtgttggtcaggctggtcttgaactcctgacctcaggtgatccacccacctcggccccgcaaagtgctgggattataggtatgagccaccgtgcccagccagcactgttttaataccagtgggatgaacgccttcaaaggggacttttttctttttgagatagggtctcactctgccacccaggctggagtgtagtggtgcactcacagctcactgcagccttgaccttctgggctcaagcaatcctcccacctcagcctccctagtagctggaactataggcatgcatcaccatgcctggctaatttttgtattttttgtagagataaggtttcactttgttgcccaggctggtctcgaactccaaggatcaagccattctcccaccttggcctcccaaagtgacaaaggggacttttaagaggcacagaagctcaatgtgatatcaaaaatgcacactttcagatggtgtggcatcagggctgatggtggggatcagggctttaggtatggttacctttcctgtttacccacatctagggccagacctccccacaccctgtggtgcttggagcatgatcctacccaggacagtcaggcagcaacagataacagcagagtgggctgccgagcccctcagagccaggctttctgagccctgcaaaggaaaacattcctggaatatgaaaaacaacccagtaatcttccttcaaattcatgaaacactgggaaattcccttttcactggggccagaggaacttaggtgtacctgagctgtaaagatgtttagtcttagctaacattgtctgaggcaatggaggcaagaacttgcaggacacttacctagtcttccttcaacctacctctagcatgaggatctgagggtcttaagtgaccacaagcaaacaaaagccagtggtttgttttgttttgttttgtttctgagacggaatctctgtcgcccaggctggagtgcagtggtatgatctcagctcactgcaacctccacctcccaggtttgagtgattctcgtgcctcagcctcccaggtagctggtattacaggcatgcaccatcatacccagctatgttttgtatttttagtagagacggggtttcaccatgttggccaggctggtctcaaactcctggccttaagtaatctaccccctcggcctcccaaagtattgggattacaggaatgagccactgcacccagcccaatggtatttttcaaaggccaaaaatcccagacattctaaatctgcactgataaaagagcagaagtagaatctgggccccagtctccttacccccatgtaaaatgagagcatactcagacatctgtgtgggtgggagggtgggtagaaagttgctgagcagaagtgacaccccggtgggtgatactgtgggctgatctagaatgcctggccttaggaggataatctaaataggacatagtggtctttggtggggagatgagtcactctccaacccccaggtggcagcgggaagtcacactgatagggacatggcaggaaatcttctttgggaaaaacctgggacattccttcagttgcccagcttgtgatttcctggggagcctgactgctctctgtacagatagagtggaaggatttaggcccaagggagtgtcagggtgggggtgcaaaggagagaaaggccccaggctttgatgctgtcttaaggagccaaaggtgagtgtttcagagtcatcatgatcatgtttctttttgttttaggagcatttctggagtattgaccaaacggaatttcgaatcccacccaggctgatcattcagatatgggacaatgacaagttttctctggatgactacttgggtagggcttacatttggatcattgtttctaagaaactgtacttggaattagtggggtcaatgaaaacttggaagcaattctttaaatcttcaatactttttggtaatgggggcctggtggggggacaggggatacacccagtgcttgtgtgagctcttggcagtgcagcctgacagtgagtgccatcccttttcaagggctctggtgagggtcttgcaccagctcctgtctgtctgtgaagactcaagtcctgtttctgcagggggatgccacactcctacatccactttcaaaccagccactctctcctcagcacctgggaatcagctcctaccctcctcaacctgttcccaagttaccaaggtccccaacccccccgccatttctcctgtccctaggcccattctcctctgtggtaagggcactagttcaatgcacccttagcccgggcccttccctctcctggcacactcctccctcgccccccatggcactgtgctctccagattttcactctcccaggctctggtcttgtcacattagccagctctgtttctgcatcccactctatttttttatttttttatttttggagacaggtctctctgttacccaggctggagtgcagtggcacgatcatagctcactgcaacctcaacctcctgggttcgagaaatccttccacctcagcctcctgagtagctgggactacaggcatacgaaacctggctaattttttttttttttcactttttagtacagacgaggtctcactatgttgcccaggctggccttgaacccctgagctcaagcaatccttgcacctcagcctctcaaagtgccaggattacaagcataagccacagcgcccagcctcccactttttgaatacaggccttccctgaggttcttctgctctcctccaacccgccaaccaccccctccaaggatttacccactctcacctcagtggaaggtcatgcttcaactctcacctttccacaaagtatggctcctaaaccaggacgtgtagcctgcgctctcatagtgcctgcagtacagtcaaaggaaatcgttgtgagggtcattcctgattcctggccagaacctcccacctttatatctggctggcagtgagcctgtactgtgactgaaatctcactcagcatttcttccctgacctcacccctgctctcctcaggaacttatttagcagctcacaacccctccatttccccagccacccaggcgaaagcacccggagtcctctgcggttttcctcctctcttttctccccacgccccgccagccactccattctagcaatgtcatctgttttatcacgcacacttattttcttagtcctgtgatctctgccacttgccagttgaaactcactttctgctagccacatgttacagtagcccctgactggtctccctgtttccacgctgcttccaggagtccctcctggcagaggaaacacccaccaaaggctgtgtcttatttatcccttttccccgcacagtacctaatgcaatggttttgactaagtgcttagttaagaggtcagcaaataaatgagtatgcaagtaggcttacataaagtatatggatagtaaattctaggataataaagggtttgcccttggctttgtttgttggcacagagtctcactctctcacccaggctggagtgcagtggcatgatataggatcactgcaacctccacctcctgggctcaggcgatcctcccaacctcagcctcccaagtagctgggaccacagacacgtgccaccaagcctggataattttgtgtatgttttgtagagacagggttttgccatgttgcccaagctggtctcaaattcctgagctcaagtaatctgcccacctcggcctcccagtattgctgggattacaggcatgagccaccatgcctggccttcccttggaatttaaacaaaactgtcagacaacaaataaagagaatgactgtgtctcaaaatgccaagtgagcacataaccaaaaggagaggggagacaaaagcagtcataggtcaagaaaggctaaggtcacgtgtcttatgggtccactatatgctgaagggtagtccctgagcctgacagtttaaagagaaaatgccacaacctccttgttgctctttgctgccactgctgaaggccagactcttgccccagtcatccatagacttgaccccacatcacagataccattttcttaaggaaagggctcacaggagttcccaagcccaaaacacacttttcccttaccgtggaagtggtactaaagagttaatgcggccgggcacggtgggtcatgcctgtaatcccagaactttgggaggccaaggtgggtggatcacatgaggtcaggagttcaagaccagcctggccaacatggcaaaaccctgtctccactaaaaatacaaaaattagccgggcattgtggtgcacacctgtagtcccagctactagggaggctgaggcatgagaatcgcttgaacccagtaggcggaggttgcagtgagctgagatcacatcactgtactccagcctgggttatagagagagactcagtctcaaaaagagtgaatgccttacatcatagaagggacaatgtgcttctccagacactctgattgaggctaggagtctcagttcctggtgagcgttttctgttgagtcatgttccttctcaagcttctgtttctgaggttttactaggagagtcttggacatgcacatttcatgcagcatcctgtgttggttttctgttttgttttttttgagacagaatctcgctctgctgcccaggctggagaacaatggtgcgatctctgctcactgcaacctctgcctcctgggctcacgcgattcttgtgcctcagcctcttgagtagctgggattacggatgtgtgccatcgtgcccggctaatttttatatttttagtagagacggggtttcaccatgttggccaggctggtcttgaactcctgacctcaagtgatctgcccacctcagcctcccaaagtgctaggattatagccgtgagccactttgcccagccagcatcctgtgttctaagcacctattgtctttacccaaagccaaatgacctctctgctcagggcagctcagaactaaaaggaaaacatttcacatccaagggccttgagttgagtggaaattgtgtctgtagatatttcattactttgagtttaaagaactctgtttatgctcatatctttgagaaagaaaacaggagatgctgtgcagtggacggctatttcttcggccattttccttcctaactggaaagactttaaatgtccaccaggctccctttctctaactcaccatttacctgttcaaaatcactgtgtgcctctctcctgacaagaacgttctgttcacttgtgaacaacagctgatccacttgaagctcatttggacttactgttgtttccttggctaggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgtatgaacatttcctggttctggttgaaaatcgtttatgccttttatcatttaggttttgccctttatccatagacttactccagataaaatgaggaagttttaaattggtgggagtttaagttatgggaacagtttgtctttgggatatgtttgcctttgtcttacaatataaggtgggagatgctgtgagcatgtgtttggagttggaggaaggtgaagaagttggaatggtcaaaaactagaagcccaggtggtttcactatattttcctttcttcttcatcagggaagttaattaatgctaggcttctagtacaatttcgtatggaaaagggaacttcacatttgaatttttctcattaaaaaaaaaaggtagggctgggtgtggtggctcatgcctgtaatccaaggcaggtggattacctgaggtcaggagttcgagaccagcctggccaacgtggcaaaacaccgtctctactaaaaatacaaaaacaacaacaacaaaaatagccagtagtggtggtgcacacctgtagtcccagacactcaggaggctgaggcacgagaatcacttggacccaggaggcataggttgcagtgagccaagatcgtgccactgtactccagcctgggtgacagagtgagactctgcctcaaaaaaaataaagaaaaaaaagagaggtggaagaagcaaggtgtgctggcattagttgaataagaaggccataaattacaagcaagttgaggaactcaagatgtattttgatctagaagcaatagtgtgggttaccatgccatatcacgaaagactacctagttcattatgcattattaaaaatagctaacatttttgatcattaattttgaaccaggcagcatgccaagtaccttacattcataatctttttaaaaacaaccttggtgtataatttacataaactgtattcatttaaagtacacaatttgatgacttttgacagatgtagacactcactgaaccataatcaagatccagaaccttcccatcacccccaaaatttccttgtgctctctctctgcagtccattgctccctccctccctggtcccaggaaaccactgacctgctttccgttacaatacagcagtttgcacataacctcacttagttctgctgacaacgccatgaagtagacattgtccccactttagcgattccaaaaacagtcttggagagatcgagcaacttgccaaagtcagaaacccagctttgtctgacttgtaagggtagaggtcatcagggctctactcagggccagggcttcccaaattgttggtgaccttgctgcctttcctggctcttagaaagtctgttacaaagtctgttacaatcttaggtatggctcactataaaagtgggcaggtttgttgctttttttttttttggagatgaagtctcactctgtcacccaggctggagtgcagtggtgcgatctctgcttactgcaacctctgcctcccaagtagctgggactacaggcgcacgccaccatgctggctaatttttttttttttttttgtatttttagtagagatggggtttcgccatgttggccaggctggtcttgaactcctgacctcaggtgatcctcccgcctcagcctcccaaagcactgggattacaggcataagccactgcgcccagccaaaagtgggcaagtttctagaccactttcactttggcctcactgttctcatttgcacatgaggacaataatagtacctttgtagggttgccatgagcattacatgagataacccatgtagaacatttaaacggtgctgggaacatcactcaggaacccgtgagcagggagaaaacattcattcactcactcattcattcatttattgagctagtgtacatggagtacctactgaatgccagccactgtgcacagtaggtgacaatgattgataggcatgaagagatatggctctgttctcttactgggagcctacaataatgctcaataaatgttagatattgttattagtggtattcaggttagtctgggtccaagtgaagttacataggaaggtgtgtggggagacaaggagaccaatgtgagaatgttagagtgagggggatacagaaaatgaaaagtagggagtgggggaagcaatttgtcctcaaagtttcccacacagagtcagttcagaaacacatggaagaggaaatgggatgaaatctcttgaggaaaattgaaggcaatctaaggattgttttacaagaataaaaatcattgctcggggaatactccttgggttgaagtaaaaatatttgtgaaacatgatgtcatatgtttaacctgctctgctttactgaaggggaaagtggagatgacattggaaatcctcaacgagaaggaggccgacgagaggccagccgggaaggggcgggacgaacccaacatgaaccccaagctggacttaccaaagtgagaggccttctttgttctcccactccccaaacacctgcaggctgagagccccccttcccattggcttaatgggatggattagcttttgtggtcctcctaatctggtatttaatagtggtgggtgggggtggagaggttggtgatctggcttcattttaagaattctcctttccaggaaaccaaagttcagcatcttaggaagctgtcataggttaaagagcctttctcagtcaacgaaggggaacagtatcttttcttgaccttattaatgtgattctttattcctgaaactgtgttatgctctggaataaaatatgcatccctcctgagttgggtaggtgatactgtttctttgcaatgcagtcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccggtaggagcccttccttggccccttgtcttggctttcttgtgagttgcagttggtcctctcccttggcatctgccctgaccactgtgcagaagaatgacccgctcagcagcatggggttgtaacccttctgctttggggaaatttaaagtaatgtgtcttgtaattagaatcacattctcagggtttcacaaattacgggcagaacttttctttatgatctgaaaataactttggtttcaggaattctaggagaaatcactcaggtctcggtcagtgtgtgtctggactatggccagcgtttccagctgatcttcctgccttcagactttcttgttccaaaccatcctgcatcctaattccttgtcctagcttcaagaatccccaaatctgggttcattgtgggtctacatataccttgtgttccacccaaactagatcattgatcccaacctccccaaatattattgcccttacctatctggatgcctttgccaattttgtttctctgtccacatttatctatcaaaacctcactcattttttaaggctcatgtcacgtataacctcccccttaaatgttcccctaatcaccccagtcataaacgggagtccaagtgggagatttggcagcgtgcctagaagtagtacctcccttcctccatccagaggatgtattgcgcatctacgacaggctaggaattaagttatagtgatgattaaattattggcatgatttgtgcccaagagcagttcatattctgggaacaggcagccacgggaacaaggacacatgactaagggaggtgagctgttatggagacagaaacaaacaaccgtgggcaccccctgctaagacagttcctccaaggaggggacattcaagtttgccaagtggagaagggatagtccaggcagaggaagccatgctcagaagttgggccagtggcactgaatgtcacaggagacattcaaaagctcttactccaaaaacacattaataataatatcagctgggcgaggtggctcatgcctgtaatcctggcactttgggaggccgaggcgggtgaatcacttgaggtcaggagttcaagactagcctggccaacatagcgaaaccccgtctctactaaaaatacaaaaattagttgggtgtggtggcacatgcctgtaatcccagctactagggatgctaagataggataattgcttgaacctgggaggcggaggttgcagtgagctgagaccacaccactgcactccaacctggatgaagaagtgagactctgtctcaaaaaaatagtatcgtagccatacaagcagcaggggttttgtgtcttcatttttccccagtatagtacttctagtttgtcatctatgagtatatgtacactattatacagtcgtagctggtcaaactgctttttttttttttttttttgagacagagtctcactctatcacccaggctggagtacagtggcacgatctcggctcactgcaacctccgcctcccaggttcaagcatttctcatgcctcagcctcccgagtagctgggattacaggtgcctgccaccacaccctgccaatttttgtatttttagtagagactgggtttcaccatgttggccaggctggtctcgaactcctgacctcaagtgatccacccacctcagcctcccaacgtgctaggattataggtgtgaaccaccacattcggtcccagtccaactgtcttgaccatttaaaaaacttctattttttttattttttatttttttgagatggggttttgctctgtcacccaggctggagtacagtggcgcgaccttggctcactgcaacctctgcctcacaggttcaagcgattctccagcctcagcctcccaagtagctgggattacaggcacccaccaccatgcccggctaatttttttatttttagtagagacggggtttcaccatgttggccaggctggtctccaactcctgacctnnnnnnnnnnnnnnnnnnnntgtgttttatcaagtttctttaagatcataattgaagagaaagtacaaaaagtaacaatcaatgtcaatgcttatttaagtagaaaatgatgctatatccaagttagcaattttaaaaaaatagcaaaggctctgcaaaattttaaaagtctattgtgatatttgttaaaggctgttttaaatacagagatttcaaagacaggaaaagtcacatcagatacagcccttgaaaattacaaagaaatttcaaaaattaaaagcatgtatgttaacttttgcatccttgtttcaacttcactaaggcagctagcctaaaatcaattctgggccaggcgtagtagctcacatttgtaatcccagcactttgggaggccgaggggggcggatcaccttgagtcaggagtttgagaccagcctgaccaacatggtgaaaccctgtctctactaaaaatttaaaaattagcagagcgtgttggtgggcgcctgtaatcccagctacttgggaggctgaggctggagaatcacttgaacctgcgaggcaaaggttgcagtgactggagatcacgccactgcactccaccctgggtgacaagtgcaaaactccgtctcaaaaaaaaaaaaaaaattctattggtttaaaccagtggttactgcagggcgtggtggctcacgcctgtaatcccaccatgtttggaggccgaggcaggcggatcacgaggtcaggagacagagtccatcctggctaacacagtgaaaccccatctctactaagaatataaaaaattagctgggcatggtggcaggcgcctgtagtcccagctgctctggaggctgaggcaggagaatggcatggcgtgaacctgggaggcggaggttgcagtgagccgagatcgcgccactgcactccagcctaggcgacagagcaagactccatctcaaaaaaaaaataaaaataaaaataaaccagtggttcccaattaggggagatttttgctccccacccccaagaggacatttgccaacgtctggagacattttggttgcaacaacttgggggggggtgctactggcactcggtgggtagaggccagtgaaagctgctgaacatcctacaatgcacaggacactccccaacaagaaagaatcatctggttcaaaatgtcaattttttctcaagattgagaaaccctaactgaaaaacatatatacatacatgtttttttaccactgtttttgtttcctttccagaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcacctttacacctggctgtttgttgtaactgtgggtcaagtgaggaaggaggcatttttctggccttgttttttcagtgaagagaatgccctggcatacctcttggccatataccctttataaatatgctgcccaattttagccagtaggtcaaactgaatataacattataaataaaagctaacagttggctggacagagtggttcacgcctgtaatcccagcactttgggaggccgaagcgggcagatcacctgatgttgggagttcaagaccagcctgaccaacatggagaaaccccgtctctactaaaaatacaaaattagccgggtgtggtggtgcatgcctataatcccagctactcgggaggctgaagcaggagaattgcttgaactcaagaggcggaggttgtggtgagccgagattgccctgttgcactccagcctgggcaacaagagtgaaattccatctcaaaaaaaaaaaaaaaaaaaaaaagaccgggcgcggtggctcacgcctgtaatcccagcactttgagaggccgaggcaggcggatcacaaggtcaggagatcgagaccatcctggctaacacggtgaaaccctgtctctaaccaaaatacaaaaaattagccaggcgtggtggcgggcgcctgtagtcccagctattcgggaggctgaggcaagagaacggcgtgaacctgggaggcagtgcttgcagtgagccgagatcgcaccactgcactccagcctgggcaacagagtgagactccatctcaaaaaaaagaaagaaaaagaaaaagctaacactaaaggtacttattctgtgcacggcagtgttttaagtggtttatatgtattaacttacttaaggatgaggaagccctataaacataggtcacattctcaaccccaggtgtaagtccgttttcacactgctataaagatactacctcagacaaagcacattataaacaaaggaggtttaattgactcacaggtctgcatggctggggaggcctcaggaaacttacaatcatggtggaaggcaaggtggcaggagagagcgagcaaacagggcagatgccagacacttagcaaacaaccagatcttgtgagaactctctcactatcatgagaacagcatgggggaagccatccccatgatccagtcacctcccaccaggtccctccctcgacacctggggattacaattcagatcacaattcaagaagagatttgggtggggacacagccaagccatatcaccccatttacagttgaagaaattaagtcacaaagaggtttaggaacttgcccaaagccacacaaccaataaatggtagagctggaacttgcacccaaacaatgttaacttcttttttatataatggagttttgctcttgttgcccaggctggagtgcaatggcgagacctcggctcactgcagcctccgcctcccagattcaagcgattctcctgtctcagtctcctgagtagctgggattacaggcaccacctaccatgcccagctaattttttgtattcttagtaaagacaggttttcagcatgttggccaggctggtctcgtactcctgacctcaggtgatccacccagcttggcctcccaaactgctgggattacaggcctgagccactgtgcctggccagcttctcttaaccataaatctataccaccagtgggaggtctgtcaagaggaacatagggctgcgattgtcaagtaatgagtgacagcaacacagtgtgactccatgtcaacatgaaagacagcatgttctagaacatgtgagaacactgtcctgttatatgagagaccacagtaagatcagtaaacagctctattcaaacggcaacacagagctgaggggagtaagaaatggtacaataacgacaatgcttttagacacttagacaaagttaaaccgcaacggtgattgtgtcagtgtcattgctaagttgtttcacgttttgaatattttaattcccttcatgtcctgctccaaatcctagcattcaatacacaaaatcgctgggaggcaatgcacaggatattctccaatattgctgaatttgaatgcttatcatctcccatacaccttgtcccctcctttctcaatggcacccctgccttcattggtggaactcctgcctaccctcgatgttctggttcaaatgccactttcttttctctttgagacagagtctcactctgtcacccaggctggagtgcagcagcgcaaccccgactcactgcaacctctgccgcccaggttcaaacaattctcctgcctcagcctcctgagtagctgagattacaagtgcctgacaccacacctggctaatttttgtatttttagtagagtcggggtttcaccatgttggccaggctggtctcgaactccttacctcaggtgatctgcctgcctcagcctcccagaagtgctgagattacaggcgtgagtcaccacacccggccatccaatgccactttctctttgacaactcttgcaccccagagtgaatattcaatcttagaagcagacaaattagggctgggcatggtggctcacgcctgtaatcccagcactttgggaggccgaggtgggcggatcacctgaggtcaggagttcgagacaagcctggccaacatggtgaaaccccgtctctactaaaaatacaaaaaattagctgggcatggtggcgggcgcctgtagtcccagctactcgggaggctgaggcaggagaatggcatgaacccgggaggcggagcttgcagtgagccgagatcacgccactgcactccagcctgggtgacagagtgagactccgtctcaaaaaaaaaaaaaggagacaaattagtacaacctttctggagaaatacgtttgttaaaagttttaaaactgtttatgccctttgaaccagtaatttcactcctgagtattaactccaaggaaataatcagaaaggcagccaaggttcatgtggaaaaacgtatgttacagtgtgctttatcatggcacaaatcagaaacaacctaaatgcccacttttaggggaatcatttaatatataatgaagtcccatatgttgatgcaaaatgaaaaagaataacaattttctcccatccaagtactaacctgaccctgcttagcttctgagttcagacaagagcgggaatgttcaggatggtatggccatagacaagaacaacaattttcttttttctttttttttgagacagtgtttcactcttgttgcccaagctggagtacaatggcacaatcttggctcactgcaacctctgcctcccgggttcaagcgattctcctgcctcagcctcccgagtagctgggatgacaggtgcgcaccaccacgccctatttttttgtattttcagtacaaacggggtttcaccatgttagccaggctggtctcaaactcctgacatcaggtgatccacccacctcggcctcccaaatgctgggattacaggtatgagccaccgcacccggcccagaataacaattttctaaattttgtgactggcataggaaaatgttagcgtatgggaaatttttgaagatcataattataaatcgatttaaagtaaagtcccaaatacttgaggtacatatataaggaaatgcaccaaattattagtagtataagaaatatatgcaaagtttgtatttgtgcatatttaaataatttatgaatgtaagtcaacactggaggttcattacaatttttggggggtaaaaccaggacctcaagtttgacaaacattgtgatacttagtttcaccttgcagctatatgggcatggctcatcttcccaactgactgtaagcccccttagggcagaggtagcacctgtaagatctgtcccatgaaacagcaggcctgggtttgcatcccaggtcttgccccagcctcctccaggacttgggagaaataatgcctgtctccctggattgaggtgagggatgaatggcagcatgtgtgtaaagtgccttcacaactcccaatgcccagcaggtagctttaggcattgcatttgactggttaaagtcagatgttctggttccaaaagtataactaaaaaaaggttcttttccttttaaccgtgggacttttatacagaaaacacagactcacatatagaagggaagcaaaagcaagattaagatgtaaggctgtctcccaccttcccaagacccagaaggaaagaaggaggatcccagtttcagggggtaggaagaggtcagctcttgccactccgagcagcatggtgcaggttgctgtgtgtggggtggtagcaggaacgattgcattgttccagtggaacagaggctataattcttatttgttattcaggctccccctgtagacctctgtcttaggaggctgactgagtattgccatggccctcaagaagagcagccagctcttctgggtccaggcccccaagcacatataaccttccaattttttcaaatcatattatacctacacccaaactactactttctaacaacgtcatgtcatcttgcttagaccttaagtaagagtctacagcttttatctaataaaggagacactctaatgatgaaagggaatttaactgaaaatggcattttcttgcagaaaaagtaagcgtcataaaagaacactccaggcaagggtgttatttggaatttttaacaatcagtatggcactggcaccaaccaatcagaatagatgtgccaacctatcatggtggatacactattaaaaaaaaacacacacaaaaaaactacaacagccataccagtatgtgcaggccgaatattagccttcgtaccagggaaccctaccaatacaccctcctgcaatgactccctcaaggaagagttgctgagtggataaatgagtggctatgaggaaagtcttttccttctttgacttcatgatacctaaccagaatctactgtagtcttgtgccacataacaacgttttggtcaacggcagactggatggtataatagtgatcccataagattataatattttttttggagagaaggcctcaccctgatgcccaaactgtaggtgtataataccctgtttttagagtaccttttctacattaagatgtttagatacacaaatacctaccattgtattacattacctgcagcgtttagtagagtaacatgctggacaggtttgtagtctacgagcaactggctgtaccatagagacgaggtgtgtgcaggctgtatcatctaggtttgtgtaaataccttctatgatgtttacacaataacaaaatcacctaataacacatttctcataacatatcctggtcttaaacagtgtgtgactgtagcgtggaacctttgagtaagtagcagcaaagctttcgtaggaatgaagttattcccatggagagcaaggagctgggctttctgggtggaactcctctctctccccttctatcccccagaaaaaaaagcttcatcttgtcaaaagataatggtctctcaattgaggttgttagccacctggtgacctataaatgatagctaaaagctggaactaatcacagtccagtcagattgtcgcttcaccgtgaattaaataacacttagtcctaactgtttctagcaagtgccaccattagcgctggagccttcattaggaaaataaatttccatcaatgccatgacatgacagggaactgaaaatcctgacaggctaacacttgattttgttttgttcttcctttctcgttttaagactagaaaaaaaaatatgtcacaattggacctgcatgttgcattaaagggctatttaaaagatggacagtttcaaaaacccatttgggaaaccccaaatgggcagagggaagctgagctgtctggcgtccaagtgctggccaagtggcagctttttgcccttccaagctcaccccagctcacaggattgtttgtcctaggactggagctgacttgtttcaccaccgtgaagcagatgttgtgacaaacacaactagaaggtgagggaactttccagaaactgcccattctgttcggggagacagagtgggcacaaagagcaactcgactcccatctagggaaccaacagccacggtgatctcaaagtttaaacaccctctacggtgtacatattttgtgctaaacagattcctttgtgaggctaaaacatttagtacttgggaccatatgcatccagcctccaaaggcagatgggaattccattcagaagaattcttttcaaagtcggcttgctgtggaattagttcataatggagttgacgttgtaaatagattaagcactcgccatttttgcagctgaattttgtgtttgttcagcgttgaatgaaaactccctaatctttcttaggttaaacataatggggtcctgaggaagatcaaaggaaggctacttttcccttggatatacatccgtgaaatgaaacgccagagttcatgaagttcaagaaaaacacgaaggaaacgtgtaacgtggactaactgcaaaccctaacgagtaagggaacgtaatgaaaaacacaggctcaccatacataggatctgactcatcatttcaagggtgcaagtttgcaagcgatgcagactccaggtttttactatttaaataaactgaacaaggggaaaaaaaacgtaattttttgacagactctctcacggtacattgaatgctcctcggggcaacctgattttgctaaaatttatctcaagttcttaaaaaggctctttcagtccttgactaatactaatatgctacttccatgtgttttcacaaaatcctagagccaaacctgtaatcctcccccatcatatttcagctcagtcctgcctcagtaatgatcaggaggacgaccaggaagatccagctggattcagacgcagcacagaagcctctcagatgaggttttgcctgggtcactgggataaacaaaataaatgaatggaatcctgtcttagaggcagcaagagcatggggccaggggattccagacgtctggaagcctgcaagttcaccccagcttggtttacgacctgaggcatctcccctcgggggctcctttccctcattggtgaaagtaagcattgaatgaaatgatcttgtccaccccagcatcgttttatgggtctgcttctctgtgactcagtttcttcatctgtaaaattagggcaacaatctccatagaatgattgtgaagataaaatgacttacaatatgttaaagtgtttcaaatcatgcttgggacaaagtaagccctcaatatattttatcatcctaatcatttttctaattgtcatcatcattatgggacaagaacagccaaacagatagaggctggaaggtaatagccgttctgctcttgcaatttgaccttagaaaagaaataaatcaacactgtccaaaatgagactgattttccctcaagttctaaatgcacaatcagaattaaagaaagcaggtaaaaaatattaagaaaggccagacatggtttaatctcacggctgtaatcccagcactttgggaggctgagtagggaagatcgcttgagctcaggagttcaagaccagcctaggcaacatagggagacactgtcactacaaaaaaataaaaataaattgccagggatggtggtgcgtgcctgtagtcccagctactcgggaggctgaggtgggaggatggcttgagcctgagagacagaggctgcagtgagccatgatcccaccactgcactccagcctgggtgacagagtaagacttcgtctctaaaacaaaaaatgctaggagagtagggcaattcctcaaaaaattaaatatataattaccatacaatccagtaattctacttctaggtatatatccaaaagagaaattgaaagcagggactttgaagagatttttgtacacccatgctcatagcagtattactcacaatagccaaaatgtagaagcaatctgctatagactgaatatttgtggccctaacccaaattcctgtgttgaaatctgaacccccaaggcaatggtttgtaatggaaccattacaaggtgagacttttgagaggtgattaggtcatgagggtaggggccccatggctgggattactgtccttatcaaagagactcacataaggtcccttgtcctttccaccatataaagacacagcaagacaatagtgacgaggtggccaagtggttaagacacagcaagaagatggtcatctgtggctgggcgcggtggctcatgcctgtaatcccagcactttgggaggccgaggcgggcggatcacgaggtcaggagatcgagaccatcctggctaacacaatgaaaccccgtcctactaaaaatacaaaaaattagccaggcgtggtggtaggggcctgtagtcccagctactggggaggctgaggcaggagaatggcgtgaacccaggaggcggagcttgcagtgagccaagatggtgccaccacactccagcctgggcaacagagtgagactccgtctcacaaaaaaaaaaaaaaaaaaatagaagatggtcatctgtgaaccaggaagcaagttaattcttaccagacactgaatctgctggagccttgagcttagactttccaacctccagaaatgttagaaataaatgtctgttgtttataagcccctagtctatggtattctctaagagcagcccaaatggactaagacattcatggatggatgaatggataagcaaaatgtggtatctacatacaatggaatattatttgggtttaaaaagaaaggaaattctgtcccatgctacaacatgggtgactcttgaaggcagtatgttaggtgaaataagccaaatgcaaaaggacaaatgttgtatgattccatttatatgaggttcctagagtagtcaaatttatagagacggccaggagtggtggctcatacctgtaatcccagcactttgggaggcccaggtgggcagatcacctgagatgaggagttcgagaccagcctggccaacatggtgaaacccccgtctctactaaaaatacaaaaattagcagggcgtggtggcacatgcctgtaatcccagctactcggaaggctgaggcaggagaatagcttgaacctgagagacggaggttgcagtgagccgagatcacaccactgcactccagcctgagcaacagagcgagagtctgtctctaaataaataaataaatctatggagacaaaaagtagaatggtggctgccagaggaggctaggggaaggggaggaatggggagtcggtgtttaatgagtacagaatttccattttgtaagatgaaaagagttctgtggcgtgcaacaatgtgaatgcaattatgccactgaactgaacagctacaagtagtaaattttacatcgtgcctgttttatcacacacacaaaagtgctaaaagaacgagtgtcctctcagacgatgcctccatgaagtcaggggcctattttttctcctgttccctacacaaaagtaggtccccaggcctcaggagacaggtaatacttgctgattgtctgaggagtgaaccttgtctcataaccaaagctcgggtcactttgagccttttgacagctacctccagcacccacagacacagctgatttggcccaaaccacctttatttaactagctgacgatgtttaaccattggaaaaagtcacattaaagattatattttgagcttttccccacacattgaaaagtctgccagcatttcactgttcagaaattgtctggagtcatgtgcctgccagtcaccccaagtcccctgccttgctccatggacgtttgctgcccagctcctcaggatgctgagggtgggacgtgggtgcattttgttatcaaagtaaccagagtaggctcgcctctaaccaagacagagaatcaaccaga

SEQ ID NO: 485 - DNA, 6812 bp, Homo sapiens
gggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcac

SEQ ID NO: 486 - protein, 2061 aa, Homo sapiens
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 487 - DNA, 26451 bp, Mus musculus
  misc_feature (1)...(26451): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggcaggttctaggatcaaacttaggttgtctggcttgaatagcaagtatctttatctgctaagcagctgcgtaatttttttatggttccatatttgtctagtatgcagaaagaaggaagtgagaagccagagcagagactgaaaatatgcatactaaaatgccaatagtgggttggttcagtagttaagagcattggcaagatcctccagaggaccccagtgcaattcccagcaaccacatggcagctcccaactgtctgtaactcctgttccaggggatctgatgccctcataatgttcaccattgcactggaaacaaaaataaacaagttttttttttttaaacgtcaattccattgcattaaaaggcacaatacacacaggtataattctgaaacttagaagactgaggcaggacgagaagctggaagccactctgtgatcctggcaacccttgaagctgcacaggaccctcttagctcggccttcccaggactttcagacttcgacagcacagcttcattttgtaaagctccaagagtgatgaacatagtttactgcttcatggaaccttgaaaagccacttagctggcttctcacttctcaggaaggtgaagagcaggccggagagtggacagatgaaattgctttgccaaaaaagccctcctgcaggttggtgaagtaggtcaaatggtagtgcttgcccagtgtgcttgaagccttgcattggctccccagccgtgcataaatctgagtgtggtggtcatgcctgtaaccccagttctcaggaagtgggcagaggggggtcagaagtttaaggttgtctttctttagcttcatagaaagtttgaggccacctagggcttcatgagaccctgtctctaaaataaaataaaaaccaattgaggggatggctgggggtggggtggggagtgggtaagagtgcttgctgtacaaacataaggacttgagttcaaatcttgagaacacaagtaaaagtctgtgtgcactggagatctgtgtgttggtatggtatggtatgacaggggccctgttttaacagaacaaatttacagtgacagtacagaatacttgatgtccttctctggcctccacattcatgcatgtgtgtacatacatgtacatgtgtgcatatactacattcacacttctctctcacacatacacacagatacacacagagagatggagagaaaaagagaaacagacattcaaaataatttttgattaaagtttttaattaaattttagtggagggtcaaattaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaggcacagacacaggcaaaggtacaggcagaggtagaagcacaggcacaggaagcaggcagaggcagaggtacaggcacaggcagaggcacaggtacaggtagaggtagaggcagaggcagaggcagaagcagaggcaggggcaggggcaggggcaggggcaggggcaggggcaggggcaggggcaggggcaggggcaggggcagaggcagaggcagaggcagaggcacaggtacaggtagaggcagaggcagaggtagaagcagaggcagaggcagaggcagaggcagaggcagaggtacaggcacaggcacaggcagaggcagaggcacaggcacaggcagaggcagaggcagaggtagaggcagaggcacaggcacaggcacaggcagaggcagaggcagaggcagaggcagaggtacaggcagaggcagaggcagaggcagaggcagaggcagaggcagaggtacaggcagaggcagaggcagaggcagaggtacaggcagaggcagaggcagaggcagaggcagaggcagaggcagaggcacaggcacagctcgaagcacaggcagcagtcagaggcagaggctcttgtgcacacacacatacacacactccagtttctccagaaatgggacctcttcttcccctttccctaaaccatgctacccctgcaggagctataggaagaggccaggatcacacctgggctgctgtctaccactgttcatgactctctgggccagagctgggctgggacgcttggctcctctccacgtggtactagctggtcccgagagacaggatggaggctcccagataaccttgctctggtgtaggtacacttggaccactgcaatggcttctgctcctccaaatgactgctcaccttcacacaggctctcactgtgctgtaggctaccccaagtattcgtgtctaaaggctgatttccaacaggatgaggaaacttccaagtcttatgcagaccttggctagggagtcctcagcaccacctttgactcacagtgtaagcaagtgatagataatggcaggttcatgaggatgccatagtaagacctattattctgtatgacgacctaaattaagaaaaaaaaaagaatcagatggtggtggggcacacctttattcccagcagtcaggaggctgaggaaggtggatctctgtgagtttgaggccctcctggtctacacagtaagttcctgaatagccaggggctacaaggagaaaccctatttcataaaaaacacccccacaaaaagaaaaagaaaaagaaaagaaaacccaacaagtgacacttagaatggaggtggagagatggcagaggctcacgatgtagtccagacaggcctcaaactcatatagtataagttggcctgtaactgttcagcctcctaagtgctagaattaccatgccttgtttaaagttttttcttggctggttttcattttcccccttttctgagacaaggtttctctatgtagccctagttgccctggaactcactctgtagaccaggctggcctcaaactaagagatttgcctgcctctgcctcccaagtgctggaactgaaagtatgcaccaccactggcttggctgggttttaaatatcaacattcaggaggaagaggcaggagaatctctcagtttggagccagcctgatctactaactatctaactatttttttcacttcataaagaatgaaagagctgactagaggaggagagctgtgaacagaagagagcaccactgttttttcggaacagagctgtagtctgcccatgccccagtgaatagttctacgtccataaacatgctggcctctgagaggaaacaatagtaacaaaaaactgcatgaagttgggagggtgaagggcactgagctctcaagggggcaagggtagatggatatgaacaaaatatgctatatagatgtatgacatttacaaagaataaatggaaatagtatcaaataggtttaaaaccacatatgatagctatcttttcttttactttttgttgagacaagttctcactatgtagtcttggatgtcttagaactcacatgtagattaggccagccacaaactcaagagatctgcctcctaaatgctgggactaaaggtgtgcacagaattccaaattatgatcattaatcttcattgtcaacttgagtagacttacagttgccttggaaacacatctttgcgtgtgtctataccgtgcttcctggaaggtttatgtgaagagaggtgacccactgtgaatgtggggagccctgcggcactgggctggtgctgagtagagagagaaaggtagctgagaacattcgtccatttttccctgcatcctgactttggacagtgtgaccagtcaccctgtgttcccgtctggggccaccagtccctgctgtgatggacagtatcaaatgaaggcaaaataaaggatcgcttacattgttttgatcaggtatttgatcacgggtgtgagaaaagcaattaatataccatggtgatgaaactaacattcactggtcaaggcgaagctctttcccctagtccttatgacattttcggtttctccatgagctactctttggctctggtctctacttagtcccactagaccagcaaaccaagcaagacctaggagcggagttcctggcccggcaccttcagccaccatctccctgtgcctgcatctgctttcctctgggttttccttctcctttgggatttcttggtttaatttcagatgctgctatgttctgaggatttttgtatttttttttctccagcccaccagttatcatctcctaactccggatctgagagaagactacctctagacatctctgttcccatgtgccacatagaccttagccctgcatgccttatactaacctatcagactacagagagagcttggaggttaaggatgtgcatgtagcttttgcagaggatttgagttcatttcctaaaaccagtgacaggtgacaaacaactgtccctaactccagctccaaggaatccattgccctcttgtggccactgccccctcccataaacatagtttttaaaaatgacaaaccaccttcttctttcttcttcttcttctcccaccttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcttcttctcttcttctccttcttcttctcttcttctcttcttcttcttcttccttcttctccttcttcttcttcctcctcctcctccttcttcttcctcctcctcctcatcttcctcttcctcctcctcttcttcttcttcctcctcctcctcctcctccttcttctttccgagacagggtttctctctgtagccctggctgtcctggaactcactttgtagaccaggctggtctcgaactcagaaatccgcctgcctctgcctcccaagtgctggaattaaaggcgtacaccaccatgcccggacttcttcttttttaataaagccaatttgaccatggctttctgtcctccacaacccatgacttttctgtggtcccttcttccggtaacgatgtctctctcgttagatctagtgagtatgtttcctcaccccatatccagtaagcaagttacatctttgccccagcctctccaacctgcttctccttcctttctttaggcttcattttgtcacctttgcctccacactggtgttagctcccactcctcaagtccatcctccatactgggctagaacggcaacctatgcagccatccctgctaacacttatccttgccgaccctgggagcaacattctcttacatcccttcagtgacgtacacatcctccttctgcctctcaagtgtgtggatcctattgttaaagcatatactgagtagctggcagtccctgctccacaggctttgagaattaactcagggaagcccttctgacactgctctaagcacctccaaaatcacctgcgcaccagctctcttagtatcttccagaatgtagcaatggctacagttaccagcttttcccactatcctagaagttccttcaacacagggaatgtttttatgatggttctccagtgttcactaatgcctgacatgtggtacagccaaaaagggatgaacaaggatgagacttggtgactgtacagagcaaagagaagctcgctggtaggtacaatgtgttctaagatcagtatctgaactggggagtctctatcttcaatattctgactgaagggaaaccaacaccattagcaataagggtcagcatctgaggtatcacttcctacagccaaattaagtctcctctcttattcatgcccaagatgactacatctatgaagggccttgtaacagcacaatctaagagaagggtttggaaggactcgtacttccactcacatattggcccacattgtctgcaatcccatggggtcttcagaaacaatctagtattttatttaattcattgggaaaaatgtatcaagtacctattaaagaacaaatagtaaataagaaagataactatggaactgggcacaacagctcatgtcggtgatcacagcacttcaggagctgaggcaggaggcttgctgagagttccaggccagcttgagtgtatatatgaagggacattatgaaatgaccactgtcttataggagtttagatctgagtggggtgtgggcaggattcaatactataaaagggttttgcaataacatatatatatatatatatatatatatatatatatatatatatctccttacttataacattgctttggaggagaggcaggcaaataattcagcctggagctatcaaggaaggcttcaccaacatggcaaggaaacactgaaaccagagagaaaaggggccttcagaaaaaaaaaaaaaagcatctcttccaagagagtctagcctctctttgcaccaagtcttgtgtcattccatagcctgtaaattcttcagtagtcagtctccacctgaaactatgtagcccaggctggtctcatttatgacaatcttgtcttagcctcccatgtggcacacccttgtgatcccagtagttggcagataaaggcagaagattcaagagctcgagaccagtctactggccggcctagaatacgcagatgctcaataacattggttgaatgcatcagtgaacagaggcctgaaggacagtgcttattgaatgggggtgtggcatggagatgtatgcactgtatgatggctctgggcaagggaagaacttactaaaaggctgaaaagttgaatgagtagctggagacccctagctcataaaggggtagccttttatctcccgataacaatagacaaaggtaatttatttaagtagggattgttgtgatcttaagtttaagcatggcatctgggctctggaaaacaagttgtgatgtgggtggatgtcctgggattacagacagaaatagcttcgtgcaagctagaggtgaaacactgagccaagtgcctgcctggtgcccattagcccagtacttgggaggctgtggcaggagggttgtctaggtagccagggctacacagaatttgtcagccagccagggctgcatagtgagaccctgttactgaagacaaaatggggggaggggggtgaagacaggcagacagagtaccttgtaaaacaaacagtaagtaggtgtttctgaggcaaagctgtctagagctggggactaactagatctcacttaagtttttgagggagggaggcaactgtggctagactggcaatgatcaccccttaagaccacaaagaaagaggagttttagatttggcgatattaggtctgaagtgcctggggaaggctttctctgaatctccaggtcaccactacccagtttctcctacccctttctctcctctttcctgctgtgatcactccaagtcccaaacgctccttacaactcagcctgcagggtgggtgtgggggcaccacgccagacacagggttcaggcttggtgggtctggctgtgacctctcccggaggcggctccctgacaggaaggcaggcaggcaggcctgccactgggcacacacaagagcttcctgcgctgcagcaggtgcccaggccagctgctccagcccttcagactcagatcaacaggatgggccagcccaagcggaaggaagcctgcagggaaggacactcctgcagacagaagcagggcaccgggtggagagaggcaggaagagctgcctgggttgctgagttggcgctcctccagcggattcagagcaggcagtgacaggaggccattcagtcatcttcccccactcccacccccacccagggcttctctggcccacgttattatcattacatttgttgctggctggctttaggtataccagaaggaaccatcagatagatgttggtagagctggaggcctctaaaacaaattccctcctttacctagtctgtggtgactgagaaagggcacctgctttagcccttttagcccagcaggctgaaaaagcccacaggagggcagtgacttttgtctcatgatctgcctgtcccagggagaagataaaaatctctagtttgctttaagccccgttatcactccctccggctccaacagctgctgtgaacccgcacaaacgggcgagggggcggggcaatagggcgccaacgaggagccaagagctctcagactaggaggctacagcctcagccgggctgctgcacccacaagctggcttccctaagaagctcagcttgccctcaatccctggagcggtggagggggcagggacaggaactcgatgtttgaccgggtcaggaatcccacctgcaagcatgctttcctcaccccatcccctcaagcggtttcttggtagggcgtcggcgaagactgtggtcccgcgggtgggggaagtggagtccaccttggaaatagctcgaacattgtattttaaacttcaactacatcaaactcaaactcgattctgccaccgagcgtcgggtctggggctccctgccacgccactagctctttggtaccggcttcccttagtccccactccaaccgcccagaaggacgggagggacgcgcagaggcgggccctgctgctagtgcctgtgctgcagatgggaggacgagccagcgcctgccgccttgggcgtgggcggtgagtgcgagcaggtgtctgttccgtgacagggctcccgccgccaccatctcgccctggttctccccagtcctccggcttagagtgacaaaacccggcaaatgctcagaaatgccgctcagtggttcatccatcccttgcttccacgcaagacccacgagaaccacgctgccaaagaacgtctggtggctcggagccgcgctcgcagcctccgcctccgcctcctgctcggggtcccgcccactccctggcgggcccagacgctgtgggcgcgaaggggactgggcggagcgggcttcccttcccaccccccacgtggggccggctctccgcaaagcctagtcgccgccaccgcgcctcccagctatgccccgccgccggcgccgcccccgggcatgggcggaggactgaaggctagggttgggcgaggggcgtcacggagtcaggtggtccccggagttccccggggctggaccgagggaacacggtgcctcgggttgtgtacacgctccactgacagagcctcttgcagccgggcagccgctgatcacgcgtggctctgccagctcattggctgaggcctcacacacctttgccgctgattggtcgacactaggccccgccctctaccccgcccgcggcgcggggcaggcagagcggctacctgcacggggaggggggcagacagcgcggagcgcggtggcgtcgacgtctagtgtctcagtgctcccgtctgtggctaactaagcagccagcagccaggcagctcgcgacctgcggccaggcagccaaccatgctcaacttcggcgcttctctccagcaagcttcggtaagttacctgaggatgctggtcctttcctgccggtcagtgtaggggagccagccggagcgcgaagcatgagcccctaaataagccacgcctgagaacccaggctgcagcggggtcttgcaagggatttcctccctgcaggctggaatatcatcgagggcatgtgcaaaaaaaaaaaaaaaaaaaaaaaaaaaaaaagggtcggaagaagcctgggacctggaccaggggagagcgatcctgggtatccaggagacaaggaggactctcagggagaccccaggagacgagtgagctggaggggctgtctccctggaagcgcggtttagatggagggggcgccctgcacctggctctggcgggagatgcccctgtctgcaccaggaatgcgacccggggtgacaaggactactcacggtctgcctagccgagaggagggcgcctgctcttcgggggagggggaaaccctgccaggtggagaccgcggggctgggctagcccggggctgggggaggggatggccggcttcgcgcggggtatggaaggcacgcggactctgcggccgccaggggagccgcggcgcccccgcagacgtcgggaggggactccccatccgaggcggaggcaggtggctgcctatagattactcttggcaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgcaattacattgttagtgatgtttcagaaaccgtgtcttgttttcccacactcagcaggaagataggcatttttagaaaagcgttaagattatcattgccattttatttatgtattaggtttttgctttgtctttatgagttcaggctggccctgaactagttatatagccagagttggcctggagccttatattccaggctcccccactttatgaggcttttcataatttttgcaacctctactttaaccagaagaatttggaagttctttttaagaggaaagtagagatggttggtgattcttttgaaattcaggtcatggaacttttaatgtgagacattaggtcgaaggtgttgcacacagagcatgatcggttatcaaatcatgttttaattaaattaaaaccaacttgtactcggggttttttgtttgtttgtttttgcatatcccaagaacatattttatgcctgtctggtcccttatggtacagaaaagcattgtgtttaataaatctgataaaaatcatagatattaagagattgagacttgaccaaaataaaatatttttttcctctttggttgctttgtgtgttttgcattttgagatgcaacttccaacttcttggcctccacattcctgagattatacatgtatcccaccatgcctggctgtatttgtgtgtgtccacttattttactcaatctccaccgtatgtgatgaagttaccaatttcagactttaggtaactagataccactttaacctggaagtagtttaagtcaaattacattttaagacattcgtcttaattcccttactggtaataaggtggcctttaaccttgaaataaaatagcaagcattgggcattcctgcggtttggataaccagataactgattagcttcaacttttgtttttgtaggaggggaaaatggaactaatttctgaaaagcccagagaggggatgcatccctgggacaaagctgagcagagtgactttgaagcggtggaagcgctcatgtccatgagctgcgactggaagtctcatttcaagaaataccttgaaaacaggcctgtcacaccagtgtctgatacctccgaggatgacagcttgcttccagggacgcctgaccttcagacagtcccagcatttgtaagtattttcagtgggtagaagtgacagcattttttaagagtttacataatggacctctaattcctctccttgcttgtgtttgtatttgtagtgtttaacgccaccttacagcccctctgacttcgaaccctcccaagggtcaaatctgactgcatcagcgccatctactggccacttcaaatctttctccgatgctgccaagcctccaggcgccactcctttcaaagaggaggaaaagaatcctttagctgcccctcctcttcctaaggctcaagccaccagtgtcatccgtcacacagctgatgcccaactgtgcaaccaccagtcctgccccgtgaaagcagctagcatcctcaactatcaggacaattctttccggagaagaacccacggaaatgttgaggctactcgaaagaacataccctgtgctgcagtgtcaccaaacagatccaagcctgagcccagcacagtgtccgatggtgatgagaaggcgggcgctgcactatatgactttgctgtgccttcctcagagacagtaatttgtaggtctcagccagctccttcgtccccagtgcagaagtcagtactggtgtcttcacctacagtatccactgggggagtgccacccctgcctgtcatctgccagatggttccccttcctgccaacaactctcttgttagcacagttgtccccagcactcctcctagccagccaccagctgtctgctcacctgtgttgttcatgggcactcaggtgcctgagggcaccgtcgtgtttgtggtaccccagcccgttgtgcagagcccaaggcctccagtggtgagccccagtggcaccagactgtctcccattgcccctgctcctggattctctccttcagcagcaagggtcactcctcagattgactcgtccagagtaagaagtcacatctgtagccacccagggtgtggcaagacttactttaaaagttcccatctgaaggcccacgtgaggacacacacaggtactgaccgagtgggctctgtctttgaagtgggtgtgtatgtggagttagactgtggacacaaatgcaagggagggtgaggtagatgactcattgtctttaaaattagtcagtttgtccctaggcctggtgccacacccttgtaatcccagcacttgggaattggaggcagaggaagcagcacatctggtaatatatacatgatatatatgtatttattacattatttattcaggcggggtttctttgtgcagccctggctaccctggaactcagtctgtagaccaggctgatcttgaactcagatttctttctgcctctatctccagagtgctgggattaaaggtgtgaaccatggcgccaagctttgataatttatgaactgaccagctttcaattttaaactctgtgcgtcaatgtatagtaaccatctggctttctttgcttcaggggaaaaacctttcagctgcagctggaaaggctgtgaaaggaggtttgctcgctccgatgaactgtccagacaccggcggacacacacaggtgagaagaagtttgcctgtcccatgtgtgaccgtcggtttatgaggagcgaccatttaaccaagcatgcccgacgccacctatcagccaagaagctgccaaactggcaaatggaagttagcaagttaaatgacattgctctgcctccgacccctgcttccgcacagtgacggccagaagatggagacgcagaataaactttggtcagagtcaggagccagtgatggtgtcaagtgcttctgcaaggctgtggccctccaaaagggcctaaagtagaagccctggcctgggggaggccccgcctgggtgaaatgacaagaagtgcttcagccacaggcaggtcacagaggacagggctcagttcttaccacagagagagaggagaacccttttattcctcccttattttagtctggaaagtttcggctgaggtgagcgcagcacaggttttgaatcacatacacattggggactttgtttttgccatttatacttgagaccagctttgcagtgtgattctttcaaaggattggtttcaagaatatagaggctggaaattacggtacagaaatggagctagaaaatgagtttgtgttacacagagatgtcatcttctcctagagttatcttgtttcttattcctagtctttccagtcaaatccgtggatgtagctaagtatatctaaaactcatttttccactattgttggtatttgaagttgaacagctgtacattgctgtgggggagccaaaggattggaaccctcattaatttaattgcttggaaatgcagctaaaattcttctttggcattttgttttgaaagtttaggcattttactctactttagattttagtttgcttgcagttttttgtgtagatttgaaaattgtataccaatgtgttttctgtaggcttaaaatacactgcactttgtttagaaaaaaatctggagatgaaaatatgtattataaagaagagatgtcaagaatttgagataactccttgagaaagttggctttatgtcatcagcaaaggacacttaacgtcaagcatacactgtggtttttttgtttttttgtttttttttttcaaattagaaagtttaatgaccgttacagatggacagtgtctttttatttataggagtttttcaggatgtcagagtagataggtaggaaaattgttattagaacattcgcttctaccttgaaaaggatgttaatgtggtcatgttcttagcaccacagtgtctgggcatctgggaaactccgagacttttttaaagtgtcatgatgtgatcacacctgcagtttggggcatcgaatccagggccttgcatgtcttctgtaagagctctcatcgctgacctgtatcccccgcaagagcaatgacttttgctaacagtatttcttttctgttgtaaagtggacagatgatacacttggtcgcaaaggtaaattattcaaaatccacagtgaaaacctcaccacactttcccatttaaactatttccatatctcagaggtttctgacatgcaaacttgaacccttgaaagaagagttttcttaaaaattataaaaaatcacgagttacaatttgcacaatattttttgttgaactttataccttgtttacaataaagacttttctttggtatacacagtgagtctgttgtatgtgttaaaacccattctccatctcaccttcatactgacctcattcagatcagaacctgaggccagattgctttaagatgatgtaactgctatgaccaacaagagaaggctgacctgtcatctggagggacttgttcaagttgtactcactcagaccaggaagagatactctagatataacagataaactggtccttaagcagtgtgagaggccaggccacctctgcagagacacttgctagtcacttaggagcgttgtaagtagggtatgacttttttcttttaataaggtcactattttagttggcccaaaagtctcactgctcttgagaaaatctgcaaaggcccctgcttgaacacctggctcactttttgagacaaagtcttattgtagcccaggctagcctggaactcaaatagcccagggggtcgcaattcttctgtgcctctggaatgctaggattcaccacgattccttaccccaacctcttgatttgttatttttaccatccttgtatgaatcttgtttgaggcaaattattgtggtattctaattcttttgttgtatatttttggggattctataggaaagactagtttagtctccttagttattcctgtcgatatggatttgtggagacatatatcattctcttaagttataagggttttgttactcagctgtcccagtgtgatccttggtttcttgttttgttttgttttgttttgttggtttttcaggacagggtttctctcttttttgtttgtttgtttgtttgtttgtgagacagggtttctctgtgtagccctggctgtcctggaactcactctgtagaccaggctggcctcgaactcagaaatctgcttgcctctgcctcccaagtgctgggattaaaggcgtgcgccaccaccacccagctcagtgtggtccttgtgaactcctgactggttaaccattttgattgacaaagatgggaattctatgatccatcctatccgttcctccggagtaagagttagtgattattctgaggagtgaaaaagtctccctgaaacaggctggccttgaccctgctacccactctctcagcctatatgtgctgtggatttgcttcctttttgttttctaacatagtcttgtagccagagctagagagttttctcttccagtcctaccctgctaccagcctgtctaatctggcatctcacagcccctccctggtgttctgtctctagtctcttcctgctaattagcctttccctttggaaaagggaaacctgacagaggcttttctgtgtaaaatactttaaagacttccagtacacttggagaagtctagatgtttctttctctcctgtgtaacttgagacaggtagtcaaggctggccttgaactcctgactcccggcctccacctgctgcacgcagagagccttgctgtgcaccacggaactccttccgttggttttcatagaacagggtaggttttgctctgtagtcctggctggcttcaaattagttgcaattttgcctgagctttgcctggtggaaccccaggtatgagccactgcctgcaacagcactgtatatcaaatatgtgccacatgtcatttaaattttccccttcccaagtaggcttgggcctacttctgattccagccctggggagagtgactgtgagtgcaagctcagtctggtttacgcatcaagttccaggtaaggaggactacataatgaaaccctatcttaggttattttctagtagatacatcaaaaagatatacccaaactatttccacaccgagtcagtatcatggctaagaatcctagtccatctcttctgaagttacccttggaacccactcttacatgctcatagcacatcctacttgggaccaaccacatttcaagtgcttggtagtcacaggtggcaggtagctagctgcttggggctccttgagggtccccagtatcctgcaccattaggcttctgccagcccctcccctccagttcccctgtaccctgtgtccaagatgcgagccttactgctgtgctacttcatgtgtggagaatgatttccctgaccttctcccttgacatttccactatcaccgcccatcatttccctttactgaaattgcctaatgcctctgtttttttccaggacaggagtctctgagtcttgccctcagcatctcgcttagcgtcttacacatagcagggctcagtcacgttgctgaactgaaagggagcctgcggagcctcaggaggggaataactggatgttatataacatacaggatacagccaccggatgctgaagcctgccctttgattccttgttggttctggaagggacctcttgctgcatgttccagacttaaagaagactgatagagtttattggtggaatacttgtctaacatgtgcccagcatcatagaacaaaaacagtcatggcacatctattttgttttggggtattttggtttttttgttttgttcttctgttttaaacagggcagggttaagatttgaaaggggtggcacacacaggtccttcagcagagtcaaattccttgcctggaactgcttagaaatgtcaccttggtagtccctctgctctttctcattgctctcaggaagcgccgagaacgatgaagaccctctcggagaattttgggcaggcctcttcctgaagatgagtgggaaggcttctttccgtggcagtgctgctaatgccctagtacctaaatccagtcctggtggagaagcctgggctaagacatgaccttgagctgactcactcacagcagagcatctccaccagagagcagaggaagtgtcagcgaaagagatcagcttgagagacctggtgtcctagaattctctggggaaatctaactaataaaacaacattttatacacatcaacacacacacagagctcagagaggtttatttagtataaggaattgattataggaacagataagcttacagctggcaagctggaatcccagaatcatagttctagtacaaatgccacgacccacttacggggcttgctttgctaattttgagaaaggatcttttgtagcccaggttggacttgaacttgcaatgtagtgagcatgactgtgaacttccagtcgtcctgccgctacctccttcccatgtgctggggtcccggctgtggaccaccatgctctgggttgctcagtgcagaagtctgacaaccacttcctgtgtaagcaagccccccgccagctggactggagcccagtctcttgttttattgtatgaggctttactctgtagcctccagcgtgctgggatatagagctgtatgcaccaccccatcttcaatttgagttccgaggcgaggggaaaaaatgctctgactgctgattgagaccccgacccacattagagaaggtaaatctgctaactcaatttatccagctctgcctttagagacccatcagggaattagaccacagacgggcattctgtagcccaaccaactgatgcacagaattaagcaccacccactgtgcattccagttctggttacactgatatgtcgttcactgctggaaatggtgcccaccttttagaatggggcttaacagacacgcctgctatatttcatgcctacagccagcagcaagctccagggagattttgtacaccagagcccctgaagagcacaatccactatgtgtttgtggttgctattccagggtccatgtgtgagaacacacaagtgtcagagaatgcagtaggatgcccaccaagggcggccatctattctgcaaggaaaatccacccgggattggatgttcacagagctctggtccccaaagttctcagagttctgccttagatctaattatttgggtgctcagttacagaaagctcactgtaaggaggtcagtctaatggtaagaaaaacacgcagcagaaaggcataggcgtgtgccacttgattagaaagcacaagtctagacagagacactccagacacagccagtccatcaaccaagttcatggatctacccagtcccctttgccctgctcagagtgacccaagaatcagtaagttctgcaagcaagtccagtggactcatgacctctgccgagagacgctcctcaaaagagctacaagtgggagaaagttacactctaaaccctaggtcacgatcccatggaaatgtgggttggtacaagggacaaaggcatctttacccccaaagaaattattaagtcacatctgtacggggtctaccccaatagtatgggtttaagtgacagaataccaaagccataaccctctcgtctttggttcattctcacggaaagagttgagtggaacagggctgtgtgttgctctaaaccttccctgctccttactgggagctagaaactccctgctttccccaggggtacctgtgacccagtgtggccctggctgccccgctggcagtggaactcagaaaggagaaggctcatcaacacataaagcggtgctttgccttactttgactttcctgaaagaatctacttttcaattctaagcttaggcaggagcagagtcaaagtctgtgtttgggaaaagcagcgtgaaattctgcaaagaaaaagaaagagaaaacgaagctgaggctgtggacacgggactgcagttctgcatagggaggtgggggcagaaaggtcacatcgagatctgtctcagaaacaaaacaagacagtcaaacagagcagaaatatcatgaaaaggagccatgacctgtggtaggctttgagaagagtcattcttacttatctgattagattatcagaacctcgagtatcgatttcaaaaaagacaacccatagcgttcatggcctccctaaaagatgtccgcaagcacttcaagtttattgccaatagacaaagaaaaccagggcggccttgtgaaaggagccctctggggtcattgccctggatgctgagatcagttctctgccacctgtaatcatgaacccaagcaaacaacttaaccatgtcgtgactttgtttctacgtctctgagtttcatctgacctgttttccaagatagaattagactagggaactatgggaaggggtgagggcatagcagagggagggcagtattggctgagattatgtaatgctctggctttcaccccgtagggaggagaaagggaaggggaaggagaggagagagggagggaaagaggaagggagaaagggggacgaagggagggagtggaaagaggaaggaggaaagaggaaatgaccagtgacttgaagaggccacctacattccatggtggccaataccctgctgcagctgaaatcaattatctagacagaaacggctcctacagttagggccaacaatctggtgtcactctatggatcgaaaagtcccaaatagtctcggtatggggatggagccattcagtagtcatttttacaccaggtattcatgcagtctcctacacttatgagagagccaggctgtggaaccaacagaaggttgacctgtgatttccaggtctctcataaacaagctgtctgggaaatgcagctgccatgctgaggaaaagcaggcctgtgtggaggttggcatgggtgggtgggtaggggagctttggctagcagctggcacttttgtaagccacaggagaacactgtggtattccctcagcttcactgagatttcgggtgacctgttagggtgacttacaaacagaaattaccacgacttaagtggcaaagcgcctgcctgacagagccagccaaagggctcagtcccaagagacgatactcagttatgcctgtttccatgctaactggagataaggagagtgtgtttgtgtgagtgtgtgagggaacagtgtatgcggcgtgtgtgtgtgtgtgtgtgtgtgtgtgtgtgtgtgcattcatgtgcatctaggctcgtgtgcatgcacacacaagtgtgtacatgtgtgtgtttcagagagtatatacatccatgcatgtgtgtgtgtgcacatacatatgtgagtgtgtttgtctgtgagtgtgtgtgtgtgtctgtgtgcatgtgtgtgtgagtgtgtgtgcctgtgtttgtgtttcttaggttgcagatttggttttcttttaactttgaggccggtcattcttacatagcccatgctggtctcaaacttctaaactcagcttcttcaggggtggggttgctgtcctgtgccacgatgcctggcttggcaggtatattttgaggagaagtgatgggacattatagtttatatctgaagtgttttcccccaaagtgctgtgcttagggggtggacacccagccgacggtgctgctttggggggttctggaagctttagaatgtgggacctggcagaagaagtaacttacggtgtactcttggttgtatcttgccccagacctcttgtctatttgtttcttgtccaccatgaagtgaacagtctcctcaccatgccctgccaccggtgcccctcctccagctgcactcagaaacattcagctaagagaccacggaaccttccttccaaactgggcgtcaaactgggaaagcaaaccctttctccttaaactggttctgaggttcaggtgagagtcgtgtgtgtgtgtgtgtgtgtgtgtgtgtgtgtgtgtgtgtgtgtgtctgtctgtctgtctgtctgtctgtcttgggtgggtctgtctgtctgtctgtctgtctgtgtctgaggcagggtacctcgtagtccaggctggcttcaaactcatcacatagcagaattctgagtcttcctgcctccatctaagagctgaggttacaggtatctgccacaacccagcttgattttgatcaaactctgtaaaagtggctaatataaaggacttctagaacactggaagaatcattgttaagattttattactaacaactgctaagtttcaaacccaggaccaatgactaggtacctatttaatatatcgaatcagacctggcagccaggttctcccagcatccttcagtccctatctgttacagagtttggctcgaataccccaccttctaccttgaactctcgagcccagtggttgggctgcccttcccccaaaagctcttccctatatagtccagccattttgattaccttttttgtttctttggcctcctggctactgcacctagggtccctctttcccctatgcccaccccccgccccgcaccccccacctgtccacacatggcctgcactcagcctggtcatgtcaattatggactctcccagatgtccctgcctctacctatgccacaagtctataataaacttctccaccacacctaggaacggtcatgtcctttccttttttatttatttatctttttattcaagaacaacaaaaacaaccacctcagctgcagcctagtgtggtggcacatgtctttaatcccagcacttgggaagtagaggcaggacagtctctgagttctaggccagcctggtctacataacaagatcctggtcaattatcactacttagtgagccctgtttaaaacaaacaagcagctgggcgtgatggcgcatgcctttaatcccagcactcgggaggcagagacaggacgatttctgagttccaggccagcctggtctactgagtgagctagctccaggacagccagagctacacagagaaaccctgtctcgaaaaaactcaaaaaaaaaaaaaaaaaaaaacccaaaactcaaaaaacaaaacaaaacaaaacaaaaacctaaacaagcaaaaactctgaagtagatgtcccagcacctgtcatcactcggaggttgaaggaggaggattaaagcaggtatacggccacatagtaagtgggttccaggccaacgtgggctacaccaagtgaggcctccaactggcaaaataaaaagcagtggcttaaaccgcagaaatttactttcttgtagctctagagggtttaaatctaaaatcaaggtgttggtagcattgatttttcttatgtctccctccttggctttagcatgcaatcttctccctgcatttttacagaatcttgcctatatctgtctaagatagtatctgtcttagggtttctgttgcttcgatgaaacaccttgaccaaaagtaagtggggttgggggtggccattgagggcttcctggaggaggtgtcactcaatttagttcagtatgaactctgaacaacatgaacaatagcacagatgggaagagtgtggaggaaagaaaaatcccgacttaatctgagggacggtacaagactagggaaggtgtggggcacagtttacaattctgaatgtcagctgagcacggaggctcacacttggaatctcagtatttttgaggctgaggtaggagggttttagggagtctgaggccaccctgtgctaaataatgagtttcaggacagtctgggctacagcacaagggcctgtcctctctccaaaaagtcaccagttacagggaaatggtccaatgcagtcaaagtcactgcccccatcttcacattaacatatgcttttcatattagcatatgctctcatattggcatatgctttcatagtagnnnnnnnnnnnnnnnnnnnngatggcttataaccatctgtaatgggatctgatgcccttttctggtgtgtctgaagacgactacagtgtactcatatacataaaataaataaatcttttaaaaaacgaaaacaaaaacaaaagcaagccggggaggaaagggttaatttggcttacatttccacattggtgtttaccaagagaggaaattgaaacaggaactcacacagggcaggaacctggaggcaggagcagatgcagaggccatggagggctgctgctcgctgacctgcctcacacggcttggtcatctgccttcttacagaacccaggaccaccagcccagggatggcagcagccaccatgggctggaccctcctccatcaatgagcagatggaccctagggagacatggtctccactgaggttcctctctctcggatgactctagggtgtgctaattcacttatatggtcatcaccatatcctcatttttttttaaaaacagaagttattatattaacagagttcattagctcaatttttaaaaaagatttatttatttaatgtatgtgagtgcactgtcgctcccttcagacccaccagaagagggcattgtatcccattacagatggttgtgagccaccatgtggttactgggaattgaactcaggatccctggaagagcagtcagtgctcttaagagctgagccatctctccagccccccccccattagctcaatttaacatgaatcctttaaaggttctatttactaattagtcacattctggataataggacttgtaggagagagtgtactcagtggttagagcacttatctagcatatgctaagtttgatcccaagtacctccccaaagcaaaaagaattggagggaaggcgtaattcagctatagcattggtcaacgtatgcaagtctatagtgtttcatctcaatataccaatagcagctgttttataaaccagcctaagatgtggtgtttgtgtagcagcaacctggggaggcaggtctttcaagcacgtacacagccacttcatattcatattccttgtgctgggcagaattttccttcattatatactcataagcattatttgatagttgatcttgtcaacttgatgggatctggcaccattgcaaggatgtttccagaaaaggttaactgaggagggagacacaccctgcctgggcagcaccatcctgtcaactgaatccaccaggaagaaaaaatggaataccaactgaatccaccaggaagaagaaatggaataccaactgaatccaccaggaagaagaaatggaataccagcatccaccatgtctaggc

SEQ ID NO: 488 - DNA, 3045 bp, Mus musculus
cagacagcgcggagcgcggtggcgtcgacgtctagtgtctcagtgctcccgtctgtggctaactaagcagccagcagccaggcagctcgcgacctgcggccaggcagccaaccatgctcaacttcggcgcttctctccagcaagcttcggaggggaaaatggaactaatttctgaaaagcccagagaggggatgcatccctgggacaaagctgagcagagtgactttgaagcggtggaagcgctcatgtccatgagctgcgactggaagtctcatttcaagaaataccttgaaaacaggcctgtcacaccagtgtctgatacctccgaggatgacagcttgcttccagggacgcctgaccttcagacagtcccagcattttgtttaacgccaccttacagcccctctgacttcgaaccctcccaagggtcaaatctgactgcatcagcgccatctactggccacttcaaatctttctccgatgctgccaagcctccaggcgccactcctttcaaagaggaggaaaagaatcctttagctgcccctcctcttcctaaggctcaagccaccagtgtcatccgtcacacagctgatgcccaactgtgcaaccaccagtcctgccccgtgaaagcagctagcatcctcaactatcaggacaattctttccggagaagaacccacggaaatgttgaggctactcgaaagaacataccctgtgctgcagtgtcaccaaacagatccaagcctgagcccagcacagtgtccgatggtgatgagaaggcgggcgctgcactatatgactttgctgtgccttcctcagagacagtaatttgtaggtctcagccagctccttcgtccccagtgcagaagtcagtactggtgtcttcacctacagtatccactgggggagtgccacccctgcctgtcatctgccagatggttccccttcctgccaacaactctcttgttagcacagttgtccccagcactcctcctagccagccaccagctgtctgctcacctgtgttgttcatgggcactcaggtgcctgagggcaccgtcgtgtttgtggtaccccagcccgttgtgcagagcccaaggcctccagtggtgagccccagtggcaccagactgtctcccattgcccctgctcctggattctctccttcagcagcaagggtcactcctcagattgactcgtccagagtaagaagtcacatctgtagccacccagggtgtggcaagacttactttaaaagttcccatctgaaggcccacgtgaggacacacacaggggaaaaacctttcagctgcagctggaaaggctgtgaaaggaggtttgctcgctccgatgaactgtccagacaccggcggacacacacaggtgagaagaagtttgcctgtcccatgtgtgaccgtcggtttatgaggagcgaccatttaaccaagcatgcccgacgccacctatcagccaagaagctgccaaactggcaaatggaagttagcaagttaaatgacattgctctgcctccgacccctgcttccgcacagtgacggccagaagatggagacgcagaataaactttggtcagagtcaggagccagtgatggtgtcaagtgcttctgcaaggctgtggccctccaaaagggcctaaagtagaagccctggcctgggggaggccccgcctgggtgaaatgacaagaagtgcttcagccacaggcaggtcacagaggacagggctcagttcttaccacagagagagaggagaacccttttattcctcccttattttagtctggaaagtttcggctgaggtgagcgcagcacaggttttgaatcacatacacattggggactttgtttttgccatttatacttgagaccagctttgcagtgtgattctttcaaaggattggtttcaagaatatagaggctggaaattacggtacagaaatggagctagaaaatgagtttgtgttacacagagatgtcatcttctcctagagttatcttgtttcttattcctagtctttccagtcaaatccgtggatgtagctaagtatatctaaaactcatttttccactattgttggtatttgaagttgaacagctgtacattgctgtgggggagccaaaggattggaaccctcattaatttaattgcttggaaatgcagctaaaattcttctttggcattttgttttgaaagtttaggcattttactctactttagattttagtttgcttgcagttttttgtgtagatttgaaaattgtataccaatgtgttttctgtaggcttaaaatacactgcactttgtttagaaaaaaatctggagatgaaaatatgtattataaagaagagatgtcaagaatttgagataactccttgagaaagttggctttatgtcatcagcaaaggacacttaacgtcaagcatacactgtggtttttttgtttttttgtttttttttttcaaattagaaagtttaatgaccgttacagatggacagtgtctttttatttataggagtttttcaggatgtcagagtagataggtaggaaaattgttattagaacattcgcttctaccttgaaaaggatgttaatgtggtcatgttcttagcaccacagtgtctgggcatctgggaaactccgagacttttttaaagtgtcatgatgtgatcacacctgcagtttggggcatcgaatccagggccttgcatgtcttctgtaagagctctcatcgctgacctgtatcccccgcaagagcaatgacttttgctaacagtatttcttttctgttgtaaagtggacagatgatacacttggtcgcaaaggtaaattattcaaaatccacagtgaaaacctcaccacactttcccatttaaactatttccatatctcagaggtttctgacatgcaaacttgaacccttgaaagaagagttttcttaaaaattataaaaaatcacgagttacaatttgcacaatattttttgttgaactttataccttgtttacaataaagacttttctttggtata

SEQ ID NO: 489 - protein, 496 aa, Mus musculus
LSSQQPGSSRPAARQPTMLNFGASLQQASEGKMELISEKPREGMHPWDKAEQSDFEAVEALMSMSCDWKSHFKKYLENRPVTPVSDTSEDDSLLPGTPDLQTVPAFCLTPPYSPSDFEPSQGSNLTASAPSTGHFKSFSDAAKPPGATPFKEEEKNPLAAPPLPKAQATSVIRHTADAQLCNHQSCPVKAASILNYQDNSFRRRTHGNVEATRKNIPCAAVSPNRSKPEPSTVSDGDEKAGAALYDFAVPSSETVICRSQPAPSSPVQKSVLVSSPTVSTGGVPPLPVICQMVPLPANNSLVSTVVPSTPPSQPPAVCSPVLFMGTQVPEGTVVFVVPQPVVQSPRPPVVSPSGTRLSPIAPAPGFSPSAARVTPQIDSSRVRSHICSHPGCGKTYFKSSHLKAHVRTHTGEKPFSCSWKGCERRFARSDELSRHRRTHTGEKKFACPMCDRRFMRSDHLTKHARRHLSAKKLPNWQMEVSKLNDIALPPTPASAQ

SEQ ID NO: 490 - DNA, 26923 bp, Homo sapiens
tcacttgaacacgggaggcagaggttgcagtgagccaagattgcgccacggcactccagcctgggtgacagagtgagactgtgtctcaaaaataataataataataataataataataataataataaacaaatgtgttaaagcagcactataatgccaaaataccattatatatgtatgtgaatatgtgtgtgtgtgtgtgtgtgtgtatatatatatgtaatcatttttattttttagagacaaagtctctcttgtcacccacacttgagtgtagtggcaccatcatggctcactgcagccttgaccttccgggctcaagcaatcctcccaactcagcctcctgagcagctgggactacaggcatgtgccactatgcctggctaatttttttttattatttgtagagacggagtcttcctatgttgcccagactggtctcaaactcctgggctcaagtgagccttctgcctcagtcttccaaagtgctgggattacaaacgtgcaccacctcatccagcctatgttttttatatttggataaatgtgttatcaatataatggcttcatttgtaatcttatgaacttcattttatgagctcaaaagcattatcctgagaaggagttcataggtttcgttaacctgtaaaaggaccatttcagattctagaaccttcatcacatcctccagtctgtttttgattgttgttttgggttggttcatgtcacgctcggatttattttactttttttatcagtagcaacatagcacttaaaaccaaaaggggcctatatgcttgtcttcaggagtgaaacgaagactctcctgagaagacggcactccactgcacagccaggcttggtggcagtgggggctaagaaccccaaggaagaacatgcatgacccttgccctccttctggaagatcgtctcaacattcagaaaatttcaataaaaaaatgccacgtgctaaatagagagaccatcagccatagcttttgctgactgcttacccttctacagctttatatcataatcttgattataacccacaaagaagctggaagatgtttggcctttgaaaaacaacacccctcctctcacccatgatgccaggcaagattaccagaattctgacactggaacaggtaaaagtcactgggtctatccagagaaaatgaaaggtcctacttttaagaagctgtaagaacactacctttacaattattgatgtgcaaagagatgttcctgataggttaagtaaaataagaaaaagcaagttacaagatagcatgttttataacatatatacagaggggagtgagaagacagggtaaagagcctgaaaatatatgtatcaaaatgttagtagaggttaattctggaagtgggattacaagggattttcatctttttattcctttttgtatttttttaatgatcagtatgttttacctttgttaagaaaaaaataagggaacgcagctgtgttcatttggtaaaaatcacaatgttaagtaactatattttactgctacttggaaccttgcagagccacttaaccacttaactggcttctcacttcttgaggagataaaaagagcaaatggggagtggaggaatttaattttttttttttacaaaaataaatccctatagtgttatatcatggactttatacagtgggccacattaggacctccagattcttactgcaccaagtaataaccggtgcatagcaggtgctccatcaaggtgaactccctttcttcctattacacatttatttccatctcaaagcactcaagggagtgcttgctggtggtgtggaatatttttcttccagatctccatttctctcttttttctttttttttttttctttgagacagagtctcgctctgttgcccaggctggagtgcagtggcacgatctcggctcactgcagcctccgcctcccaggttcaagcaattctcctgtctcagcctcctgagtagctgggactacaggtgcccgccaccacgcctggctaagttttgtatttttttagtagagacggagtttcaccatattggtcaggctggtctcgaactcctgacctcaggtgatctgctcgcctcggccttccaaagtgctgggattacaggtatgagccaccacgcccagccacttcccatttctctaaggtaaaaataaagtatttcttccttgctctgattttttttccttttctactttactagtttttctagttctccttcctggggctttctccaaggtattttagattctttttttttaaaaaaagaaaaaaaaagtactcttataaaatgagtattttgaaaactgtagctgtccctccagaactgaaagaaacacacatggactatttcagttatctcttgcagtatagcaaaccaccccaaaacccaatgacactcctgtggacagaagcgggaccgtggagtggaggggaggcaggaagtgatgcctgggctgctcttttatttattgttcatgattctgtgggtcagggcttggtggggatggctcatctctgctccatgtggtgtcagctgggcctgcgtgactggggctggcgggtcccaggtggccctggtcacgtggctggagtgttggtactggctgttcgttggggtgccttagttttctccatgtggccgttctcctttcacatgttctctcattattcagtagtttagcctgggctcctctgccttgtggctagtttccaagaggataaacacagacacttcaaagtcttcttaagatctaggcatggaagtcccacagcactgccccacattctcccggtcaaagcaagtcacagggcagggccggcccagaatcaaggggtaggaaaaaagactttacctcttgacacagaaatggcaaagtcacagcagaaaaggttacatgggacaggaagggttgtggtgggcatctttagaaacaatttaccccataaatagagtttaagattaaaaaaatgtttttaacgagctttaaaaccatagtaattagtgtaatgaaaataactaatgatattcaccagaggagatttttttttctactctatctggcactttcactttctaaatcagccccagttcgcctctcatccccactctgcaccccatgaggccaggacatcctgagcacgcacacaggaaagaagtccttgccacaccctctgccagcatttcaccacgggcctgcccccttcagcctgcttcttcctcagaggcccaccctcagttctcttcttttttctcgttattttcttttcctgcgggattttatctactcccttggcttcaattgccacctagactctgatgacacctatattttgttttttatttctgtttattgatttatttttgagacagggtgttgctgtgttgtacagtgctcggagtacagtgctcagagtgcagtgctcggctcactgcagccttgacctcctgggctcaagcaatgcctcagcatcccaagtaactgggactagaggcacacaccaccacacctggttaattttctgatattttgtagagacagaggtctccctatgttgcccaggctggtctcaaacttttgagtttgagcaatcctcctgcctcagcctcccaaagtgcttggattacaggcataagccattgcacctggctaaaattttaatctccagcctagatctttctctgttgggctccagacttgaaatatggcattttcttcctttcctccaaagcccactacctctctgtggccctcttctatttcatacagtgaatcaaggcagaaacctggcagttctcgatactaccctcttcctcatgtctacatccaatcgattaccgaatcctgcttgctcttggcatctctattccatcctctccagacctgccaccatttcttagtttagcccagcatcacctttgctgcctgcaaaagccttctcaatggcgacagaccctcactcctctggtccattctccatgctgggccagaatgagcttcctataccatcatccttgttaaaacctgtcagcaggtcccccttgtccttaggataaaagttccacttccacattccttagcacggcacacaaaggcacttcatgttctgggctgctttccttaatagcctaagttcctcatcctgcctctcagatctgtgatccagacaattcagagcatcctaaatccccaaggctctctctagtctccacttctatccctttacttcctcagcttacagatcaaatgggagaaggcttccctgacccttccctaggcacctgcaggtacctatcttagcatttgtcagattctatagtgacggctggctctcctatttacttctcccactatactggaagctccttcaacactggaacggtgtcatttttatggtttttcctcagtgttcagctaatacctggcatatggtggggcaatgaatggatgaatggtgatgagacccactgactgcaaggggcaaagagaagatgtctcgtgggtacaatgtgttctaacattcataactgacctgagaaatctttacagtcagctcccctctcacttccttcattattctgatctaaggagaaaccagtaccatcagcaggaagggtcagcatctatctgaggtaccacttactactgcccaagggctttcttttactcatgctacattagtctgttctcacactgatataaagaactacccgagactgggtaatttgtaaaggaaagaggtttaattgactcatagtcctgcatggctggggaggcctcatgaaacttacaatcatggtggaaggggaagaggcacagagcacaagcaagagcagggaaaaccaccttataaaaccatcagatctcatgagaacttactcactatcacgagaacagcatgggggaaactgccccgatgatccagtcgccttccacctgatccccaactcgacaagtggggattatggggattacaattcaaggtgagatttgggtggggacagagccaagccacatccaaaccatatacacgcccaagatgacagttttccatgtctgaccctgcaatgacacaagctaagggaaaggcatagaaggacccacacttccacctaggcgtttgcacatatcctgtctgtaactccagtgggtcttcagagacaatctacaattactttctccaataaaaaaaaaaaatcttgagtgcttcgtatagaacagatactagatcaaaaagatgattataggctgggtgtggtgactcatgcctgtaatctaagcactttgggaggccaagacaggagaattgcttgagcctgggagttcaagaccagcctggtcaacatagtgagacctaagctctacaaatagtaaaaaaaaaaaaaagaaaaaaaaaattcagccaaggctgggttcagcggctcatgcctgtaatcccagcactttgggaggccaaggcaggtggatcacttgaggtcaggagttcaagaccagcctgaccaacatgtgaaaccctgtctctactaaaaatacaaaaattagctaggtgtggtggcaggtgcctgtaatcccagctactcggaggctgaggcaggagaatcacttgaacccaggaggcggagggtgcagtgagctgagattgtgccactgcactccagcctgggcaacagagtgagactccatctcaaaaaaaaaaaaaaatcagccaagtgtggcagcacacacctgtagtctcaactactcagaaggctgaggtgggaggatcatttgagcagaggaggctaagggttcagtgaactgtgatcaccccactgcactccagcctgggtgacagtgcaagaccttggctcaaaaatatagatgattatacatgatcaccatctcaggagttcagatctggatggagcatgggcaggactcagtatcgtaaaaaatgttccttgcaaaatgactaatccactcccagcatgaaggtgtggacaatgtacgctgagagcaaagaagaaccatcaattcatcccggtgttatgaaggaagccttcaacaaagtgacagtggtacaaagcccttgaaagccaagaaggcaaagggggccttcagggatgcaaatgtatatttttttgttttgtttttgtttttgagacggagtctcgctctgttgcccaggctggagtgcagtcgcacgatctcggctcactgcaagctccgcctcccgggttcacaccattctcctgcctcagcctcccgagtagctgggactccaggtgcccgccactgtgcccggctaatttttttggtattttttagtagaaacggggtttcaccgtggtctcaatctcctgacctcgtgatccacccgcctcggcctcccaaagtgctgggattacaggcgtgagccaccgcgcctggctgcaaatgtacatttcttgtacatggcgtcccctagcactttaaagaaaaatccccatttcgggccgggcacggtggctcatgcctgtaatcccatcactttgggaggccgaggcaggcagatcacaaggtcaagagactgaaaccatcctggccaacatagtgtaaccccgtctgtactaaaaatacaaaaattagctgggcgtggtggctcacgcctgtagtcccagctactcaggaagctgaggcaggagaattgattgaacctgggaggtggaggtttcagtgagccaagatcacaccactgcactccagcctggtgaaagagcgagactccgtcagaaaaaaaaaagaaaagaaaagaaaaagaaaatccccatttcaaaccatgacctataacttcctcagtagtctagctcctcccgctttactttccagcctcatcccctcccactctccctgacaccctctgcacctccagccacattgcatcccatggggccaggtccttcctgctgtaagactgccttagctgctccctctacttaggtgcacttgcccgggatcctcctatcctctcatgaggttttcagcttaaacatctccttggagcaagcttctcctatatctcataccaaaccagttgcccagtcacaatcttaccaccctgttacaatttggtgcactgtaagtgaacttacctaccttaatggtgcttttgtgtgtgtgtgcgtgtgtgtgtgtgtgtattcgacgtgtacttatctttgcctcccctggcctgtcttgttcactgctactgtccctggaacagtgcctagaacacatagtagatgctcaacaaatagttgtcgaatggagtggataaacgaacaaaggcatgtgcaacatagtgtttcctgaatgaggatgtggctcggagacatgaaaatgcaccatatgtttgaggaacagcaagcggtttgctgtggctgtgggcaagggtaagtctgggtggaagacgaggtggggagggttgggagagtcctatagttggaggctgactggatagctcagaactgaatggcctttcatatcctggcaacaggagccatggatcatttttaaggagagaatgttatgattggatcatgacttttaaaaagccattccagtcacagtatggagcttgggcaatggaaaataagctggagtgtgggtggaggttgggtggggggattgcagattgtttaatcagagcaagacttgatgacagattgatctagtgcaacatttggagggtagaaatggaaagtgagaacagagacatttctgaggcaaaactgctgggtcctggggaacaatcagatccagggctttgagagagaaggtgaaggctggaaggagacaaggcacgcatccgggaaggagtagaatcagcaattctagttttggatatgttgtctgaggagcccggcaaacatgtttctctgaatctctaggaattgtgccaccaccacactgttcctcctaccccttttctcttttctttcctgttttgaatcactctcacaagtcaagaccgctccctgcttcttagcccgctggggagccaggccagcaggccccacattcctgaggaagggacagggttctggcctggagggtctagcagaagccaccccaggggagggcccgacaggaaggaaggtaggcctgccggaggggcatacaggagcttcctctcccgccacagtgtccagggccaactgctccagccctcaggctgggtcaacaggatgggacagcccaggcggaaggaaacctgtggggagggacaccccgcagacagaagcagggacatggggtggggagaggcaggaagagctgccgggctgctgagctggcgcctctccagcagactcaggaggggcggtgacaggaggccattccctcctcatccccgcagccctgggcctctctggtcctggccaacagtattactatcattattattgctgttgttcgctagcctgggccttagatacattagaaaaaaaccatcggaagatacgcatagcattggcagtttctaaaagaattaattcccttcctgtgttcattctgtgattactgggatagaaatgctatttgcattaccagcctttcattcagttacagagacgtgagtgctcgaaggagagacagtgatttttgccttaaattcagcctgtccaaatcggataagatctccgatttgctttaagccccgttatcactgccttcctctccaacaacagctgctgtgatcacgcacaaacggccaaacgggggcaaatccgtgccaaagcagggccatgggctttcctgatcagaaggcctagccccagcccccaggcgcagcacacgggcggcttcctttcagaaacccagcctgcctcccaccagctggagtgggtgggtggggcggtagtggtgccagtttcagggaacggccggcaaacccacctccaggcgtgctccagcgggagcctggagaccctaggagagccctccccacaagcggcttccaggcaggacgcttccagaggtcttggtccaggggtgggggtgaggtggggtctacctttgaaacagctacaatttaaacttcagctacaccgagctcaaactcgattccgcagccgagtgtcggcgccagagaaggataaaaactcgggtctacggctccccaccacgcccctggtccggtcctctgggcttccaggagtcctcacgccatcctctgggttgcccaggaggaaggatgggcggggcgggcaggcgctgcgggcgctgcagatggggagggcgagcccgcggcacggcgtgagcgggggagaggcgcgcgagcaggtgtcggctccgtgacagggtcccccatcccgcgccccagtgctccccgaggcttagtgaggcaaaacccagcaaatgcttcagaaatgcagctcagtcggtcaccgggttctgcttcctcatcagacgcgcaagaggatggcgcttccaatgcaaatctcttggctccggccccttggctggcagccgccgcgtcccccgcctgcctggcgtcccgcccactccgtggcgggctgagacgaggcccggcgcggaggggacggggcggagcgggcatccctccccaccccccacgtggggctggccctccgcagtgcctgggcgcgctgcagtcgccgcgcctccccggccgcggcaccgcctctctaggcaggggcgggggacgaggggcaaggagtgggcgaggggtgggcgaggggcggggggcgtcactcaatcaggtggcctctggagttccccggggcagggcagagggaacacgctgccggggattgtgtacacgctccactgacaccagcttcacgctgccgggcagtcgccgatcacgcgtggccccgcgagcccattggccggcgcctcacacacctttgccgttgattggccggcctcaggctccgcccccacccccgcccgcggcgcggggcaggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggtaagtcatttggggatgcccctgtgcttcctcgcctggtcttgtctggggggccaaagggggcgcgaaccccgagccccggacatcagccatgcctgagaattggggctgcagcggagtcgtggggaaggaaagggcttcctgcctgcagactatgggcattagtgagggcgtgtgtgttggggagggggtcgaaccagggggctgggatcttcagacagggacaggggtcttgctctagatgtactgaggggaagggacaactccgcatggagacccgagagggctggtgaggaggaggatgacgagcgggggaggagtggggagggggccgttgccctgcagcgaggttggggtacagtgtggaacgagagtcgcgggagggacaagggggctaccctcacctggtaccgaggagagatgcccggtctggctcaggaacgcgagccaggggaggaaggggctgctcgcaagcactcgggaggcggggtgtccacaggagaggcgagtgggctacccatcctgggggtctgaacccacgcttggaagacgggggctgctcagcagatagctcggggctgggggaaggggcgcctgtcgtcggagcggggggatgacacgagggcccgccgacagccctgggggacgagttgctcccccagacgtctggagggggactcttaccccaggggcaggtggccgccttctgacgactccttggaagaggcggggagccgcctctggggcaggagggtgggaagcgggacccagcagctggggcgggaaggtgggcggggggagctgggccgcgagacgcgggggccgcgcgtctggagccggggcctgtgggggctgcacgtctgggaacccgtggagacgcgcggcgggaggggcctggagctgccggaagccacggggagggggcgccgcgtctacagggaagagacggggtggtctgaggtcccgtgggccgcgtgggcgggaagtgccgagggctcggccgggttcccgggggctgccggcgggaggagggcggcggccgggtttccgcggggacctggctcctcctcccgcatctgaggcggaagccgggggtgggccgggagcgggtgcgcccggggaagcttctcgtccccgagtgacccagccccggcctccgccaggggcgggagcaagcccggccccgctgtcggttcctaagggaacggcggctcgcggggagctggaaggggcgggcgcctcccggagcctggcgcccgcagccccgcccctccccgcgggcccggcgcgcacggccgggcggttggcggcggcgcccgcggcccctcccccgggtcgggcgcgggcgggggcccgcaagctcaggaagtaggggaaaggtgacggcgcggcaattcccagttcacgtttcctgcgcctcccggagcagccgctgatcacgctttgttcacatgcctcgccccctcctcgcccacgcccccgccccgggccgcacagccaatccgggctcgggccgccgagccggccggccaatggcgggggcaggggcgcggggacgtgcgagcggcgaggaatgttcccagtgactcacccgtgagcctcattgaggttagggcggccccctccgtcggtctccgccagctaggatctcccccgccgtccgcccccgcccctcgtctgcctcccccgcccgcgcctccgcccgcgcttccctttcctgcctcgcgccccactccctttcctcccctccctgtttcccttcctgtccttcccagctcacgctctctttccctgccgcctgcctttcttttttcctttttttgcattggcgtcttggggctgttacacacacgcgcgctgtccattgcagcttacataaaggcgggcgcgattatgcaattatattgttagcgatatttcaagagcaatggctcgttttcttaggatttcaacacgaaggcatcatgcatttttgaaaaactagtattgagaataataccttgcaacgtaaagaatgttttttggtatttttacacaatctctactttgaccaaacgagtctggacagttttcttttaatggaaaataggagaaatggtgagtagtaccatttttttttagcgtagttcaaagaactttactataaaacattaggtagttctacaaataagtgcaaaacctgtgctgttattttgtcatcaagcagttctttaaggaattaaaatagattctactttgattatgctgactttttaaagtcggtttttgcaaattccaagtagaatattaaattttttgattatccagtttttagtaatattgcattagctatgttgtagttatgtatggcaaaccattgtgtcaaatagattcagtaaaagggagcacaaatatgaagaggttgaaagttaattaaaataaacattagaatttttttctatgtatatcacttgatttttctttaccataatcaagtgatcaaattttagatcttaaataatgcaattttaacttgaaagataccctgaggatcccttatcttttgatttttatcccaaagtgcaaagtgactttccaaaggtcagacccataacaacaggccagagctctactacattttgtctttattagaaggttttggctattttttttttctatcagcaatttgtacctcaaaagacctcataccatacctgtaatatttaagaagataaattttttgccgcactcttagtttttttgcccgactccagttgcaggtagctactctggaaagtctatataaaatactccttttcttcttagccaaatacttctccttttggatcacaaatgcattgataattttcgtcttagtccccttaatggtagtaggtgtgcctctctcccatgaacggatatcgctttatcagtgttaaagtctaaatgttaacagaaaaaatgaggaagattttattgccactactgtgaggtttgggttacctacctaacaagtgtagctgaacttccttagtatcatagtaagtgtgagaggaaaattatttctgattttaatttggaaagttgtgtgagttgtaaaaaaaaaaaaaaaaaaaatttgctcatttttctgtgtgtcatttggatgacaaaaaatatgcttataagctttcctcttttgtttttataggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcatttgtaagtattattgtttttaagatagacgtaaattatataatttcttaaaatttatataataaactgtagatttctcatgctatgtatttcccttttctttagtgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggtaccagccacttcttatatctttagtgtttaaatgaagagattttggctgtgatcacacatttaaacccaggatgataaggaataacttgcctttagctagtttagaggatggtatttaccagtgcaaggtcctccaaaaggctgtattggaggccgctcacgagtgccataatccttgcactttaggagaccaaggtgggaggattgtttgagcataggagttcaaaaccagcctgtgcaacatactgagacctcatctctacaaataatttaaaaataagtatgtaaatactttattgatgtgcttttgtttcagtctctcgatgattctgtagatgtctgagtagttactttaataaggtatctttaaagcctttgaatcatagttaaagtcaggaagtcttttcatttttggctttttttaagggatgaaaaaaaactgctctgttgcccaaactggtctcaaacttctgggctcaagctatcctcctgccccagccttctgagtagttgggactacaggtgcctactactccacccggctgccttatttcatgtggggaagagttttgtaaatgtgatcaagtgacaagttgaaattggagcaatacatatctcatattcatttgacagtttgatttattagcttttattatttaaaatgtatcttctcatatacttttagacagaattgaacatataatttacggcaatcttatgcataataatgatttgtatgtctttgttttaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgtcctgttaatttataggagttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggtatatggaatggtcattgcatttcttaaaaaccattctcaactctcaccttgacattgatcacttatattatccaaggacttagtgtctgaatttctctaagggtctcattcaaatttagaactgtaggagtatgtctttaacatgaatccatttagagagtatacaaagtgaggccaaatatctatttggtgaggtaatatgtgaaccagccagttctaagaaaacacatttaatttttaaacattgttttttatttttcaagacacagtttcactctgtcacccaggctggagtgcagtggcatgatctcagctcactacaacctccacctcccagattcaagtgattctcctacctcagcctccagagtagctgggattacaggtgtgcaccaccatgcccggctaatttttatattagtagagacggggtttcgccgtgttggtcaggctggtctcaaactcctgacctcaagtgatccgcccatcttggcctcccaaagtgctaatttttaaacattcttgaatattttgatatttaacaatattttgatattaacgaaatcttgttaagtagtattcaagttaaagggaacaccacagtgaataattacaagcaatgaaactgccgtggcaaatgaaaagaaggctgacttattaaatagcgagtaaattgcttacctctagaagttagacaattaagtgataccttaaatgcaataaacatattggtacttaagcctcatgaaaagtaatccacctctgaagagaaacacttgttagtcactcatcagtggaaggaactaagggctgtaaatgctacttggtgtatagagtataattttgtagattactattttagcttgcactgaaatccccttgtggtcaggagaacatcttccacaatgcccaacttaaccagtgacctagagtctgcctcattgttgaataaacaccatggtaagggaccgtgtactcacttggcagcagttgtaggacaggtttctcaggacatctgtacacctgttgctacttttcttggaaacttaataccacatgagtatgacatagctgctggagagaggctttgccattctggcctctggtgtagctttggtgttgggcacctggaccatcctcttgctttagagcttttcatggtggcaggtgtccagaagtgggaatggaggaagatgactgaaatattctctgcctcccccaatgctcagtcccttgtaatgatgtggcccatgaaactatgccacccgttggccgtattctttgcagtcctagttggtatctgagatctttccttaggaatcttgtaaatagagttactgtttttgagttgaacgttgaagcaggatctaatttttttttttttagacagagtctcactctgttgcccaggctggagtgcagtggcatgatctcagctctctgcaaactctgcctcctgggttcaagtgattctcctgcctcagccttcccaagtagctgggattacaggcgcccaaaattaataagttaaacttggtacaatactattaagttttcataaggatactaaaatggagaaaagttgaagcagaaacacctttttactagcttaattttttactagcttttctactttttcctattacaggacctaatccaggatctcaaattgcatttagttgtcatgtctctgcagcctcctccaatctgtagtagttcctcagtcctgtcatttgaacattacttgtcagttattttgcagaatgtcccttaatgtgggtttgtctgatgtttattcatgattagattgaggctatggggtatgtgggaaagatgccccagagtgataatacccttctcagcacatcttacctacgaaaacatggtgtccatatgcactcctgatgctgctaacctcactcactttggctagggtgatatctgttggaattttccactgtaaatttaccatttttctacttataattattaaatatgtagagggacatactttaagattatgcaaataacctgtttctgcttacacttttccccatttattttagtgtccttatggaaatgttgcctggggcaattattactgtgatatgctaatttcctcattatttattaagttggaattctgtaagagttgtttcttctccatttattcagtttttttaaatgtcagcatggacttgaatatttatctcattctttgagttgtaacactatacttaattattttgtgactcatttgtcccacctttggcccttgttagctctttcagtattcaaccatttttaataaatgaagatgaaaattttatatggttcaacctatcatttctcactggaacgagagctgtttggtattagtaactacttttttaaagtgttttctacctgcgttgctgccaccctgtctaatccagcatctctcactcaagccagtgcagccacccctaactggcctccctgcctctgtcctgtcttcttactatccagtctcctcacaacagagtcttttgaaaatgcaaacctgataatgtcacttttctgtttaaaacacttcagaaatctcccaatgctctcagagtcaagtctaggttttataacatggtctagaacagtactgtctaatagaaatataatgtgagccatatgtaatttgaaattttctagtagccgcatcaaaaaagtaaaaaaaaaagtttatatttaaaatttgtatttaaaaaacatttaatttaatgttcgtggtaatctttgaaatctagtctagtctcagtagggactagcctcattccaagtgctctgtagccacaggtggctgctgcagtggaccgagcaggtctagaagaccgtgcacgtttaggcttctaccaacctcccaccacaccactttccatcttgtactctacattgtgtccaagctctgagccttcctatgtgctatgtcttctgctgggaatgttttccctgccccccaaccctttttttcccccccaagacatagtctcactgttgcccagcctggagtgcaatggtgtgatctcggctcactgcaacctctgcctcccaggttcaagtgattctcccgcctcagcctcccgagtagctgggattacaggtgcccaccaccacacctggcttatttttgtatttttagtagagagggggtttcatcatgttgaccaggctggtcttgaactcctgaccttaggcgatccacccaccttggcctcctaaagtgttgggattacaggcatgagccacgcacccggccttccctgcccttttaccttgacatttccactgtcataataatcattattaccctttacttcatgtcttttttcccctgactgtaaaacttcatgaggaaaagcaccctgtgggtctagctcactgctacatcaccagcatctagcacagtccctgacacgtagcacaggcttaacaattttgccaaactgaaagttgagccgtgaagaggcctgtgcaattttagggagggagaacaactaagaagttgttacatgcaggatatagaaaaaggagacgagaagctgaagattgcctttttcttgttcccattattctttgctagtgctggaaggaccatttattccaccttccagactcttaaagagtctcatggcatttgaattctcttcattgcatttttaagggggcagggaagaaatctgatcaagacacatacactaggctcactaagtcccttcgtgtgagtctaatgcttcagcctggaagggctgaaaagtgttgccttggctcttaccctaccctttctctttagaagactttcagaataaggcagagacagaaatggagacttccatcaagggcactggacatcagcagagccctggaactagacgagatcttctgggcaacaccttaagggaattttattctgatgccttaatccagtcctggcattttgctgaccaacttaagcagagcttgagaaatgataaagttgattttcgaagagcactgcctctaattttttacacaggtaactgtgccctggaggtgtcagtatcagggaaagatcaaaagatcaaaatgatcaaattgaaagacctggtatattaaggttctcccagaaaaatagaaccaatggaacaaacagaacatgtatacatatgtattccttatatgaaactgaataaaaggaatcaggtcatgtaattatggagactgacaagtcccaagatcagcagtcagccagctagagacccagaagaaccaaaagtgtagttctagtccaaatgccagcaggttcaagaaccaggaagagtctatgtttcaatctgagtacaaaggctggaaaaaaaataaagtcccagctcgaaggcagtcaggtatcaagggttcctcttacttagccttttgcttcattcaggccttcaactgattggatgaggccaatccccattggggagggcaatctgctgtccccagtctaccaatccacacgttcatgtcctccagaaacaccctcaaacacacacccagaacgtttgaccacatatatgggcatcctgtggcccaatcgagttgtcacataaaattacctaccatgggccaggtgtggtggctcacacttgtaatcctaatgctttggaagaccaaggcaggaggattgcttgagcccaaggagctcgagaacagcctgggcaacatagggacatcccatctggacaaaaaaaaaaaaaaaaaaaaaaaagaaagaaaaaattagccaggcattaccatcacattggggattaagtaaaaataaataaatacatacataaaaataataaataaaaaattagccaggcatggtggtgcgcacctgtagtcctagctgcttaagagcctgaggtgggaggaccacttgagactgggaggctgccgagctgtgaccacaccattgcactccagcctgggtgacagaatgagaccctgtctcaaacaaaaacaaacaaaacaccacacctggattctagtcctggttacactgataactagtttattccttaagaaacttgctttatcattctgggtctgggtctacctttaaaaatgaggctaaatgcacctgccctactcagcttatcaagctactgacaagttcaaataaggttttgtacacaaaagcccctggaaactatagtgcattcgatgtttgctggcaccattgcagcacccgtgtccaggaacacacgcatggcagtggatgctttagaatgcccactgagggtggctgccaattctaaaaaagggaagccacctagaactggatgattagagaattttgatacccagagtgcccacatttctacctatgtatggtaattatttgggtaacccatttacagtaaatctcattgcagcgaggccaatctaatgggaaggaaagcacaaagcatgaaaacatggccatttgctgaggaaagctagagcatgagtactcatcatttaattagaaagcatacatttgggtagagttaccatagaagcctccaatgtatgaactgagttcgtcaatttactgaaatccctttgttctctttataatgatcccagcttgagggaattctccaagtctgaatttagttcattcattcatgataaagtgcccaatctcagatgccccatcaagcatgggctaaaaatgatataaagttatgcccagagctctaggaattcaaaatcccaagggaatgaagatcagcatgagtgacaaaaacatctctgccccaaggaaatcatcaggccacacctgtgccaggtctgcccacataatgcggcctcaaattgacagacacagaattccaaggaagcataactctctcatctttggcttattctaacggaagggataaaactaaatggagccgtctgttgttttaagcttcccctgccagttggcatcctgatcttgacagagattagaaattcatggctctctaccatggatgccaacaatccctgcatgaccttgattgaccagcttggcagcaagatgctgaaagggagaaaatgccccaaaatataaaaagatgacaccttatctttctttcattttcttggaagaatttaatttttaattctaaattttaattctaaattggaggcacagcctgggtttagaaaaatctatataaaattctgagaagaaaagttaagaaataacgtgaagtgaagaaaggatgacccaggctgtggtagaagcagtttcctatttctctgattaagctgtgtgaagcttgaatatcagtttcaaaaaggcacccttttagtttgcacaatctcattgaaaagataaatacaagcactgagtgtttattaccactagacaaagtaaaacagtgtggccttgtgaaaggaagcttctcctggggtcatggggccatcatgctggtgtcacttctatgctggctacaaatgtaagctaagtaagcaatttcactatttcacagctttgtttcagtatctatacaatgaggttataacgctcatctaacctgtttctcaagatagaattaggcttgaaaactctgtgtgtgtgtgtgtcgggggggtgttggcagtggagggagggggttcaaacattaagagggctgcccaaatatcaatggtgggtattgcactgtcacaactcagatcaattattaagacagaaaaggcccctataggtggggcagcatccgacatcagtatagaaattgtcatgttgtggtccctgttagggaggaaggtcaaattccaaatgttcacaaaattgggatgaagcaatgaagcagctcatttccaagatggcacccaataatttttgctcttggatattcatgtcctcatgtagtgtctgctcattttgactagagttgatctatataaccagtaggatggtgtagaaacgatggtgtgtaatttccaagactcctcataaaagatattattgtttccagcatgatccgtcttggatcactcactctgagggaagccagttgtcatgttgtgaggatgcacaagcaggtctatgcggaggtctacatgctgagaactacaccttttgccaacagctagcaccacgatgccaaccaagtgagagagctacttggaagtagatcttccagcctcaatcaagccttcagatgacggcaaccctagctgatatcttgactgtaacctctgacaaccctgagccagaacaatgtagctaagccatccccgattcttgacctacagaaactgtgatagataacaaatgtatataattatcttaagccactacattttgggataatttgctaacacagacttagcaatggatattaaaagcagtgaagtatttctacagagtaggcagtaagaccccaaagccctgaaataaagacaatgttcagtttagtccagtttccatgctgactttagctctttaattggacaatatattttgggaagtggcaagacagaggaacaatgaacatatagattccagagatttctacgaattgggacaatagtattgaaacttctaagctttgattacctttttttaaaatagaagagtgtctggtatactggttgtattagtttgctagggctgccataacaaagaaccgctgactgggtaggttaaacaacagaaatttatttcctcacacttccagaggctagaaggccgagatcaagatgtcagcaggattggtttctcctgaggcctctctccttgccttgtgggtggccatcttctccctgtgtcttcacatgattttcctcctgtgtctgtgccctgatctcttcttttaacaataccagtcatattgaattagagcctgttccagtgaactcatttacccttagttaactcttttgaatcctatttctaaatacagtcgcattctgaggtactggggttaggactttaacatatgaattttgggaaggatcatagcattggtcaacatgtcagtctatattattccatcataatacaccaatagcagtatttttttccttcctttccttccttccttcctccctccctccctcccttcctgccttcctcccttccctctttcctccctccctcccttctctccttcctctttccttctctccctccctcccttccttcctccctcccttctttccttccctccccctttccctccttgctttcttctccttccttccttccttcattccttccttcctcccttcattcgttccctccctccttccttccttcattccttcctccctccttccctccttcctcccttccctctttcctttctccctttctttccttcgttcctccctccctccatttctccttccttccttccttttccttttttttttaatttttttgagacaggatctcaatctatcacccaggccagagtgcagtggtgccatcagggctcattgcagcctcaacctccacaagctcaggtgatcctcccacctcaacctctgggtagctgggaccctagatgcacgccaccaagccaggctaatttttgtatttttggtagagatgggttttcaccatgttgcccaggctggtcttgaactcctgagctcaaacagtctgcccacctcagcctcctaaagtgctgggattaaaagcatgcaccaccacagctgcccaccaagaacagtattttgtaaactggtctgaagttcctatttctagcgtctggtaaatttcctagagggctgagtgctcccacacccttagcccatgtcacaagtgcaaagtgcaactcccagccaataggaagtcatatttttcagctattcactgaggtatttcttggtcatggaatattctttatcctcaacaaagttttccttcattacatgcttacaagcattatttgtgacaatccatttttttctctaattatccccaaagtaagcttgtcctcctatggacataaatcagattcagaatcctctctctattctcaacaatatcattaatcatgatggtcttttttaaaatccatatttagatttgttcactttgatttttctaagagattatatattttcttcccaaatttagttcaaccaggaacattcaatcaaggctttagtcagctttgctggttggagttatggcctggccaagatgccttctgattccattcatcacatccattctattctttgccagtgtagttctaataacaatgattttcaaacagaaagggggcctaagtccccatctctatagaggtcataaggctgagttcatcaaatatttcagactctttagccaggcgtggtgatgcatgcctgtaatctcagctacttgggaggctgaggcagggaaattgcttgaacctgggaggtggaggctgcagtgagctgagattgtgccattgcattccagcctggacgatgacagtgaaactctgtctcaaacaaacaaacaaaacaaatatatatatatatatttcagatatatttgagactctgcttttcagacacatggtagcattgcgcttcccccttgtgtctgggaggtctagccaatgggctgtgaatggaaatagtgactttctctctactgtggtgaccagcaatattggggctagtcagccttagttctggagcaactatgacaaggaatcatgggtgagaattgaaccttgctggtttaattgtgattgtgattggagggattatttgttactgcagcataacattgacttatatcttatataatgtatcctgactgatacaatcccttttgtctcatgaggctgcctctgagtgaacttattccctctttccaagggccacgtctgcatatcaaaatgtattgaaagaggtgactttgaaggacaaaaaaacctctaaactcttcctccctgacaataagtaccttatatttgcataattaagaggggcaaaatccaagctcactggaccttgaacaaagaagcact

SEQ ID NO: 491 - DNA, 2899 bp, Homo sapiens
cagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgtcctgttaatttataggagttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattc

SEQ ID NO: 492 - protein, 480 aa, Homo sapiens
MLNFGASLQQTAEERMEMISERPKESMYSWNKTAEKSDFEAVEALMSMSCSWKSDFKKYVENRPVTPVSDLSEEENLLPGTPDFHTIPAFCLTPPYSPSDFEPSQVSNLMAPAPSTVHFKSLSDTAKPHIAAPFKEEEKSPVSAPKLPKAQATSVIRHTADAQLCNHQTCPMKAASILNYQNNSFRRRTHLNVEAARKNIPCAAVSPNRSKCERNTVADVDEKASAALYDFSVPSSETVICRSQPAPVSPQQKSVLVSPPAVSAGGVPPMPVICQMVPLPANNPVVTTVVPSTPPSQPPAVCPPVVFMGTQVPKGAVMFVVPQPVVQSSKPPVVSPNGTRLSPIAPAPGFSPSAAKVTPQIDSSRIRSHICSHPGCGKTYFKSSHLKAHTRTHTGEKPFSCSWKGCERRFARSDELSRHRRTHTGEKKFACPMCDRRFMRSDHLTKHARRHLSAKKLPNWQMEVSKLNDIALPPTPAPTQ

SEQ ID NO: 493 - DNA, 62231 bp, Mus musculus
  misc_feature (1)...(62231): n = A,T,C or G
taaaatgttatttgggcatacttacagtgtggtgatttcacgttcatatacttataaaatgtctaaagataaaatcaaggtaactgttatttccaacccctgaaacagttatcatttctatatgatgggaaactttggactcttctcttctggttccttatacaataaataattcatttttgtaaatgatgttcattcatccatcctgtagtatacaggacgtattcttcccgtgcaaatctcttttgtacccattacccgctccctccccttgtgcctctagtggccaatattcatcgtttctgcttccacgggaccagctttcttaatttgctgccttcttatgctaacagatttttttcatgcattaaaaaagtgtcaaaattaattacatgttatgcaaagatggatgtagaacctgctccacaaagcacaatgtattgtaaatgaaggcagtctctgaaggtcggctcactactgggagtccagcttaatagaatgtggtcgcctgaaggaaattcatggcttgagtgaagaggtgtctggaattcccatctgggatttattagtgtgtgcgtgttggtggcatagccggatgttagttcttaacttaaggaaacaaagttttcaacgtgacgatggcgactttttgctctgtcaagtggtagcagctgccgataccttcctggttctggaaactccatcagctgaagtggagtgttgctcaatctgtcgtactaaagggtctggatgccaatggtagtgggctgtgtagttgatgagggagctagttaggtgcctccttatggggaagcacagcccgtttgttgacgcgaacatcttctgggaaggttgcatgtacccccacactctgtttatggggatgataaagcaagtacgtccactcggcacacgctgtaaaacagaaggcttgcagctggcagagttgcgttcctcttggctccttttctgaaggaatttttggaaacttgttagatttatgaatagttgcagattaccagccttggtctccagtgcaagtgaatgctcctttaaactttgtttttttctttgaagatagcagatttggttttttttttttgatggttccataatatactttatgggtggaggaaatacagtttattcttacatgttgtcatagctcatgtataattaaatgttgaaatgattattttattggttatatagcctcttcaaaggacccaacatgtattataggtctagaaagggaaataggcaaacagacatgagggataaacttgtatttgcaatctgtctcagaggacatctgatgtcaagcttaccaatagtagaagttgcttggagaaattcaccactggccctccgtaggcttcgttgaaaaggagaggcctgagtctggctttgagagaggccaaaagaggatgtagctgcaggaaaaaaaaaaaaaaagtgcacctggcagtagctgcccccacagtgtgactgcacagtgttcttgtaagtaatttccagttaatggaaacaaatgtcaaaagtttctgcatgattttttttaaagatttatttattttatttatgagtacactgtcgctgtcttcagacactccaggagaaggcattggatcccattatagatggttgtgagccatcatgtggttgctgggaattggactcaggacctctggaagagcagtcagtgctcttaaccactgagccacctctccagccctgtatgattactttttaacccagtcgtgtcagtgagcctgtgggcacatgcttgtgaatttgtccccagagacacttttcatgctttcttacattactattgcttttatctgggggagagatgaacacactggctggccccctgggagtggtgtctcacctgcagcccagcttatctgtgtcacttaaggtttgtggtacgtagggactgttgtattgtatccttggcaggtatttgggttttcagcccatgctgttgggagaaacccgatttaaacattataagcgctataactgggtaggatgacttgactggtcagtgcaagaatacaggagaaagggccacccaggaaacattatgactggcatttgaaattggaaataaagggggatagagtagtaacatgagtgatcaccactagatttctagccactgttgcccaaatggtggggggtggagggtggggaatgaatgttaagtaggaagaaagtcaagatgttcaaaacctgatcaaggtgtcccctgacggtgcctgcaggagtggatgtttctaggtacactgacactaagcagccatccaagcaggccagtactaggcagttgacaatacatggccaatttaataagtatttatatactaagaactttgtcatcctatgaagaaataatatacttaagttgaaagattaaaatgtgaattacttaatgtcactaatctatacatttttttaatgtttgcaatgataattttttgtcacatgtataattttaaatatgataattttttaaaaaatccaatgtgttaaaaagaaatattaagccagtcagtggtggtgcatgcctttaatcccagcactcgggaggcagaggcaggctggcagatttctggattcaaggccagcctggcctacagagtgagttctaaggacagccagggctacacagagaaaccctgtctcaaaagacagacagacagagagagagagagagagagagagagagagagagagagatatggatgaactctgatggggactggctggtaggaaatgcagagcttgctagagaacaagaaagaacagctttctccactctagatattggctcactgggtggcagtgaagtctctagggtgtttgttgtgatggtagaacttgttgggaattcgccctctaagctgctgaggcctgctgttcataaggggtcttctcacttgggacatttgcccattacccgatcgatgccagaagagactctctgaggccaggttgtaccaatcagtcaagtgcacactgagtgccagctgacgaagtgtctgtactagggagctacatgcctaaggcacccacaaaaagcaaggaccaagacctggaagggaacttcttcctataaaacttcatcagtgctgtcctgaataaacacagacttctgtcagtggtagaagaatggctaaagaaagacccctgagttttctcatggcaggcaatgaagaacaggcttagaatgtgaagtgagagagtctgtcgtgagccacctcacaacttctccaaccctgagatcagatagggtcctgcaaccctaatttcctgttctgtgtttccatcagctgaaatcttgtgtttatcacatttctttggaaagaaatgatatcatcacgcagacacaatgtgacattaaactgtagccaacccgagcaaagagcttatgcactgtgcattgcgcaagaggttagatgttattctcgtcccctccttgtccccagtctgtgttatgccatggtgcccttgtgagtttatggtagcatccaatgtaaacatctcagaacagcagttgtgagtcctgatcagcaacttgaggccacacctttataactaatgagagtctaaggagctgatgtagttaggaatgaattagagtcatatacagtaaaaactgtatagccaatgttaattttgaagacctcccagaaagtcacttaagactagcagcctgtccctcaacatttctaagagttatggactgagtgttgctttctagcatggggacaggttgtgatttctttggaatcaacaatggctgcctcccttttagaaacgtttgctatggggagatggatacctcaaaataactagaaaagaacattctgaatgttcttttttattattattattttgattgtttttaatacagagaaaggaaaatgttgacaaggatgagagactccaagtgtcttttatagatcaacatacagtgcactaaaacatcacaggatgctacatggggatgttcagttatcctctctcaatgtttttatagtcattctttctctatttcacatttatttctgggcgtgcgtgcgtgtgtgtgtgtgtgtgtgtgtgcgcatgcgtgcgtgagggtatgtacacacgaaggtcaggggacagtttgagggagagtcagttttctccttccaacatgacagctccagggcttggtggcaatcaccttttactactgagccgttggtcatgcacatctatcaggttttcaaaagctacatagtcttcaatgtagcactcacatctcctgggtaagggctgccagggtcaaaggccaggcggaggtgcagagagccgtcagaagaggggcaaagtcccagctctgcatcgtcatgttttccaagataaaattagggtgaacagcgctccagggactatgtcattattttttgtatccgatcacttatagctgaaattgaaaagaatttaaatgccatgcaaggtgactttgctgaatttagtagttaaaaaaataaaaaatcagtggaaatagagtttaaattgagaaagttaatgatttttttacctttttttttccctacaaagttcatgggtttaatatcacattctgtactctgtacacggctcaggtgaggggggttgtcagaacgtgcaccccatcctctgaggggtaactgacacatatctctatagcccctctctagggattggccaaataaaccggtttccgaacctgacctattcaagtggaaaacctcctgagccacagcagaaaaggagcctgtcctcttgacctgaaccctgtttggataagttctgcatcagttcacattttaccgcctgctgagtttgtctgtccagtgtcggcttggccatccctcccggagtttctccacgagcctcttctgtctcttaaactgtgaccacctggcacacggtcaaaacctcgtaggttctgttcttgtccaaaatctgacatgaaagaagcagactatgacaaccggacgtagcttcaactgccaaacagatctcagactaagagtctgagttcagctttccacatgtggagcatgactttgggatttcaaattttattcagaaacttgcaaaacaaaacaaaagtacaacacacacacacacacacacacacacacacacactctctctctctctctctctctcctctgctggatgcagtcagcctggactccttactcagcctgtcttggcgtagttctgtggcccctcgaagtgaacacaaggtagagagagatggtgatcactggggatcccaggcagagcccctggcttctgaacgcttcacagtaatcaatcacagatgtgcgccggctatcagcgctgggaagttgcataagctcagattgcatgcagctacggtcagccagccagtgcgagggggtctctcttaggctgctccaaaagaaaactcagtcataagtctattctcatctccttgcaaacttattttttcagagtgaggaggaaggggcagtgattagaaggggagtcattttccagtttttaagcttcaattccaactcattagaaagaggaactttctaattaggaagaaatggtgctgtcttccatttgtccccacttacctgggcataggaaggactccagtcctggtatgtttgctatctacagctttgccatatcaatctgggtcagcatgtagggttccaaaaagacattcctcaacagcccaaaccagtctggcctcgttcatgaaaatacacgggaaagagataaggggcacactatagtttgtgtacccagccagcttccttgcctgtttttatcactgagactgttaaataagtggcatcctccccattttacagatgtacaaacagaggcttaacagcttgcctgtttctagaggaaattcttttaaagacagggaatagaggggatcccttttaacacaagcaaggcttaaccagcatgggctctgctgtctgtaagaaggacaaaaaactcaaattgagtcttttcaccccttaattctggttgttttatatacaaggaagcttggttggggaccaaattgcatttttaattaaaaaaaaaaatccaacacatttgtgatctcatgtagctgaataaatagatgctattaaatttatagcttatttaaagcattaaatgtcaagaatggaattgctttaatttgaagcggtgatctcagcatgtgaacagggattagagcagtctgtgctggaatgacagccagctgtaaactctttggtgaccttccagtgtagcaatctttgaggtattcctctgtgaagggaggactggcttttgtatgagcaactgggtagaaagcaagggcccgaatacaggagacaggaaggaggctcagcctccatacactgtggtctggggtccattgctcctcagtcagtgacttggcaagtcatataaccccctctgtttagttacatatcttagccatggtgatcccaaggggtgactttaaagaaaacctgtgctagcagcgtctctctactagtgtcccattgagcgaagatcctccgtctctaagaagctgagaccttcgcagatagatccagacttttgatccccgcatagacagactctcctttcctggttagcaataaagaagtttgagaaatttgagtcttcagccatcatcaacccctgagactaaacaaagaccgagaggccagagaggtaaatggagacaagatagaaagtcagagaaaatttaaagggcacagaaagagaaagggtcccctcaactttgggtgtggttgaattctctcaccaaccaagggtgaagagtttcgacataacagaatctaccgtgaagaatgcctgcaaagagaaggtattcctttgtatacccttcaggcctatagtaagatggcagagtcatgtgacctggcaatttaatcccactcctctgaggcctgccctgtccactgcacctcagagaatacccatggtcccatcacttggtctctcccacaccatataggaaggaaaaacaaggagagaaaaatatatttaaaaccctatgaagaatataacttctgaagccactgagtcaggccactgagtcacacatgtcacctattgtggaagacactggtgtcattttctctggagaagccaggtctatttcttgggtatatactgcccttctcctacaaacctaaatctaatgcccacactgagatccgattaaaggtctcccagtaaactccagcaattccaacgctgcttccaaagaggaaacataaacaaaaggaatcccggatgcatgttctagaaagaggaccagggactcacgaaaccttcagacattttccaacctggtgcatgcatctaatcgtctactggaagctttgtagcaagggtgatttcttaggagggaaacagaaacaaacagtgaaatcctaggaaacaagtgtgtgccagatgcatcgctctctgcctgccagcgtgcacctctgtgtcattgcctcctcctcctcctccctcagaactatccgctcacacccatccagcacatgaatgattatgtaagatttgctggaactgtcattgaaaatctgaatggaatttacccatagctacacactcccagaatctggtggccagtgccccgttttcttctcacttccacacttctgtggcctttcttggttcaggcccttgtgttctaactccctaaccgtacccacatactcatcagcgcatcaacatatgaggtcatatgaagcacacgcgtaacctcattggaagatacataagtagcctccactgttacacaaatatcctttcacaccgagagccagcatcctggccagtgagtgagggctgagggaagcccaatggggcttccccatgttttagaggatccaatggcaaggtatttgatggaatgtgaaggtagaggctggaagtccatagccccaagcacgtgggaccgagaaaaagatcttttccatatttcaggtcagggaaaacaaaggtcacttttgtacagagaccatgggagtctttgcagacaggtaatagaaaagttgaggacagcctctgagtcaaacagaaggaccattagaatactctgtaaacagctattttgtgacctataattttatatgttcagctcctacatcctgaccccagggcagaaataaaaactatcgatagctccataagaagctctggtcatgctatcaatagttttgacttcttcatttccatgtttttatttccttattcttttattcccatagccagtagatgccggtgcaggagcactcggcagacgtgcatgttttccactgcagatggccaggccctccttgagtctgctggggtgtgcatgatgtttccgagtagccacaccagctctccccacttctgcttgctagccttctgaactgcaaattctctaacccacttcattctgcaaaagcgcctgggtctctgtaagccaaagggcccagagcccaggcttgtagccaacccctcttttcttttaaaaaatggcttcattagaatgtaatttaagaggcttgtcctgttgcatgagatttagtcggcttacaaagatttagctcagttgggttggcactaatacatttttcatagaaccaggtgccttgtaaggaatgaatttaatccgtggtccagaattatcataattagagaaggaaggtccagctaaagaagagccacttctatgtgacttgtgtaatagtaggtaaggcctggatgaatggagtaaaccatcagaatatttgaggtgtttgaattctcccaccttgatagagacgggatacaggggtcagaacccaacgtaagatttaagtatgcacttttctagatgggaaatgttgctgatttggttgctactttatattaggtgatctatagtggatggttaatatgaattctgagcttactgcccagaaaggacactagactgtttcttaaacatacaagagtaagtaggggactggagagatagctcagctggtagagggcttgcttacctagaatgcacgaagcatttaatctccagccccacctaaactagacgtggtagtacaagcctctctaaccccagcacattgggggtcaaatgaggagaatcagaaggtcaagtgcatccctgaccatatagaaacacctctatgggctccacgagccctgtctccaaaagacaaaaagggaatagtcttataggcagttgcagatcactgtgtggcgtattagagcgctagtcactggctagccctgccctcttcgaataaaagcccaacaaatcaacactacgaagtattcacttggaagaagtataaggctaccagagctatagagaaccaactatctgttgtcatggtcatgaaacagaatagtttgcctgcccagggcacatgactttgaggtcctgccgacagctatagagtgcttatcctgtacagtctattttttaatgacctgggcattgttgctcttgaaccacatcagaacgttctcccccaaggtgactgctggactgcatttgaataaaaaagtttctctggaggtttctcaaggatcctggtgaatgttcaaagatctgcagggctgttaacaggatgctaaattgattaccaggctgctatcttggcctttaaactgttcgttcagcacatgttctccttgactaacctgggctgggctgaaggactttttgtgaaccaacgtaaaaacaagcagggtattaaggacttttacgtaacaggccttgggaggtttgcacatactcagatttgtgagagggcatttaataaatatgacataaaggggcactttccgaaggaagaaagaaaggccttctgccaggagccaacggatgtggaagctgggctgtcttgatttgcataattaccgcctcaccttcaaaaggtgctgcgtcttcactccagctctagatcccccgaaggcgtctcatttgtgtagcaaacagctgtggcgaggttcctccgaggcccaggtggacatctgtggacatctggccagcggaagagggaaggcaaagccggatgctgtcgggtagggaggggcagaacgattgctcagaaggacaggcaaagacagacggcaagggggcgtgtcttttgtttcagaagcatcggcatcctttgtgtccgccatgaatacaaagagtactgagcatagattgtctatctcagcagcactaggatgtagggcacaggagagcaaggttaaccgtcattttcagaagggtatagccggttattcttttccggccatgctcagttcccgtaggctctacagcactgatcttttccagatgtttctttcttccctctggctattatgtcttggttcaccttgccctttcaataaatttgagataaaattctggtagggtctcaagtatgttagaatcactcagcagtagcgactgatttaatatcagaccagagagctctatctatggcatcccccttgccggtgaatagcttcgatactgatggcaaactgattggcaaagaaaaggcaagagtatcctttacaaagtttattgtaataaggtgcaatagttagtgacaacctgtgtgtagaacttacagtttcaaatcactgtgtttatagtgccatctgtaataaccagacaaatctgtgaatcacatactgcttttgtcttcattttatagataagtagatggatatttgagtttttttttttcttaaggtcctataaataataaatagcagaattaaatccaaactacaactcaaaaaagcctggtcagtttacatagtcctttcactaaatttaccacaaggcctggactccgccctcctttccatataaaaatgctataagaaaaagaaaggcagctggaaaatacatttcttaaagactctaacctttctcagttataggagaatgtaacactctccagccagagatttctttccattggatgttttcctttcaggtattttacttggagcccctcactctagggttgatgctaaaacaaggccctgtaaaaaatacaatctctgtaagacaggtaggctggtgggagctggtgtagccaccccagagttaagatgacttcctctgagccagtggtggaagccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagtgcttgtccccctgcacgtctgcccccattcgttctgtccagggcacctttcctgcactgggccccacctgcctggtcgcctccacccgcagtggcccctcgggggcggactcctgcagcccagccccgcgcgattcgattcgtcactcctgcggaactttcccctgaaaatccctcccgcagccgctcgctcgcccgccccgggaggttctgatctcagaggcttcctcccaccgcgtcccgcccgccggcgcacatcgcactcgtctaggagcctcgcagcctcacgtccatgtccgtggcggtggcgcctgtggctgtgcaccccgacagcatgctctccgaagcggaggagcccagggaaggtacgccagccgctggactccgccaagttcagcgcaggaatgtggaggaaggcgggagcaggagctgatgggagctcgcagaaagcggtggggaactttgtctctgcctggctggactttagagagtaggcagccctgtcccaccagccaggcagttaaggagcaaaggacccagcaccagacctagccaagccagcccaccaaggctgcttttcagatttctctggaaaggagaaagcgggctttgactgttgagaatacaaaacgcgcttggaatgggctgcctgcctgcctggggacaacccaaagctggattcccaggaagagtctgagtccgggtccctttgaaagggggtgtcaagaattggaagggacatacgtttccggctaaaaaggggaagcagagtgaggagagaagtgaaagatctttatttggggaatatgttaggcttattattttcccttttatttatttaaatttttcatgccagaccttctgcagtttccgggggcctgaaagatgggaggggggcctttttgtcctttgaaacaggagagtttgtccctttctgtctttgcaaaagcaagagtttcatttactcctaacagagctggtgacagggctggacaagctccaaccaaaacactattatagctggtgttagcttgggagtttatttgtgtgtgagtgtttgtgcgctttgttccctgcaacttgatgtatacaaaagtccacttgtaagtgggggtgggattaggggtagctggggaaaattagtcaggtgtgtgtgtgggggggggggtagtgttcaaggttgtgaagtctccctctcttttcacgtagctttttgggagactcttttaagttgcaagtcagtcagagctaaggcagcggcagagcaagggaagttctgcattttgcaatgtaggctttccagtgtggttgtgtacctagctttgtggcatgagggaagctgtcaattgaaaagggcttgtttaatagaaatacgggccagtcagtggaaaaaatgacagcagaaggattgtgtctgagcttcccgtgggctttttggagctgggatgtttccctgtaggggcctctgtaccaacagaactttgtgctgatgggtgctttctttttctgttttgcaccatttgcacgaagtcaaaagcagtcaaagagaaataggagcggagctgagaaaaccatccttgaactttataattgcatagcacttagattagcattttcttcctggcctgttattcccggccttttacgaaagggggggagtgggggtggggtggggatcggatgaaaaactgctaggtcaactgtattatacctccctctagcaacatccacagtgtccccttctttgctggctctgctagggagtttgtaagctgtgtggaaactggtgtaatctttagcttgatcctcacctgcccttgcctgcaacggtgtacctaccatacaggctttgccctctgcattttaaaggaagcccaaaatgttcgtgtctgctagaattttaaactgatagtagggtaagattttctttttcttttttactaagtctgaggaaaaagtgaacgattactttattgaccggactgattcactgaagcttctgctagggcgtgtgtgtgtgtgtgtgtgtgtgtgtgtgtgtgtgtacctgcttttatgggacctaatctctcacactgtctatcaccagtcagttttcttactcctttatcctctctgattccaatcttccctatctcccttcacttacagtggagttctttcctctggtggcacacttgtcaattctgtgtagtgagagatcagcaggagcccttcaaactctctgagctgcaaggaaattaattgcccttggattctttgtatctaattcgttgtaatggtagacacttctaattcatcctttagaaccctagtaagagactagtgcactttcgggggaattgaatctggaaaaaccatcgtgagatgcagaagtccttagaggccggtttatttgtgcatgtgcatgagcgtggatgcatatgactggggagattgttcggctcctatggcttagaatgcacttgactctgtgccagtggtagctcccgtctacagtaacctcttaaagaactgctttcatttcgcctgctcgtcagtaagtgactgtgaaagtgagggggaaaaaatctagaacttgctttatcaaaaggcgagttaagatatgaagacataagtggatgggaagagcccagtctattaaggaggagaatgcctttgaaaagaggctgtcaacaatttcctgtggatatgggcttcctgaggagtcaattaatatccacatagttggcatttagatgcttcctgttgagtacattgcttaattatgagagtggtaaaaatgaatgatggttgagctcactgtggatgatctagacataagtgctgaaggatccaagactcctttgccttgggaatcaatcagaatttttagagtggaaatgcgaacgccattatcgctttgtgagcacttgggagagaatggagggttggctggcaagagagtgcagctctctcctctgttgcccacaccaaccatttccctttaccacctaacctaggcctctcctgactcaccagtcctgctatttcacaacaaacatggcggccattacacaacctcctgcttgtagactggcagcctccccttcagccacactcaccatcatcctcaagtcttggagtaggtgtctttgctaccccagaatgacacccttccatcttggggtcccacactatttttcatgacttctcctccatgcttagatgagagggcactcccccattctagggtactagtatttgccgctattcttttttgccctgatactctagtctttatctgaactcttttcttagtctactctttggagaagccttttctggtcgaagcaccccacgccccagtctgaaccaggacccccagtttccttctctcagaacacctgtccctttccttgctggcacacgccacgctagctaatctttcttcctgggcaaaagagtctctcttagtccccactgctatctctagaacctgtgccgtagaggtgctcattaaccaccatagagtaaacaagtgacttgtttataaggcttcttctcatcgctttgtccaactttaggcactacttacccaacctttaaaatgaacctttttaaaaaaacaccttgattgtttttattttcaagacatcatctggctatgtagcctaggccagcctggagctcacagtggtgatgctgtctcagcctctatgtgctggggttgcagatacaaagcaacatacctggccattaaatgctctttctctgctatcttatcttactgaaatctggttgcttttgtgttttgtttcatgagatttttttttttgtctttcatctttttggttcatcattccacaaatgtgtcaaaattatcactaccctctgctcatatcttttgtccttttaaaagaactgatagtaataatattagtactagtactagtaatagtaataataacaatttaaagaccagtgagatggatcatgtaataaaggtgcttgccactatgccagatgacctgagttcaatccctggaagtctatggggaaggagaaaaccaattcctacaagttgtcctttgacctctgcaacctttacacacctcccatggcacacacacacaccacataaacaaatgcaattaaaaacaacaacaacaaaacacacgatatttaatactaaggaccaacatcttccttggttccttggatttcaccataccttggactcctcttttctggctctttatccactctgctatacctccatcttggactcctaaaaaccacctgtatctgggcttcctggtagacactatgtttgaacattgaacagggaccttccattcaataagtctaccatgaccgcaccccttctgccagcgcagatctgatctcccttctgtgtctcctatgcatgcatgctacacccttctttttttggattccaaactataggcctggatattctcaccaactctgtcctttcctttgtcttctgcctctaattggtcaccaagaaaggtcacccactttaccttcctcgttagtcctgaaatatatcttctttatgtgtccttaccgtggcatttgtgctctgattgttttagtaatcaacccagtcactggccttccaatggcaaaaagtggaatgtagtttctgttgttgtaaacaaaataattgttggaaattttgaataattcatatattctctgtgttagttttcagtcactataacaaaattcctgattgattaacttctatgaaaacactttaaaaaaaaagttactgtttggttttgaaataggattttactctgtagcctatgctaggccttaagtcactgtcctcctgtcctatcttcctgggttctaggagttcaggaatgtccctcactggatgaagatttattttgactcacagtgttagaggtctcagggcctgatggatggagctcttgccttgggtctgtgctcatggcagcttgtcatgaggaaggaaaaccgttaacgtggtggccaggaagctaaagagagcaaagacgcgccaaggtctcaccttggtatccttccagttactggaaaaccccaccatcttctaattgtatattgagagcctttaaacattataagtctttggaggacatttgagatcaaacccacagcaccctcgaacaggctgaaaacccaggatttcaggatgtattaggcagcagagtcagatacccaagaacggtctggttaggttgccgcactgcctctgactgctcagatttctgttacagagtatttggtcctcctcaaccttcaacatcctagagattagccatctgattggtcttggctagctggagttcctgcccttgctgctagggggagacactccttctgcttccagtagtggttctgggaaatgggagcagatcacttcaattgtgaaaaggcagcttctctgcatcaagaagttgttatttgcatgaccttgaccacaccaatccaccccaccacttggccagcaggcctctgcttcctcattcctcacagcagccctgttcccttggttgtgatctctctctggatctgcctcaagtggattctgtctccatgtacacacatttggcagaaaatgcttttccaggctgttccctgccctccctcactttcccagtgtgcactgttttgaccctgtgtacagtcattagttatgtttattcacgctttattaggaactttttgacaatgcagctatacatttttttcccttcctgaacctcctacaccaaactggggtcacctcatatggaaggagccaatgatgccccattaaagaattaattttaaatcaagatgtgtgagcatcctggagagcattgcttagaggcatcgccttagcctctttacagaaatacaaacagtgccttcccaatccagaggacaagcctatttgattttcttaaatttttcactcaagtgctgtgactagtacaagcaaaacaagcaagtgcgcttcatctctggggtcagggcctgcatcgtgaatttccttgaacacagaagaagcagttttgaagccagaatatactgagttattctctatactagagtcagggctgggcattgttctcatttcatacttgtatgactctctctgctaccgctatccaggaggcagcacccccccccccgacaccctcaagtgcctctgttcagcccaagtgcaggagatctagaagctagcaaagctggtagcaggtgtgtgcatcctccaaacagagaggagcccaagtgcaggaggtaccttcttcactatttgatgttatagttaattgtagtcaccgccgggctggagaacgctggaacttactccttctgtgtaatgtattttgtacctgaccatatgagaacatgtgatatttgactttctgtgcctagtttacttcacccaatagaataaggtctagtcacattgtcacaaagaacaagaatccatttatttttatggctgaaaggtattgcattttatactcaccatttctttatctatttttcagtctgaaacccatgtgaattccagatcttggttattataaagtgctgtgttaaatatgggggtacaggtacttctttgatgtactgattttatttcctttggacatacacacagtgagactgctgggtggtgtgataaagctgtttctgttgtttgcttgcttgcttgctttggaggaacttctgtatggttttctataatgctatattttttatgcttctaccaatagtgtgtaagaatttctcctcccgccccccaaaataaatgccagtgtttgattttttttctccttttgctgatggccattgtcactgaggtgatggcatgtcactacagtttccagttatatttccctgacgacaagggctgaacaaatgctttgggcatttgtattgattgagcatttgtattcgtttgagaaacacagacagttcctccaggttttgttgggcgactaaacccaagcatttgaccgtttaaccgttgagtcccttgaccccccccaaacatggcagatggcagttgcttgtcggatgaatggtttgcagatatcttctgttttgtaggctaagtgtttatggttccctttgcctcgtgacgccttgaccatgtcatataatctcatttgtttgcatttgctttagttttctgtcttttgggtcctctccccttaaaagccccattctgtttcattatcctgaaggttttcctctaggagtttcatagttttgctggccaagcaattattattgggagaggagaggctcggttatttcatggtggtgacttacacgaatcttcttatgcggtaatggagacccctgggacactgtgtagctacacacagtgttattaattctcaccgtctcagtcatctatggcgtgacacttccatttctcatgtattgccttgctgggtacctgccgtgtgtcttctctccctgactcttgcttggcaaagggaatgatgaagcaaagctatgtagtgatgaaggctggctgtgctgtaatgcctggttcttggttttcctgagcttggcatcatacataatatcaaagtcatagcatgctatctcagaggccagacatgattatctgtttctgtttgtgaagtcactagcctgagagtacaatgtgctgacaaggactacgaaaagaaaattcatcctgacctgtgtatggtacactctttcttctatagtgagccactcgctggccttgaagtacctgggactacccctacctctaaatgctgaaatacaactgaggatccccacacacgcctctaaaaatattgccagcctgattatacatcatactgttgttgttcttggattatgataacagtggactgtcaggagagagtagatgattaaattccctgctcctggctattagtaatccaggaagtagccaaagggtgggtgggtggaagagagcacagcagccagaaaaatctcaggatctggtgatttcatctgaacatgatacaagagtcaatgacttgccacaaccttttgtttgtaggcatttctgttggaaattatggaaacaagcacaatacatgtgctcttcgtgtagagagttgttcctaaaataataccgagaataaattaggatgaaatgaagtcctgtgtgtgtctataatgtttgcagaaggtctgtctagcaagtgcttcgtaaggaaaacaatccttattgcccagtgcatgtagaatcactgtgctccaggttagcattgcatcccagatctttttaaataaatattttgtctcagagatgaggcaccaaggctaccactgcccactaggcttcttctaccctcttcctggcctgttttacaagtgaggctgtatgtgaacacaggctctagcttcaggctctgagatctccttaaagcaggagggttctaatctgtctgtttaggtgccattcacgaccttttggagtagtttaaaagtgtaaatggaatgtttgaatgaaggaagtggtcctgttcaaccttctccagtgacaataggagataaggcacgatggaatactattcagctctacaaatcaagactctaagactccctggttttgaaagcaacaggccaaaggagaggcctgaccagtgggctcacttgttttcattcctttaaggctatcatttaagaccagttcgatgttgggagtcctggctgggcggggaacacattcttcaggagaatgtgttgtatgtgtgtgggtggagaaggagtcaagccagcacctggcatggagcatgatgccattgcagggacagatgcccctcccacagccttaccttccctggagcctgccagccgggtgcattctgggagtcagaacatttgtgtttatgaagtggttgagggccagccgcctactgtcttccacagccccttacaatgacaatgagagaatgagtgtcaggtcttgttcagatgctttggccagcattgaaagagttagctgcaggggggtagcaccctggtgaggaatggcacagagtggggagcaaactgaaaacaagtcctgctctgcaaatcaccaacactacaaagcctaggttatcttggtaccctacagcatgttaacgatgtttaagatggtcacagtactaagactcacatatgacacttatagatggagtgtcttctagctccatagtaatgaacaaggcttagcttaagaatactgaggagccaagttagatggggagatcggttgctctctgatctccaagaggaagagtgtaaaggaaggagaggctaaaaccataatttcagttcctgagaacaactgttctacaggagcagagagaggtggagctagtcaaggagacagcattagccttgtacaaatgggaggaggaaatcccagagagaatgggttctttggaagccaggagaatagtccatggaagaaatggccagccaaggctgagcctgtgttagaggcaactttgctttggtgtgaggccttgagtggagttgggtttaaggaagcctggaagccaaagcttgaggaggctgtcataggattggaatgtgccttaggtattcggttggtatttagtgggggaatgaagactgtcctgttgtaaatacccagtctcctaagctgcccgtcatctccctttgtgtgtgatgcccaaggcttagtaaccagcaggctccgttcattctgtccatcccagcacctctcctcagtgttgagaggagcccagggagcaggcctgcaggcctctgaggcatcatatcagatacacttcagcgcggaaaagaaacaggagaagacagccaggaaaaggtaaacgacaaaaggatgggaacaattctcccacaggctacaacagatcaaaagcgcagggaaatgtctgacttagaaaaaaggaaccaaacggaagacataccaaagaccggtgtgggagcccaagcaccgctgtgactccaggggtaccagctcccagcacttgcatgaggggctcagaccattagatgttagtgactgaactgagtctccggttcctccctgctcctctagacagagttcccacctcctgtcactcgcttggttctgtggcaaactgtccatattgtctgagatgcctcattagcataaataggtaagattttattgtgaggaacaaaatgtttctcgcacttagagcgtttgtgacagaaacagtgaaccaagaacatataataaaagatgttcctatcgcttaggaaatccccagggttttagaaactctggccaggagccagaaatgaagactaaataagtatttcttattatatcacagtgtcatacaggcctttgtgctcgtgagaataaaagaaatgtgctctcctcccttgtgtctaacttcctcctcatgcatttacttcaggcatacgccgtatgtcgtgggaagccaccggtggtgggctttgccagggtggtctcgtcttccgcatctaattcagagctctttggatgtgagtttaaacatgttaagtgggactgagactccgtgaagcattctaagaaacttcagttttgtcctgtaattaaggtagaaaactgccatcatatgccagcagaaatatgttgcatggcttgctcctggtgagaaacctggagatagtgtttatgtatatagtttcacttaacaactaagtaaataaggtggttcacattgacaccccaagaccaaccacattcacgcagtgaaatctccccctgtacccttcatgaaaagcaaagaaacaaccttttcctcctgcaaaattattctgtgagtgtaaaacggttctgcatcgactgcccaccccccacccccattgtaaggcacttatgaaatgttttcctttccttccccgggttaaaatgaaaacggagtaagtcagttttgaaatagctagtatgaagatacatccctcctcagttcgcagggccaaacactggacacaaggttcctgagaggaaaggtgatcattaaagaaggagtctcccccaaaagttgtcaacagaggtggaattctggggcaagcagcacctaggaagggcaagggggaggaaggactgggacccaggactgaacagaaaatcaagggaggggccatttggcagattccagagtaagggaacagaaagggagaactggggggaggggggtggatnnnnnnnnnnnnnnnnnnnngaggagaggaatgggtgggagctgttgtgtggcaggcttgtggagggggaggaattccaaggcatgaggaaataatgggagttggacaaaaagcaactgaaaactcccaaagtgagcagcagtattcaccaggcaagaaatggtggtgacctgggtaagttcgggcaatttgcttattttggttgagttagcaggaagccgagtgggccgtgggccgggctatgttcaccaatgtgcaaacttggagctgaaggattggtgccgttaaaagaaaaggaaatttctcaggctggattggccacagggggcccgccaagaaggcagtgacattgggaatcctgcgctgacttgggggccactcaaaagccagggctgtgttgagctgcctgggatgtctaatgaatttcttggtcactcagccttagtcctgacttctagatcaagctgataactctagaagtatgcatgggttgcttcacattcctgttccggcctcctattccagcgtgctgtgggatcatttcatctgcgtgtctggctatggggggagggggttgttcctcacagtctcctggctgcaaagctgcagctggcttgtttcaacacgtctaagggttaatcaggtatattctaattgctactgggagaggcagctgagcctgacacagccccgaggttgcctgcggggttggggggggggggtgttctgttttcagttctctttcccaaagacgagtacttagcttagcattacgaccagtagagccgtttatgtcacataccttcctgatatgttttagctctcagctcttgtttctttaagttttctagatggctctgctttaaagcatgcttcgaccaaactaaaaggattgctaacaaattgatgagctgtccttgttactgctgttttcttccctgagcatgctacagcctttggcgttttggtccacagagatgtggaatgtcgtttggattcattgatggtagaggaaggtgctccagcttcctttctgtggctgtgatcaaatactctaaccacaacgaactttggagaggaaaggatctaagtttccaggtcaatgtccatctagggaagtaggaatgctgctgcctgcttgctctccggatgacgaggctaaagctcagctagccttttgatacagcccaggaccactgcctaggggtggggccgcccacagtgggttgggtcttcctacagttaagacaatcaggacagtcccttccggacttgaagataaagacagttgtttgatttcgccactttccagggcattctaggatgggacacattttcaataagtgttcactaggacagattgggagagagaactgtcatatttagttgaggttcgagagttatcatagaaccagtacttgttctctcagagtagaattgtctgtgacttttctcctggtttttattttttcacgggccagatctctctccctccccctcccctcccctctctctcctgtgaaatagtcagtcctcagttttcattgtatatctatccatagatttactcagccagattttttttttcaatctatggtgctttttttttttttcttctagttcatgaatgagtcaattgaccgaatgtaggcagctactgaacttggcagttggttgccatcagcctgcctgtggacaggaagtgtttaggatagatatgactaaccattttccaagccttaaataaagcaggggattttggacataataggtctttgtcgctcgtttcaacatttgctgcgtgttgaagttcaaagccagccccttggctactttacatttttccaggtcctctgttcccccagctttctgtgttatagagactgaaactgttcccaggctttgggtgtcttgctgattgtcgtaagtgaattatgaggatattttaattgtcttgagaatcttctaggtctgtattttctactttttttgttctttgagttttccctccttttcagttgccaccctcctgaggttcctacctgacttgcctacagagcagtgtaaggtaagagatgaaagtgaccctggactgctacacagaccgtggacttgtccttttgaatatacggccctcatgatgtgttgcgcgcactcaacaggccaggaagaacgacgctgctacaggatccttctgcacacatttattcagtcctgtttcttctttctccatatatctcccttgtttatatctcccttgtttttatatctcccttgtttatatctcccttgtttttatatctcccctgtttatatctctcccttgtttttatatctcccctgtttatatctcccccgaaccctgggcctctcactcttttatactctctctcatccacgcaccgcaggccacgccccctcgccagtcacgaggcttcagctaatcagggcagcaggggcaaatctccaccaaattggattcacctgtatcctggtacacctgtgcagcactcaagatgtttgtgtcttatatgaggaagtcaggtgcaagtcatatgacttagctacagtccctggcgcctttaggactgccgccacacccgctccccacaattcccccttttttcttttttggcagagagaatgtctgtagatagccccccgcaaccatgccccttacctgtctttgggagacaaacagcattggtttgatccctgtcttaggttggtgacatgcccagggaatcttatcactgactacctctcaatcatgccaagccactcctggggagattgtgttttgcttgcggcaggtgcatcaaaaggccaggatgttaattaacctatggccagatcttaattgctgcaagcaagcctcatgggtgaaggtagaggtctgatccccagtgtgcaagcataggggccctacacaaaaccatcccttaggctcatcacccagagaggtcttggccagctcccgtgtcgtttttcctgggggaagggaactaggacactgaaccttcatgcaatcagacgtgccttccacaggatgccaacagcaagctatcctctgtgcagtgcttagcctcgcaccccacggcataacgcagcataatttcttttagagcggcaaaccgaatctgaggagattgtcccgcctccactgcagcaaaagcctacgctaccatggcgaaagtgcgggccgcacactctgcacctaacacatgtgccaaacacaaaaaacacacacacactataacaagcatacatcccagggctctcatccccgctcatcttccctgaagcaagggatagatggccagaggggctatatctttaaggggaattcagggatcaaaaagcgtggaaaaatttgaatgtcatgtcgagctggtatcggcttctggaataccgaaaggatctctcatctcggctccatcgtttgtgcttgtgggaccatccaccacatccacaagggcaactggatcaggagcctcattcttgcagcgtctcaccaatctctccggcacccaaagaggttccatctggtcctgtggaaacacacaaacagaccctctccccctcatcaacaccggatctactcgatcctctccaaatctccagacagaaggtccacctacaggtggctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcaaccactgactgctgaaagttctgaactcggtgggggagtcggttccccgtacgggccaccaattgtcgcgcccgctctcgaccagcaagaacgacacgaccaccagtccttctaacagcagtttattcagtcctcatctttcttctttctcttcatcagtaccgttcccagctgaagagttctgaatccatgctggatccttctcaacagtctgttttacgggaacactttattaaccgctccttcccagtgatgcagttctgaatcctcccctgtagcagggggtcttcgctcttgcctgaagatgtttcttgtcccgggtttcggcaccacttgttgcgcgcgctcaactggccaggaagaacgacgctgctacaggatccttctgcacacatttattcagtcctgtttcttcttgtttatatctcccctgtttatatctcccttgtttttatatctcccttgtttttatatctccccccttgtttttatatctcccccgaaccctgggcctctcactcttttatactctcagttcccatccacgcacagcaggccacgccacctcaccaggcacgcagcttcagctaatcagggcagcaggggcaaatctccaccaaattggattcacctgtatcctggtacacctgcgcagcactcaagatgtttgtgtcttatatgaggaagtcaggtgcaagtcatatgacttagctgcagtccctggcgcctttgggactgccgccacacccgctccccacaatgatgtagcaacattttccactcctaaagctccttccagttagccagtgtcttttagacttctttaaatcacatctctctttcactcagggagaaccatgccgttttgacaaattccaaaatatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttccaaagcagagaactaggtggtataaattaaaacattaaaagaacaatccccttaaattcaaaggaaaactagttagccagggtaggtttaatattcagttttagaaactgactttgaaatcatacattcaaaagaattgaattataagatgatgtgttttctggaatatacattgccttacatcttagagatgaagtcagtgttactcttcttagctagtgctatagtgtgattgtactcaaatgtgctcaacacttggttggtcctcaatgtagcagtattgagaaatggtcaaatcttgatcctataggaggtagttggatcatggagtaccactcagaaaggatgagtgcacatctccttggagtggacaaggtctggtggggccagattggtcatagtaaagccatcctgagagttctacttctttctgggaatcacttgatactctgtataaaccctagtgcacttgaccatttaaccatgctcagtgtcaacctgagcccatgggcagttgcagatatcttttctagctggcagaactatacttggcattagatgcatgttaaaaacaacacaaaatagacaagaagagactttcaaccttttgcagctatgagactactataatacatttttcaataaagtatcatcttttccaaagaaacaatatgagactactataatacatttatcatcttttccaaagaaacaatatgagactactataatacatttttcaacaaagtatcatcttttccaaagaaacaatattttaataagctctgttatttatatagacttaatgtaaaataactggcagatataatcaaaactatttccccaggaccaaaaatgtggccataaaccttgttaatcatttgactcggtaaaactatattcccagcctttaagggggaccttctcagattttcgcctgtgcttcagtcttttagaaagttaatccagatactttgaaaacacaagttatgccatcaaatattgtatctcaatattttttaagttatgttagttaatgctgttctttgtttatggaggcgtttgtttctctcgcattggcgcgggtgaaatgaacaggtcttcatggacatgtaggacaccttgaaccatccccagaagaggcatccaaatccatccaaaaaccatgctgagaaagctcactccctcatctctgcttcctcaccttctaagttacatgtatttcccttttaaacagaacttgctgtgaatagggtagcttttagaagagggaattagcttcactgataactatcttgagtaatgtgtgatacccacggtgagaacccggcagagatgcacatacatatccctgagtcttttactctactgaacacgtgatcagctgggacatggtttagttcatttggaaggtggtttagaatgttgacagttctcctcaaagatggcaaggcaggatgataagggggtggttcacggtgccctacttgtccataaagaaactgttcatattttacatagttaccagggccaattacaaacgcttccataaacaacagtattaactaatgtagctgaaaaaaatatcaagatacaatttttgatggcaaaagttgtgttttcagaatatctggatgagctttctaaaagattgaagcacaggtaaggcaggaatctactggaataagggggtagttaatattagtagcttcaccagagaaaacaatgaagtgtggaagacccatggctgccccctgggaacttggtctcaaggaattcccagacttacatatggattaagtacacaagggggatgctctctgggagagaggttcatgaacaaatgtctatggccacaatctctgaggcaaaactactgatgtagataggtggctttgccatgaagcttagaatggagtgtgtggttgtttcccaaaacgtggtccttggacggctggtaccacagggaatggtcataggtgatcccagacagagtgttcagtcatcttcagcctcatcatgagaccaggggcttctaagtgtttttgaaatcttctgtatctgtccagagaatgcttgtatttgggatatgtgacccttgcctctttagtcatgggactcactattgtaacccaaagctacatagggactcatagcctctggcaaacagcaacacctgggagcagctgatggtgttggtgactgactttttcccattgaattgatttctgatgttaaaaatagtgattgattttgatgaccttcatgtgctaaagggaataatgttagtttccagtcacgtggaatatgtggtgtcctttctgagtaagtttattttctaatgaaagtatgttgattagctaaaagaaaatcaagtccgtagtaggtagaaaacaaagcatgacagtggtatttaaaggaccaggctgaagatgtggccacatggatgtaggatggcgttagatggctacttcagaaatggaagcattctgaggggaaaggtgagtagagacgctgacagaagcctgggaattggggaagagagtgttgccgtgtcctccttgcctgttttgatggacagcctgagaacaaagtgctagaagctcttgagtcaccaagacctttatcccaggctctcgtaaagtgactcagatctcggtgtgagaccctggccgttccagtcagagatgagaactcatacgctcacaggggacagggagttagttacccataactgcccccaacatacacacacacacacacacacacacacacacacacacatatacacgcacactcactgctgtcagaagggctaggtttttttgttgttgttttgaaggagggggaggagagagaagactccaaatttttaatgatttatttaacaaattacaaaaacaaaaacctaaaatattatgggagcctattttcgtgggtatgggaacatgctggaattaaatcctagaaatggttgttcaaaatgtagatataataaagatatttttttgatggtgacagtgtagattttgttccatgagttttatctgagctgagaaaaaggtagagtctcgtccatctgaccatcagcaactatcagctttataagtgccaaaactaagttttaagtggaagaacttgctacccaatgctttttgatagtgtcctggcaaaaccctttccggaaggagagaactgtcacaagttatcagggcttgtgttgtgaccctaggtcgccctctgagccttccctctccctcttccatctctagagctggggttgatgaatgaggtgggaaggcagctattgcaggaccagtgtgggagagagcatgatgaaagctatgggatggggggaatcacaggctgacaaagtatctgggcaaggcatttattttgttgatatttggcagtaggtcataaaaatgacccgttttcgttgcgttatttgccaaagtttattttaccctggtatccaccattagagaagtaattcagctccaagacaggcaggttgatctattcaggggacgccttccagttcttttaagaaaggactgtaatggtcttttttagctactttccttaactgaaaaggatgagtgtaacataccagctctgtgtcgtcagcatcctagcattgtggttattttaacttaactgtttgtctttcgggtttgatggggggtttattattttaaattctgaatgtaattttaagccagccagtttcaatatgggataaaaattaaaacattccctaatttgttctttctcaacatattaaggtacgtttgtgctttcttagatttcttgctgtgtgtagtgtttgtgggggagggggcatatatgtgtgtgtgtgtgtgtgtgtgtgtgtgtgtgtgtgtgtnnnnnnnnnnnnnnnnnnnnnnnnnnnnnnnnnnnnnnnnnnnnatcttcttgtcctatgcatgaacatcatgaagttccaaccacaacaacttactttttatctaatgtgggttctggggatagaactcaattcctcatgcttgtatggcaagcactttaacaggaaagattctatgggagtaactcggggttacacgttgtgccttcctcatgacttttctcggatgtcgccttttcagaaaggcttcccctgcctaccctggataaaagaacatactgtctcatttatgcacttctgttttatgtggcccctgccatgacttggcacttgtgcacttgtttctgccctgggtcttcctttagaatctgaaccccttgtgagcaggtgttctgcctggggcatgatagacacacaattttaagaaaatctaaaaaataaaaaatgagtgagtgaatgaagtttttcctcacacctataagttcatttactgtttagggttccacattgacatggtatacccagttcaacttcctcctaggatctttataaacttggcaaatttactccctctctatgacctagttaacacattgtatagaaatgagatttggcgctaaagatagctgaagtgtgtgactgtcttcattacttttctcatgctgtgaagagacaccatgaccagggcaacgtataaaagagtttattctgttttacagttccagagggtagtccatgaccgtcatagtggggaatgtggccacagagagacagacatggctctggaacggcagctaatttctcatatctcatacatgagcacagacagaaagagcgcacggggaatggtgtgggcttttgaaaccacaaagcccccagtgacacacctcctccaacaaggccattactcctaatatttccctaacactcacaccagctaaggactgcattcaaatctgtgagcctacggcagccattcttattcaaagtaccacagtgactaaataagttctgtgaagaccagccattatattccatcgccttgcaaggcctcctgagaaactcacaaattgttcctaatttgtcttcattttctaagtttaccagattagaaaactcttgtttctagttgtcttagtcactgttctgttgctgtgaagaggcaccgtgaccaaggcaactctgatgaaagaaagcactaccttggggctggcttacagcttcagaggtttagtccatgatcctcatggcagggagcatgtggcacattggcagtcactggggtagtacctgagatccacatcctgatctgaaggaagaaagaaagcctacacctcaaagcccacccccaatgatacactttctccaacaaggccacacctactccaatgaggccacacctcttaatccttctaattttttcaaatagtatcattccctggtaatgaagtttcaaatatatgagcctatggggggccattctcagtcaaaccaccacactaatgtataagcacatttctagacaggatgtatttctttcttttttttttctttttttttttttttgctctggccaaactttactctttttttttttttaacccaacactatggtttgtttttgtttgtttgtttgttttttgggttttttgttttgttttgttttgtttttcgagacagggtttctctgtatagccctggctgtcctggacctcactttgtagaccaggctggcctcgaactcagaaatccgcctgcctctgcctccaagtgctgggattaaaggcgtgccaccaccagcaccaccacccagaaacactatggtttttagtcactattaccccaggagacctttctgcccacagagtccctgtcactctcaggtccaattctctgggagaatcaaagacaagtagctgtcccagagaagggacagggggccatggactcagctctagctgcagtctcctgtaaaggagtttgagttttgctgtgcctcagccccatgtcatcacgctcttcctgcaggtgcccctgtcacccatactttatattcttgatctagagagtgcacacagatgagcgagcacactgagacagggaaatatttggtttttattcaaacttcggcggtgactgtgtcttttccccactgacttgggtccaacctcacagtctagttcaactggctactttgaaaagaattagtgcacaggaaacgatggaaaaaggggaacaggtcacttactgctccagggagaaaagggttactgctctagggcctcaaattcctacaacagagcagtggaccttcgtttactcaaacgttttttactgggtggagaggattaagacatttgcatgaaagtcttctggagaagattagaaaagattaattctttgtcctaaacataagttttatggtattttgatagaaaagtctcatatttaatatttcttacaaatctctcttttgtttgtttttaaacattctttcaagctcattaaggtgaaggctctttttttctgtcctgtctgggagtaagaacctacagttgggagaagtacctggttagtaatagttggctcagtaaacctgagttaggaccttaattcaaagaattagttattccatcattagcatgtcttagggggaacctcttcctcctgtgagtcctttgctaggaggttcttggtgacactgagatgtgaggcctgtcccttggccagtgattctattctctggatcacgacacattttcattttacaggccttcatatctacttcaaccttccacctcccaaaaaaacattagaatcacttgggaccagatcagagatcagagatgctgggcagaatttttaattcctgactattcagtaggagttccagaagttgccctacaatctagtcacatctgtatggtacaggttgaggttatcactcagaaggccaggggaccctccttcaaaaaaatggggtcacagcttagctcaagaggaccattgtcatgccggaatgtgtgcctcttatgcacagatcttatgaaaaatcagaaacaaagatttttatatttattttcataattttctaacactcgcttactcccttatccttagagcacactgctttatgcagacccaaaatgtgggggggggggggctgtccaggctccaaaggtgtgtggtgcttcctaaaccctccaaattagaggggtcagccagggtgcacaacactggagagagaaggcagacagaaggaaaagaacttcttgaagaactcagatgtctccttggaagtacccattgtggagaacaatgcttcggagagcctccagaggaagccttgtatttatcacagagcctcagggcatggctgtcttgatatctgaattaaagtagcttactcaaaggctctaagtctcctctcaccttctgcttaccctccacaggatcattcacaagacattggcatgtccataagatgcttaactgatattttagtgtaattgctgggaaagtttgggaccaaaattttaggaggttgtgccaagatgcatatttgggagatgcttagggtaaggccagcaggttactgctcctaaaatactcccaacagatgggcttgagatatttgtttgggatattccagatcatttgctacaaaggctgaattaactaaatatggtcactctaccaacaaagtagctgctattcagcacggtttggccaaggatggagagaaaagcaatggcttaaaaatgaaaacagaaaatgcatcagtgttgtatagatttatagctaaaacataaaggattgcccaccacatgtgaggccctgtatttgatcaccacaaaaaaagaatgagtcaatatccggtttatcgcgttgttcttagccatggactaatcagatagtcggttttgtataaatgattagaagatactttcatttaatttcaatcctgtatgtaggagttaggccctctttgaattgttcctggaaaaggcttacctcatactctcctagctgcattatcaaaactgagtattaacaggcttcctcttgaaaatattttctgtggattccaagcatgagtcaacatctctattttcgtaaaatttttgaaaggggtgctacccacggagtcttgttttcaatgtgatcctgtggtcaacaagtggctctttgggattttaagtccagtattctagaaacataccccggagcagtgtggaacctttcaatctccgagactacagtcctggggacttcatgcagtcggtgcagcaattaccaagccacttccatgcacttctgataccagtggcccaggactcagaattctgtcctggaaacttgttgcctcccctttccctgccaaacactgcctgagaactgagaaacccagtagcaagcatttctatgtccccaacaagaacacagctactatttacattttacactaccatcactaccccctccacccccaccccttaaaatccatacattggcttctggtttatgccaacgaacagagtttttagtggttcactggccaataggaagtctctgtgtcagctctggaacgtgtttctgtaaaggcaagatgtacttttgttttgaggctaagtatctttggagaagccttcaactctatcctccgtctgtccgtcatctcatccaaaaaggtactactgctcactctcttcttcactactgttgcttgttgcacagtcctcccgtggaccttccgtggcacgtcccacccttgttcccatcatcccgcctgtgttcccatcaatccctcctgggttcccatcatcccacctgtgttcccatcaatccctcctgtgttctcatcatcccacctgggttcccgccataaccaccccctctgtgagtatgagtgcctagagagaagagaaattgctacttaccttttaagccacagcatctggcatgttacaaacaacacgtttctgttgaatggtgtagtacacctgttaatattctctctgctcccttcacttgtgcctgagccattctgtaccagaacttcaccttaatggtgagctagcgttataatgatgacaataattacttacacaaacctacctggttacctgacagcaaatgtacttcatgtggattacttttatttaaactccatttgctgataaagaaactgaggcacagaggaagtaggtaatgtggtccagtctcaagggcccccagggaacgatgcagcttctgacccaggctgcctgggtccagaagctatgcctgcatcagtgtattgcctagctttgcccacagcctgccctgcccacctggcccactcctatttacagtgatcttctctgaatccattccatcagtttgctagccaattaattatcttaaatgatgttaatgtacagatttgttctttggtcctgtttgaaatgtggttggacaacttaagcaaaatcgatgttatagtaattttttattgcatgcatatttgagcatcttcagagggaaccttggtatacattccttcaagagctatttaacaagaaagactcatccccacgccaccaatatgactccccttaacttctttttttaaaaaaaacctagtatttttgttttgaagaaaacctggccaatatgtttacaggattctcaagaaatgttttataaatatatgactaaatccttagttttgctccttttttattcctgtagggatattttacctgaggcagttacagttctctcgtcgtggtgtaatgagcagtagcacctgtacaaaggtgttccatttggacgataagttatatgataatcttagtcacagtatgtggtcctccttttactcggttcatcaaaggctgaaggcctccttccttcctcccaccacttataggactcttactgctgttgggttagtaagcagcaaaggtgaatggccgtgttcctcggcacgtcgtcattatatatcagttatgcatagcattttgaacacctacatgttatgaatcctttcatcactcagacattacatttcttaagaaccacaagccttagtctaggtgtggtggtgcacacttgcaatcccagcacttaggaggctcccgagtatcaggccagcccgagttgttacacagtgaaaccctagctcagaatcaaagaggagaggtggggggcctttaagacttcttcacatagctcaagagccattcatatatttgcttatctatgcaggcgtagatctatgcatagctctgaaaagatgccaaaaatctcagaacagttgttgcctcttggagaagggttgagatcagagttgtgcagtgagggaagccaagctaagggactttcacttgatttattcagtcttgttcactgtctgttggtttttaggttaaactccatatcttaaagctgaccaggtacatcctgaaaaacacaagatgggccttctcctcttctttgatttcccttcccgtagagagccatcattaggttttccttaggtgttttcaatataaaacagtctttctttttttttaaattggttatttaatttagttatatttcaaatgtcccacttcctggtttcctcacccttacccaatcccccctcctcctgcttctacgagggtgctcccccacccacccaccccttctgctcactgcactagcagtcccctacgctggggtatcaggtctccacaggaccaagggcctcccctcccattggtgccaaataaggccatcctctgctacataagcagttggagccatggatccctcctgtgtacttttcggttggtggtttaatataaaacattatttctaaaactcatatatcacgtgagtcttttagagaacagattacatggggcatgcctgcattcaaattcatctctagcagtcactgactgtgtagccgtttggaggtgactcagtttcagtgacactccatcagagaaaactaaatttccctttcccagcagggtcagttgcaaattgcttcttgcctaggatctttgtgtccacttgcccttctcggggctggcttaaacttgtgcaggtcttgtgcatgctaccacggtctccgtgagttcatatgcatccatcctgttgtgtctggaaaacactgtttccttggagtcctccactagctctggctcttattatcgtcctgcttcctcttccacacagatccctaagccttaaagaaagatgtttgataaaggaaccaaccacactctaggacaggccctgtgtccaggaacagttgaccaatgcaaaaggaactccgtgtttttgaaatgggcttttgttttggtatatgcatgccttgttggggttttgtttgtttgttttgatatttgggtttggtttttgttttgtttttctttagaaagagagtgaaaacatgaagttggggaggtagggagatgagaaagatctgataggagttgggagagggaaaggaatataatcaaaacagagtgtatgagtaagcaactcccattttttttcctgggcctcagagacctgacctggaaatatgtgtagtaatagccttccttctaggactgatgtgaaacttcaatacgataatgcaagttccagggacagtacagtaagaattgctaaaacgacagctacccagttaacattctagcatggtaagaaaagaggctcataagccccgactcctacatgaagaactatggagagggtatagcctctgtgggaaggaaactcaagtttctcaaaggatgtggctcttggtagatcaacctgccaagatggctccacacccagaagtataaggacattacgaaatgtaatgaggtgttattaaaaggggggtaggaatgaaatgaaactggggaacatggaaaagactgggaggtgaatatgattaaaatatattgtataaaattctcaaagaattaacaaaactattgtttagtggcagctactattattgttgtctattttttgctatctatactgtggttattacctaagatgatgtaatgaattcttatggctatatatatcttgccctgacttggggcagccataaaatatacttgtttctctaacttttgtcctaacaattatgaagctgacattctttgagatccaaccatactgcttcatctaaacatcgccaatttgtcctccacttctggagccaagtagggatgtctcattggagtttatgccagcaataaggcaataaagggccggagtaatccctagaaagcatcgatcttgtccacaaactatcaaatagaagagaggaagagaaatgaccagagagggcacacacagtgtgttgaattggttcctctgctcagggcacctctgcctctgaagttcccagtcacaccaagaagggcagctgaagtaaggcagcctagcacactggcggctacttcaaagtttgtaactcggtagatctcacttcggtccacaccatctggaaatgggcaactcctcttacacatgcgcgcgcgcacacgcgcacacacacacacacacacacacacacacacacacacacgacgagaaaactgaattttttttttgtttgttttttttcgagacagggtttctctgtatagccctgactatcctggaactcactttgtagaccaggctggcctagaactcagaaatccgcctgcctctgcctccctagtgctgggattaaaggcgtgcaccaccacgcccagcgaaaactgaatttttaaagacattaaattgcacccagacttccagcccagcgtcactccactccgggccctttgttccgctgcactggcttcctgttccctagtctcagaggccttggaaggctgggtgtgcagtggtgatgccacggtgtggcttccactgtggcgtaagttttggttcacttccttttcgagatgttccttgcttggctttgcatgcgtcttgcaaccgcgtctgtccttgcccttgcgtggtaggcattccctctgttctccgagggaggacccgtcttatcactcagaagaccttccgctacctccctgttcctgcagcagagtctttgccaagagagatcgaaacccttcagaaatgaaaattttctttccgaaggatttaaatatgctccttatatttcagtgtgatcatggaaaaggaaagaggagttggtgtcaggtacaccacatgaggtctctgcttccacacagccatctggtgctttgcgtgtctcagtttcagggtactcacaggagtcgattgatcttgaccaaatgtaattcgtcactagagtatggagatacagatgaaggttgctgtgctgtgctctccatacaagtctacagaggagcctttccgtgtaggcggccgcgccatgtggccgccctgcttattactctttagaacgaccttgggagcttagatcagcaatctcagctcacgggtggggaaacagtcctagcaatacccctgtgcagtaactgagccatagctcattcgttcattagttgcagagtgtttgggcttgtttttccaggagtccgggaagaattgtcacaataaggacccacaataagtccacagactgttcctactgcagccttttttactttaattttttttttttttttttttttttttgctatgtattattggaaggcgtgattttcagatcatttcatgactctcaaacacgaactggatgttttgaagatttttcttatccgagttaatgagggaacagggtcagctgttaacactttacgcttaggacagttctaaactatgcaaacaaggctcactgacactccactgggaaaattttatccacccctccataagccagagccatttttcaccctttcagtctccagccaggttttgaattgtgtagtagtgagggagatgaaagtggtctgtaagggcttgttaccaggtcctagctgctgctaagaatgtgcccagtgactgacaggaggcatttcaaaatcaccattttctctggtgcgcatcctttatgtggccctttaaagtggcacctatgtttctggattacatgcgagatatggggtgtatggcttgcccttgcccctgtggtggtgtctgttgctgggttttagccatgtggcaccaggagaatatgtgcacaccactatgcatttgaggcccaagctaaggatccaaggtttgtccattctctcaagatagcaatctctgggatagcctcttccatctgaagacatgaatgcagtttgtggtaaggtgcctcacgctcctcccctctccgactatgggtgtcacttctgacctttgcagggccagctgtcctcacagctcacatatagatatgcagctcctcctaacaacaatcttccccctctatcccctgtcccttcccttgccccccctccatcctctctttcccccttattttcatttcttctctgtcctgtttatttcctccttctagcttttcagtgtggaggctgccaccaggaaacataaccagccattctctcctggaacaccacccgatcccagagtagggaggttgcaccttagcccactgatctcccgagacagctggatttgatgcgaactagtttccttttccttccttccttccttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctctctgaaggttttcttcccccttcctcattctgggtctactggatggaatttaacttggtaataaattggaataacatgtgtgtatatagtcagcattcaaaagaagcaagaataacagacctactgagtgaaaagattatgtgtttactgataaatatgtggcgtgacttgagtgcttcattgtgtaatattagcgattgtggggcctttttgttcatttttagaaaatttgctcttcactcattgatagtagcaaaaagcttttcctttggtttcttctgaacacagttttttcacttgcacacatgggccagaatatttttaattaattaattaattttattacatcccatattttatttccccccccccaccctccaactgttccacatcccatacctcctccacaccccctgtctccacatggatgtcttcaccccctaccccacctgacctctaaactccctggggtctccagtctcttgagggttaggtgcatcatctctcaatgaattccagaagacccagcaagcagctgaaaagagtcagatgcagatatttgcgcccaaccaatggacagaagcagctaacccctgttgttgaattagggaaggctgaaagaagctgaggagaagggcgatcctggagtagggtcagaatatttttaccatcaatatttatctccaactttatgattgttggtggtaaaaccaggaatccctaaatattagtttgttttgcagaaaacactgtcgaggaggaccgttggattcagtcctggggaaggagggaggcgagcagacttactgtaagatgtgctctattctgcagggcagtctttcctctcaagactaggaatgaaatgggacctcacgcatgctggatatggtggcaggctcgctcttctgccaacaatttccatgtctgtttccaaggcaaacgaatccatcttaattgtaaacagctgatcaatattctcaatactgtctccttggagagaattgtgtccaggagcgcaagccttggtgtcactctccctctcctcttccccccctcccctccccctctttctctccctttcccctccttctctctttctctctctctctttctctctctctctctctctctctctctctctctctctctctctctctctctctctctctctctctcctgtgtttaaacaccaagccagaagcagaagtgggacaccgtagctaatcttccactgcagttcacgtgagaaatattagaccttgcttatactcaaaatatctgcattattgttttctgatatatacaataaatctttgtatacaataaatcttccctctttaaagaaaactaatttgctgatggtaagagaaaccactttctgaagtaggcttacatgggtggggggggggaacccacatgtttagtgagttaaaacaagtgtctatttctctaggttttaaaataagcaaacagaaacacccaaatgtgtgttttaaatttgcgttttccaggccaaaacattttccttgagaaggtcttaagcatggggaggcgatgggagaaaccagtgcctggcgaggcccagggcatggcacaaacaagtaaacaggtggggtttgcttttggagatattaggggccaaagggagagattgtaacaattaggcaaataatgatttaggagctgggaagcgtgatggttagcaaagaacttaaatagaacctcattttctcatgcaatgtcttcaaaatgccctgaccgtagcgtgagaggacatcggaaaggagctgacctagatgacatctgcagagatggaaggaactgcatatgatctagagatggataaatgggaaagtgcgggaaaaattggtaatgggctaagaaagaagaggacgagatggtggctagttcccaggtctcagacttgagcaacagccaagagagatgccattaactgaagtgataaatagtggagagggagtatcctctacaggatgggctaaacaaggattcaattaggggcccggtgtgtccgagatgcctgcaaagtttcaaaagaaaaccgtcttaaatgtttttgcaacatgagtctggaaaaaaagtcagggctgagggctgtgggagttgttggcacatggatgctatccacagccatggagatgatatcacacaggggtgagcctagacagaacgagaaaaactaggtcctggattagctctgagatgcgccaggcctttaagagagctgatagatctgacaacgagcccgagcaggcgaggctagcagcagttagtgtccaagaaagaaaacagtcatattttacgatcccagaccacatatccctggcaagcagctgtcaaccacaaccccgacttggctcaaaacagacctgaaaaataaacccactgaatgcatgtctgctttgtggagagggagcaggatgcactgaagtgatctaaagagtaagatggaagtgtcacgtgtacgttctggggagaaaggaaaagcctcagatcaacttccacgtctgggttatgactcggttacagtaaatgaggggtgatgttgcttagtctgcagtagactgtcttctcttccccggcttgcaggaagctaaaatgctgtgctgtcgcgttcttgcttctctatatgttggaaatgaaatgggatgttgagagttaatgagcaaagtagcttgatgagctacaaagatgcaggttcagccttgagaagttagcacaaatgagtctaaaccacacacacacacacacacacacacacaccccccgttggtttcagtatttcccaacagaaagtgtgtctatctgggaaacatgattgtagatcctagatggggtgtttgtaggtgccaatctctaaatagttaaaaacagaatctttatataaagtaagttgctgatatctaagtaatttgttatgtttctgagaacgaccatgtatctcttcctgtagaaactagatttgtttattcttaaggtctgtatctggaatcatagcacaaaagcgagtccttggccataatgagggaatattaactgctagggtactgtgtgtgtttgcatgtgtgagtgtgatttcattactgtgaattaacactcttttgcaaatcaacgaagagacgggaatgcaaatagatgactattaaacacaaatggttcaaaagcttggagaccctcctgaagttgatctcttctcctgagcttttctctctcaaaacacatttcgggtcttcttctgcattttcacttcatgtttctgtaacttaatatcaacagttgggagggctctgtgtctagttccaccaggacatcctttccataggtgcacggcattgtatgttcctgggtcagttctgcaaactaggagccattctgtaataacctgtatgagaccacatacccgctttgaatccagattttaaatgtaacgtgggttctctttgtctccgccttacatctagcatgaaacttgctcatatctgtcctagcctgggttttgtagttctgctattttgcttcctgctgatgctagctttggtccaaacaaatctttttacatcatcagtgccctaagctgttcgtcttcatcactaagtggttatatgccaacttctctaagtgcattttctggaatgtacagagagaacagaaatttctggatacccagagcactgtagtcctgagaccctcagccagggggaaaggagagtcccagacaagcattcatattacagccagaacacagaaggggtaatcctgagagagtgaagctgatgttggtttcttgagcgttttcacttctgaggctctaagctagaagcatttttatgtcattaatctgtaattcatgcaactcttctgtgtacattaaacatctgccaaagtaagtgacgagcattccgaaagtcgactctggggatcagcttttccagagaatgtttttcgtgtagcatgttttgttggctcattttaagcttatttcttcgaaacgtaaaagcaagagtagaccaggaacagcagcggacagtgaggtctctctggagtgtaaccttccaaaagctgacatctgagagtgaaattcaaagtgggtgggatggctgggagagcgatgaccgatggcttaggcacttgtgctttctgtagctggttcataaaacagtgctctccttggggttcgctggagtaaatatgccatgtcactctgtattttgaccttgttatctatcctgctttctcaaatgagtttaagttgcctaggtttgcaattggctagaagataggtatggagttgacttaaatttttatacagttaagctaaatagaaaggcataaaagtttgccccctcatgaggcatagtatttaatctttagatttgtttttatttatatgactgcgcatacatccatgtgagcatatgtaggcaggtgctcagaagaggatgtcacatccccatagagctggagttacaggcagttgtgagcctggcaacataggtgctgggttccaaacacagatcctctacaagagcagcagtgctcttagccactgagccatctccccagcccccaaaacgtaatattttcaaatcaaaagttcttttcaaggaagttatcaacgttaactgctctatcagcataatatcaataactggaaacaaacagtaaatggtaaaggagtgccgggaaggactccctaattcttggaggtttgcttggttttattttacttgctattaactgatcttttgttctttctacctgtccctttcgttttttattctgcagtggctacagatgtcttcaattccaaaaacctggccgttcaggcacaaaagaagatcctgggcaaaatggtatccaaatccatcgccaccacgctgatcgacgacaccagcagcgaggtgctagatgagctgtacagggtgaccaaggagtacacccagaacaagaaggaggcggagagggtcatcaagaacctcatcaagacggtcatcaagctggccgtcctccacaggaacaatcagttcaatcaagacgagctggcgctcatggagaagttcaagaagaaggtgcaccagcttgccatgacggtcgtcagcttccaccaggtagagtacaccttcgaccgcaatgtgctgtccaggctgctgaacgagtgccgagagctcctacacgagatcattcagcgccaccttaccgccaagtctcacggacgggttaataatgtctttgaccatttttcagattgtgattttttggctgccttgtacaatccctttggaaagtttaaacctcacttacagaaactttgcgacggcatcaacaaaatgttggatgaagagaacatatgagcttgcgaagtaagattgtgaccagcagcgagttaggtgaagtccagcaccgatgacttgtaaagggaagacggagactcttttatcaatcacatgtatttcagaaaggcttggcccccatatgacctgttattgttgttggacattaatagtagtacttctgtgtggcttgttgtatttgaaaggaaaaaaaaaagtgtattgccaaaaattctggctgcaaacgtcttaatgattggcaagatgtgagaaaaacggatagttggtcattcagatgtcaagggatacaaagacagatgagtgtggccccaagcgctggcacttcttgtgttttagggaaatcatgttggtggcacgttggatatttctaatatgtataaagccgtgtatcttgactcaccttgatcctttgctacgtctgtgtatctctcttacaatgtcgagagcctctctttgctgtcattgatccttttgaaacaactctgcttctttggttacagatcgtcattgaccttcaggagttaaatttgaggcagtcaaaccgaatgctcaggaaagcaaaaaaaactgtgcatctgaaatcatgactgtgggagtgaacaatcttagacatcatgagcagtgtccattgcaagagtgtgtttttgaagctgacttctaccttttagtactatcagtgatacttagagtctcagagctagtggcatgatattgccttgaaatatctgcttagggcataactttgatgtcatcttgaacatgtactgacatgttcccgtattaacatctatttcacctgtaggaagaataaatctctagattggctttgatattgagacaataaaatgtaagtagcgtttcaaaaagaaaaacttcttgaatttaaagatgaattcatcagactgatttatgggtgaaaggatagaaaggacgttgctaagtaacataagaaagatgcatgtatttcagtgtgtaacagggattgatgaataaaagatgccattttttatttaacgactcgggatttagattgtgttatttggtttttcaacgagtagactgatgaccgtgtctgtcttcggtgcttggtgtgccatttctgtataatttttggtgtgtggataatgaagtagacccttgcttattgtgtaaaagagctagaagccatctgggaagtaacagacccaaccactggccctaaacattggaattgccaccaaacctgtcatttacctacctcaagaacattgactgaaaatctaccagcaaagatcccacaagtgaaaattctcaaagttaagatccgctttgacccatcatagcttagaaggaagtggtcaggtttctctgagacccagctttctcagtaaagataaacagcaatggcaaaaattacctatgcaggtgtgatgtcatattgatttgagctggaaagtataattcttccctccgggagcctctggatgatcctagaggtgataacactagtgtaatggctgcattactgaggattggacttcctaagtgctaaacggctcagaaacagagctcagcagccttccttaaccaacatcagggaagctaagagtgtgctctcatgggagccactggtctgactcactctgctctaccagtccttgtgcagcaaaagcacagatactgaagcttctcaggaatttttagctcaggacgtgaccgacaaaactgaagaccttgggagaaattgagagacgtccgcacatttgagtcatactgatggacctgtaggtagcaacactatgcacatgatgcggacagtggtagcaccccttagttttgtatgccagagtcctccttagggttatcgttgctgtgatgaaacaccatgaccaaaaaccaagttgaagagggaagggtctcttcttcttacagttctatataaaagttcatcatcaaaagcagtaagggtagcaactcaaacagtccaggaacctagaggcaggagctgatgcacaggccacagaggggtgatgcttactggcttgctccccacggtttgcccagcctgcttgcttatggaacctaggaccaccagcccagggagtggccccgtccacaatggtctgaatcactaattgtgaaatgccctacaggcatgcctacagcccgatcttatggagacattttctcaattgaggcgccctaatctctgatgactgtagcttgtgtaaactgatataaaactagccaacatacccaggaaggcataaaaaaagaatatgtggaaagttagttcaagaacaccctgtagatgtcaaactctgcttatcggtagatgtcccttatagaaaatggcatattgtatttgtatctagcctgcctgtatatctttctatatttacaagtctcaagaattgtaacttataacacataatacaatgtaattgctgatttgggggaaaagggtgttttgcttatggaataaccacaagaaaaaattgtgtttgtgtgtgtgtgtttaatgaaaacttttaaaatatttacttattagtgagtgtgtgagtgtgtgtgtgtgtgtgcacacgcatgcatgcctgtggaagtaagaggacaacttggagtagttgattgtctccttctacgatgtatgatgggtttggggtcctgtgtccactctgctcagtggattctgggaatgagaactcatgggtcaggtgcctgtagcagcaggtacctttacttgctgagctatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtaacccagcctgttctaaccattttcttctaaatgatgtctttttagatctcatgaaagaaagaaatgtgttagaactgattttattatgggctgatgctttttctgcaaaacgtatgagctatgtaataaataataaccaatactggcaattaacgtttatgatatgacaggcatactcacacaataacccccaccaaaatcttcattactttgcaaatgaggaaacggaggcaaggaaatttaggtttttcttgaggtcacaattaagcatcagtgtgacaagcagtgcccttgcttgtatttaaatgtagcatgtctaaagacaatagtaagcatatcgttgtctcagaaaaagaggtttttatgcctctgaaaaaaaactttcaaataatgtcctttttagaccaaatttaaatcactgcaagtctgacctattctcaaagatccgggtctaatactatgcaaagtcattttcaatattgcagcatgagttctaatctgaagggatggaatagctcagatttctgtctcttgtagtgcctcaactcaaggtgctcacaattaagttgggtttgaacacgggctcatgaggggaggcagccctcccccagacagcctttggaggaggcacagcactctgactgccccaaggcagtcccccattgtgtgccaaggagtagtatgacatcagttcaaagcgtcaactttacttccaggtttgaaggcggaaaaccgttttgacaagtaagattaaaaacatactcttgggtttttctgattattagaacttgcatatacaactcagtttgtgacaaaggaaagcatgtgtgagaagcatgtgtgagggtctcctttgcgatttctctggaaagccccacccccaccccaccatgttaatacacttgtaaaacaaaacaaaaccctacaaagcttaacctgctgggttcctgagctcctaactcccaccccatggtttaagataatactttttgtagcttgaacttgaagggttggattttttttcccccactgagagtttaaatggcccttgagataggatgggttgtctatgagctaagctataactgaacaaacccaccttgataaatgaaagatccatgcagtcatccagaggctgaagtatttgtagaggaagttaagtgttatctagtcgcaagaaaattaaagtattcgaatggcacagcatgcagataggaataatagtgtttaaatactgttgttaggcttgaatttctatgcttgcattttctaaattagctgaacttagcagtgtttggcttgagaaattacacacctgaacagaaacctctaaataacttaaactcaaggcaattttagaactgttatttgacagatagaattgtatcttagctctgacacaatttcattttctgtaattcaagtaacaactacaaagctctctctataaagatcatatatcaaatgtagggctggaaaaatggcttaggggttgacagtatatgctgcctttacagagaacctgagttcagctcccagaacgtagtggcctgtgactccagctccaggggataaaacacctctgctggcaccagcattcatgtgtatatacccacacaaacattcacatccatttaaaaatgagtcattaaaaaaaaacaaaaaaacaaaaaccaagcgtagtgctgtaaggtggtaaggacctgtactctcagcacttttggagcacgaggcagtaatagcaggagttcaaacacatagtgaattcatgattcatggcctgcctggactatgaggctctgcttgaaaaggaaggagaaggaggagggggaggaaggaagaagaaggggaggagaaggaaagagagaaagaaaggaaagagggagagagaaagaaaggaaaggaaaaagaaagaaagaaagaaagaaagaaagaaagaaagaaaagaaagaaagaaaaaggaaggaaggaaggaaagagagaaagaagggaaggaagaaagagaaagaaagaaagaaagaaaaaaagaaagagaaggaaagaagaaaaacctttatataactccctaatgaaaatgctgaaacaggaaaaatgagtcagcttttgcttctgaaatggtacaacaggaaaatctatgcttataaatgcccattaccatctccaccaagtgttgaacagttttcttttactctggtgtccttcgggacacttacatatggcccagaaccagagggacctttttactggaaacttcatgaaagggaaacactgtaagactcgtttctgtctttcccaagaagcgttttttttcacccagtgatgagcttgaagttcgggttaggggctacaccagagctacagcactgctgtgtgcagagcacagagaaaggatgtggacaagccaggcagcagtcccagctgtgaacaaagcatctgtgctttgggaaaatgctctgcacatgcagggaacccagctctatgttcacgaaagttccatgtgatctttgtaaggtcaggcagccagtgagtcaccccttgtccttcctgggtgaccgagagcattctgcccactctactctctgctgcataattctggttttgacttgtgaaagtaaaatgactgatcaggcactcacagttcaatcttaacacgagggaaaaatacttgaattggggccagcgagatggcttagcagctgaatcagtggctctcacccttcctcgtgctatgaccctttaatacagttcctcatagtgtggtgacccccccaaccataaagctattttcattgctactccgtaaccataattttgctactgttatgagtcgtaaatatctgatatgcaggatacctgacatgtaaccccctcaggggggtcaagacacatgtattgggaaccagtgagctaaatgcactggtagccaagcctgaaagcctgcatttggaccctggaagctacaagagaaaaggaggaactgactctcacaagttgttctctgacccccagaaaatatgtgcacacaatttttttttagtttaatatctgatttttttaagtgttctgatttgcaaagtcagctaaggcattaaattcctctgcacttttccatttaaaagcttgcagacagctaagtcatcttatgtgtgtggcatctaaacatgaggcagaaaagtaaagggtaaatatctttattgtcaccattgcatgggataattaatagtttacaagatgggcgtgctctctttccctagaaacagatttttattccctcagtaggcactgccgtttctctatgctaaagggcatcctcattgcctgctgctgtcacctaagaccacttgttttccgaaggataaaacctccctgatcactgggcaaaaatcactgcattgctgtgtttacctaactagggacctccccccccccccccctttcacaactgggcagtcacacctttacctggctaaaacattcactgaagaacagaccctgaaatccaagggtagaaacattccatggtgttttcaaacagtgtgtcaggagtttggcatctcttcctcctgggaagtcactggagggtgaccaggtagaacctgccagggaacagagcgcagaggctgaagccagcagcaaatttatttcctgcccctggcatgccaaggagctttctccctatgtctctagaacttgtatagactcaactaattcatattttcgttgggaagataaaatcaagcatagagggctctgaaagctgaggactgttcttttgtgggtgctgtttagtgctggccttctgctatttcccaagaagcaatgcgaataagcctgaacctaaagggaatttagctacagctcttcagcagatccagagaaccctatccgattcaggtccccttgaaaaattggcttttgcttttaatttaggaaaattatttccgattgagttgtgaaacctcctgcctggttgtcatttgggcatgaccacttgaccattacactctacatttctgtaaattgcttgatcatttcagctgccattagccacaggcaatagaaggtgtgtgtgtgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggctgaagattagcctggaatcctggggtgactgggcctcttggtgcttcccccagcaccttctacctcttgttctcttaagtgtaagtaccacaagtgcaaaagcagaagtttgcaggtcttcgaatacctcacaccaagacaaatccagcattacttctgctccctgtaccagtcagagtgtgctaaggttcttctgggagtcgtcaattgtacccttggggctgatggttctctaggagagcttgcaggactccaggaaaaggttatactcacaattatgatttatcacactgcaaggaaaagagaccagtttgaatgtttccaggggacttcctccagtagaattttatagacccccttaatttttccagatgcaacgtgagacaacatatgtaaaatattaccaaccaccaagaaagctcctctgactcatgggatccagggtgttcactgaggtgtgtagcttccacttgattgagtcttgtcactgggactctagctcctccaatggcaaaggaacacaagatgactcggggtcccagggtgaacttttaaaatagacacccagtatcaatgacctccttagcataaagtatttgttaagccttctggttcctaggtacatggacaaattttgatcaagcaaggtattccaacacataaaaacgatctcccagggtgtgatgaagactctgttttcctcggaatgtgcacacacatgcaacctggcttcagtacgggaggaactatgccagggcaagggctctagaatgcgtggttctctgaaattgcctgtactgactaaatactatgtcattatttttctgtcctggctccagcaaagacaccaaatcttgggggaatctagagttccttgggggaattgttttcaactagaaacaaatacaagaaataatgatagactaacctgttcagagttgacattcttgtccgtgtgaaaggtaagtccccagccatgcctgacagattaatttaactatgctattcaagatactttggactgtgcaagaacacctgggtgctggtcctaaagagtttgctgactgattggggaagggggagccaacagtgcacatttaatctagttctaactttggcttcccagaacgctgaggatatacttcctgatgtgaagttttttttttttgtttttgtttttgtttttctaccagtttgaggttaaaactgacatttttaaagcaatagactcaaagtgatagattccttctttaatcgaatgtatgtgagagtctgtatatgtgcatgagcaggcatgtatatatgcacatttatgcctgtatgagggatagtgtacttaaaagaaacaaaaacatgcataggggtcttttgtttttattcaaaacaaaagctagttaccagtgagtccatgacaagatgtggattacaaaccccgtggaagaatgaatttgaaaaacaaggaacggtttcttcaatcgttaacatttaattcatatttaaagtttcacaaatatctgagtgatagcaaagcaaagaggaacttgtttgccttattttttgagaaagggtttcagttgtagcccaggctgacatagtacttacaaccttccatcatccacttcccgactactggataatacgatacctactttaaaaccttttgttttaaatcacttaaaatagacttctccacacctcaagaagttagacaaattctgacttcataacctgtggtcatgatgtatgcgtgtgccccctaagcccttgggtggagaccaggaagaacatattagcatggatctgaagacaatcgcttcccttgaagccatgtttgtggacgattttgccattgacccaggagtgagtgaattcttcctagcacttagtcacatgtcactaccactgtcctgaggaaaagcactaacaacatgtcctgtcttcttgtctacagaggattagagagcaaactcagaatagactcctgagcattgagcccaaggtgggggtcagaccccaattgagattcagccccagtggctttctctgtgtctagaaaaaacagggctcttctccttcacactgagttccatccagagagccgctccagataccttctagacaaatcacaacacttcccgatcctggttggctcaggaaagaaatttttattttttatgattatgaaaagatgagatttttgaagttcacaattttgtttaactgggaagatggcttagtttgataaagagcttgtcatgcaagcatgaggactgatttcagatttctgtctggcactcccattaaacaaacaaataaacaaaaagagctgtaacctgggaaagtgggaaagtggagataaaaggatccctctgctggctggccagctaaccaaatctaagctctcatataatagtgaaagactgtgtgtcagaaaaacaaatggaaaaacaagggacatgcatattctatacacagaaggacacagacacacacacacacatgcaaggatacaaacacacaaacagacacattggacacagacacacacggacacagatacagaaatacacaaacatggacacaggtgcgcacgcatgtaggtgcacatacacacacacacacacacacaaacacaccacccaaggacatatacacatttccatctatctctttacttgactaggccctctcctcggagattgacaatgtaaagatgtacgttgcttataaaccccactttgtgttctgaatcagattggctttccacagcagacccaagaggagacatctctctaatatttttttttttttgagaataagggctttatttttattactttgcctctggcactcaagactggggctgaaacccgacagggacagaaggactaacgactgaatgaccaggacattcagtactgttgagatatgaggcctaagtctcaaagcccacgtattacttcgaaaagccaggcagtgcacacaggaggcggcctcttgggagcacatgcgtggccacgccctcttctctaatgtcttacaggtgacctttgccatacttccctcctcaccccaggcttttaaaggaaactttacagacaagacattgtggcttgccacttctttcagcttaagggaagggaaaaccaccattttttttttaagttttgcgtgcatggtgtgtgtgtgtgtgtgtgtgtgtgtgtgtgtgtgtgtgtgtgtgtgtgtatttgtgtgtacgtgccatgcgcatgcagtgcccacagaggaggaaagaaagcatcagctcctctagaactggagttagagacatggttataagccaccatgcaggttctgggaaccaaacctaagtcctcttaagagcagtgagtgctcttaatgctgaaacttctctccacgtccaaaagtcaccatcttgataagaggcgttgacttcctggctgctgccagtatgaactgaatttggaatgtaaaacaaactaagcgtatcagtctttcagtaatcaatttcaacacaagaggtgctccctaaatagtcctccctgcctactttttgtaatagcggagaaaatcttcctgcacaccgggaagactccagttcctggaagccagctctaagttggggtgatcctcc

SEQ ID NO: 494 - DNA, 2087 bp, Mus musculus
gatcccccgaaggcgtctcatttgtgtagcaaacagctgtggcgaggttcctccgaggcccaggtggacatctgtggacatctggccagcggaagagggaaggcaaagccggatgctgtcggttataggagaatgtaacactctccagccagagatttctttccattggatgttttcctttcagggcacctttcctgcactgggccccacctgcctggtcgcctccacccgcagtggcccctcgggggcggactcctgcagcccagccccgcgcgattcgattcgtcactcctgcggaactttcccctgaaaatccctcccgcagccgctcgctcgcccgccccgggaggttctgatctcagaggcttcctcccaccgcgtcccgcccgccggcgcacatcgcactcgtctaggagcctcgcagcctcacgtccatgtccgtggcggtggcgcctgtggctgtgcaccccgacagcatgctctccgaagcggaggagcccagggaagtggctacagatgtcttcaattccaaaaacctggccgttcaggcacaaaagaagatcctgggcaaaatggtatccaaatccatcgccaccacgctgatcgacgacaccagcagcgaggtgctagatgagctgtacagggtgaccaaggagtacacccagaacaagaaggaggcggagagggtcatcaagaacctcatcaagacggtcatcaagctggccgtcctccacaggaacaatcagttcaatcaagacgagctggcgctcatggagaagttcaagaagaaggtgcaccagcttgccatgacggtcgtcagcttccaccaggtagagtacaccttcgaccgcaatgtgctgtccaggctgctgaacgagtgccgagagctcctacacgagatcattcagcgccaccttaccgccaagtctcacggacgggttaataatgtctttgaccatttttcagattgtgattttttggctgccttgtacaatccctttggaaagtttaaacctcacttacagaaactttgcgacggcatcaacaaaatgttggatgaagagaacatatgagcttgcgaagtaagattgtgaccagcagcgagttaggtgaagtccagcaccgatgacttgtaaagggaagacggagactcttttatcaatcacatgtatttcagaaaggcttggcccccatatgacctgttattgttgttggacattaatagtagtacttctgtgtggcttgttgtatttgaaaggaaaaaaaaaagtgtattgccaaaaattctggctgcaaacgtcttaatgattggcaagatgtgagaaaaacggatagttggtcattcagatgtcaagggatacaaagacagatgagtgtggccccaagcgctggcacttcttgtgttttagggaaatcatgttggtggcacgttggatatttctaatatgtataaagccgtgtatcttgactcaccttgatcctttgctacgtctgtgtatctctcttacaatgtcgagagcctctctttgctgtcattgatccttttgaaacaactctgcttctttggttacagatcgtcattgaccttcaggagttaaatttgaggcagtcaaaccgaatgctcaggaaagcaaaaaaaactgtgcatctgaaatcatgactgtgggagtgaacaatcttagacatcatgagcagtgtccattgcaagagtgtgtttttgaagctgacttctaccttttagtactatcagtgatacttagagtctcagagctagtggcatgatattgccttgaaatatctgcttagggcataactttgatgtcatcttgaacatgtactgacatgttcccgtattaacatctatttcacctgtaggaagaataaatctctagattggctttgatattgagacaataaaatgtaagtagcgtttcaaaaagaaaaacttcttgaatttaaagatgaattcatcagactgatttatgggtgaaaggatagaaaggacgttgctaagtaacataagaaagatgcatgtatttcagtgtgtaacagggattgatgaataaaagatgccattttttatttaa

SEQ ID NO: 495 - protein, 219 aa, Mus musculus
EPRSLTSMSVAVAPVAVHPDSMLSEAEEPREVATDVFNSKNLAVQAQKKILGKMVSKSIATTLIDDTSSEVLDELYRVTKEYTQNKKEAERVIKNLIKTVIKLAVLHRNNQFNQDELALMEKFKKKVHQLAMTVVSFHQVEYTFDRNVLSRLLNECRELLHEIIQRHLTAKSHGRVNNVFDHFSDCDFLAALYNPFGKFKPHLQKLCDGINKMLDEENI

SEQ ID NO: 496 - DNA, 58723 bp, Homo sapiens
attttgccacaatttttaaaaaatacaaaagaaaactgttaagaaaaagagaagtagttcactataatggggactagctaacaggaagtaaagagaactttaaataacagaggaatagcagatataaggagcagcccctacccgtgggccgtgggtctgatagagcacccaaacacatgcttctctctgctccagaccttgctggagaggtcatggcctgctgtggctcctgggctggcagagaagtcactggggtgctatgctggcagaacttgctagaaatctaccctctaagatgctaaggaaagctattcatgtggaggtctttcactggatgcattctgctgcaaaatcaaccgagagggatgccagtggaagctgctggaggctgggaggtgctgaccatcatgttcagcaggagccagttgctgaagaaggtgtggatactctaggagccatgcgtgtttgcagcagcctgcagaaagagtgtaccggaaccaggaaggaaaactgcttctttctgtaatgtctctacagtactctccactgatgaagcttagaatggtaccagctaacaaaagaaaaaatatgtaaaggtcccttctgtgtcttcacatagtgagtaatgaagggtgaatttcgagctgtgaggcagtaaacttattgcagttcctcaaacttagaaattgggttgaatcccaataccctaatttcctgttccacatcacatttcaactaatacttgccttttatcacagcaaccaccaacaacctagctttgcaaagaaatgacatcatcaaaaggaaaataacacaatatgttaaactgtgaattcgcttgaaatagtcattcatgcaagcatctgagaaatgttgtgtattgctttgtttccctcaaagacaaaatatcctgcacacctctgtgaatttgctgtagtgccctgaggtacactggcacataatttggggacctcagaactaaaatcatgtctttttcagcaactcttgaccgcatcactgtaacatatgagattgtaagatgccaatttggttaagactacgagtaatgtgtaaagtgaaaattgtatggggtcagtattattttaaaaatcctcttaggaagttaccaggttggaggctgatataccatctcctattaagtataagacttactgccactgtttccttagcattgaaacaggttgctatttctttaagaccagatactagagttagcttgtctttgaggcattttgctaagaaacaataccttgccttaaacacaacattcattatcagtgtgtgagatgctcacagtgtaaaagtccatgcagagactagagggagaagagggaacagcaaattcccagctccttctcatgcttactctgcagcataaaatcattagggggaatggtagccaatgtacccatttagatcatttctttctatctgatatgggctgattatatatcactgaaattgagaaaattaaatggcatatgatggggctttgctaagttcagtagtaaaatgtctgttgaaacagacttcagattgaaaaggttggtgaattttagatctcctgtttgtactaggaaatttatggacttaatatcatcttttttaggtaggctagcacattgttcaggtgagcagtttctcagaaaatgcattcattttcatgatgcctacaactttgtgaatcataactagtatatatttctgcagctcttctttaaggagaggctgagtaacttaaattttgtaacctgacctattcaagaggaaaaacttctgatgcatgcctttcactgctacctgcaaaaataacctcccatttttcctgaagccctgtttgggtaagttctgcttcagttcacattttcaccacctgctgagtttttctgttgagtgtcagccttggctactcgcaactgcaagcctatgtcagccttttctgtctcctaagcagtcatcagttggcacaattgttaatagattctacccatgtcagaaactcaatgccaaaatcaaattatggcaactagaagtgggttagactttcaaatagatctcagaccaggagtctgtggtccagattccacaaatggagtactacatttgtcttctttgtgcatttcacatttcaaattttgttcagaaacttgaataaagctcttaactgctcaaatacagtcaagtagggccccttactcaacctgtcttggcattgttttctgcccccttggagtgagcacactgaggagaaagattatcactgggtgtcttgagcagagctgcttgcttctgaatgctcacgataatcaatagcagatgtgtggtaagcactggaaagttgcataactgtctcacactgaattcagctacatcagccaggcaatgtgaggggtctccactaggttgttgaaaataaaatttagtttaaaacctatgtttatctcatcacaaaattatttccttgccataaggagtaaaggcagtggttagagtggaaataatttgacaattactgcccttagacttgaattttagtttagtatacacaggaactttctaacggttaggatggaaatggagttgttttttcaaggaggctgtctctggtaataaagtttgtcaaggcaattctggatgaatgtctgttgccggtgatgtgataggagattgcttcaccagccaggtagaggattaaacaatctctggctgggcacggagtctcacgcttgtaatcccagcactttgggaggctgaggtgggtggatcacctgaggtcaggagttcaagaccagcctggccaacatggtgaaaccttgtctctactaaaaatacaaaattagccaggcagggtggcacatgcctgtaatctcagctactcgggagattgaggcaggagaattgcttgaacctgggaggcagacgttgcagtgagctgagattgcaccactgcactctagactaggcaaccaaagcaaaactccatctcaaaaaaaaaaaaaaaaaaaaaaaaaaagaatagacaacatctaaggtttctttcaagcctgagttccacactgtgatttttgatacctttttccttctgctgcttttctgaaggaaggctgaggatgccttggtcagatgtgatgtcgtgctgtcctggccacctcagccccacctttcctcttcttcctggtgaatcccttctgtggcccctctcatgctgtttccattttgaccccattcacctgagcacaggaaagaaattcagcccttttgttttccttttccattgctagaccacacacattaaattgccacacctatctggaatatttacagagccagcatttagggcctccatatagacactcttaaacaatctgggacaatctggccttaatcatgattatatttggaaaagtgaagaggggaacctcatgattttcagtgttccatcatgttctttactcatttcatcattataacaaccctgttaaataagtgacttcattcttattgtacagatgtgcaaacaaaagcacagagaggttaaatgactttgcctatttttagaggaaaaatgaagaaataatgaataggaagaaaacccatcttaatgcaaatgaggcacagccagtgcttgctccgctgatgcgggtgtcagtaatcagggccaggtctcccaaattgagtctggtgttcttttccttgctcctggcagcccatatccgatgaggcttactgaacttttaattaaggtccttactgaacttttgatttaaaaaaaagattcatagtttcaggcagctgaataaatagaagctattgaatttatagcatatttaaagcattgaatatcaggaattgaatggcttcagtttaaagctgtgatcaagtcatttgaacagagagatttgacgatggttcaatgctagaaccatggccagccataaactctatggggacctcccaatattagcaatctttgagttactcctctgcaaaataagggacttggattttataggaacagtttaatacagtgagaaagtctggatataggagacaggaggcttagattgcattcattgtggtctaaagaacattattacttagttttgtgaccttgagcaaatcatgtaacctccatttctttaattacatatctgtaaaatgagtatgatgacccaagggggctaatttgggagtctaaataaaacctaatacaagacattactgctaagtacatccagccctccatatctgtgcgttccatattcatggatttggcatctgtggattcaatcaacagcagatcaataatattctgagggaaaaaaaattccactaagttccaaaaagccaaacttgaatgtgccgctactatgttgaatttacgtgaatgaagtgctatgtagccattgtattaggaattataagcaatctagagataatttaaagcatatgggatgatatatgtaagttatatgcaaatacttcaccattttatatgagacttgagcatcttcggattttggtatcctcaagggtcttggaaccaatctcccacagatgctgaggaatgactgtgttataaaagaaggaccgtgggtcataaattgttcagataatattttctgacctgatttggagagtatgcttgtgttttatcatctgctaaaagctttttaacaaggaagatttcttagaagagaaatacacctagaaagcctaggaaacaagcacatcccagatgtattattgtctctctgtgtgtgctcatctccgatgtcagcaattcttcccattctctcagaattaggcactcacatccagagcattagtgaatgtgtagaatttatgggagaagtcactgggcagactgaggagagggattacccataacttcaaactcccaggactggccaccagtggctttctccttccctcatctccacactcatcctcagcatcttcctctcacatggttctgccccagcccacatcagcctccccagtcttatcccagtgcagatggtccctgacttacaattttttaactctatgtgtatttgtgtgtgtgtgtgtgtgtgtgtgtgtagagagaggggtctcactctgtgtgtgtgtgtgtgtgtgtgtgtgtgtgtgtgtgtagagagagagaggggtctcactctgttgcccaggctggaattcagtgtatgatcatagctcactgtagccttgaactcctgggcaagagtgatcctcctgcctcagtctcccaagtggctaggactacaggcatgcaccaccatactcggttaaccttttaaaaatttttttgtagagttagggtctctctatgttgtccaagctggtctcaaacttctggccacaaacaatccttgcacctcagcctcccaaagtgctgggattaaattcatgagccagtgtgcccagccttactctatttgtattgtactaaaagtgatacacattcagtagaaactatactttgaacacccatacaaccattctgctttttttgctttcagtgcagtgttaaaaagttacctgagatagtcaacattttattataaaataggctttgtactagataatttagcctaactgtaggctaatgtaagtgttccgaacacattttaggtgggctaggctaagctatggtgttgagtatgttaggtgtattaaatatattttcagcttatgatggttttatcctgatgtagccccatcgctaagttgaggagcatctgtactcagcacttaaggctacttgaggcacagagcttgatcttctgcaaaagtgtataaatgactccactgtcattttagcattccctttttcaattctagtatatacaattttcttttttctttttcttttctttcttttctttttctttttttctttttttttttgagatggtgtctcactctgttgcccaggctagagtgcagtggcacgatctcagcttgctgcaacctccacctcctgggttcaagcgattcttctgcctcagcctcacaagtagctgggattacaggagcctgccactgtgctcagttaatttttgtatttttagtagagatgagatttcactgtcttggccaggctggtctcgaactcctgaccttgtgatccacctgcctcggcctcccaaagtgctgggattacaggggtgagccactgtgcccggccataaataccattttcttaaggctaagagagccaaataacctgggccagggagaggccatggagagatacccacttaggcttacttgtgttatggaagggtaaatgtaaatgtgtctgaggataataggaagaactcaaagcctacaggcctaaccaggtgagaccaagacacagatctctcccgcatatggggaaacaggagtgacagccaactttttatatagatcacggaagccttcgaaggctttcaagggtgtagacaaaaatgatacaagagaagttgaagaaggtctcaaagtgaaattgaaggaagcagattcagcctcagcaggatagaaaaaaaaatgaccatttttggtgacctgaagtttttgcgaactagaggctataggtccataactagtttacagaggtgcttcatatttttcactgcagagaacatataacattcttgaatgtgagtggaatatttgatacctcctaattaaaaggtaccttgtcttcccagttctgccggctggccttctaatttgtgtgagtctgaaaactcactgatctccccttttcttaacagacatctggggagctgtgagcaaaaggcctaaaagtcaggcctttaaaaaaaactctttgaacagctttatttaaggcataatttggaaagagatttttctgctgccctgtgataaagttcagtcgagagttggtgttaataaaccttccttagaaccaaggtgacttggaaagttgagttctttaggtctgtggtcaaattaacaaaattatgtcaataagccccaggtgagtagggtcaatttacatatgacacacacaaatatttgattatacctcaatgaatgaataaaccttcagaatcttagctaccattttcattcttccatcttgacacaaaaggtgggagttccattattagacacttgcaggagttcaacatagtatttaaatttaagtacagtttgttattaaatgagaagtgttgctaacttagttgcaattttgtatcaggcgggcggtaatagtttgttggtatgacttccatacatgttgccatgtgaaggatgtttggggtgtttcttaaacatacaagaatcaacaagtcccacctacaggagataacaaatcattatgatgtactggaccattattcactggggctaagaagtaaattatccccttttgaataaaagcacagcaaaatcaaaatgacctagtacatatctgagagcagcagaaggccaaggggagccctagagaatcagctgccctttgtcaccatgttgcagggtaggggtatggggcaatgcagcctgcccagagcagatggctttgaggttatacgggagactgaggaatgtacttattcacataaagccttttaaaataagctgagcattcattgctcttgagctaaaacagaacattcttccccaaggtgactgcttgcttgcatttaaatacaaaagaagtttctctccaggcttcctgaggccgatggtgaatgttcaaagatcaacgaagctaacatgaatctaaaatgaattataaggctgacggagcgcttgaactattcattcagcagttgtaaaacaagtagcacattaaaggacatgtattttaacatatcttatgtggtttgtccccagttggacttgcaaaatgacatttaataaatatttcttgtaagggtactttctaaaagaagagagtgaaagtaattctgctgtaggcagattgggcctgaaatttgggttgtctggatttgcataatcatcaccttgaaaaggtgttgctttaccccaattatagatcagtggaagctctcttgtgtagcacacggccctggtgagatcccttaagatctcttgtggactatctgtggacatctgggttgcagtgaggaagggcaaggatagatggtatagggagagaggggcagaatgttgacttgggcaggacaggaaaagccacttgtgactggtgagggagcatttctttgggttcagaatcatcctcatctcagtgtatctccccataagtctgagattactgagtgcaaggtatacatatcagcagctcctgactcaggatgtgtggcagaggggaccatgaagttaactgtgactttcggaagggtgcagtctgttaccctttcggtggcgaggtcagtttccgggaggctctgcaacactgatattttccagatgtttctcctcttctcccttctctggctggctatatcttcctcccttcatcctgctctttcagtgaaattgagataacatgttagaatcttaggcaggttagaatctctcagcagtaggatgtgatttaatatctagacctcttacattaatatttataatagccttcactgcttgtgaatagcataagcactcttttctgttcaaagtcaatactgaaataaaacccaagagtatgttttataaaaatttacttttaatggtgcaatggtaataatctatgtagtccttatggttttcaaatccctttgtgcttatattaccttatttaatacagacataaatctgtgaagtaaataatactatttttatcttcattttacaaatgaggaactggaggctcagagaggttaatttgcataaggtcatacaaatgatagatggcagaactggatttaagttcagactccttaaatccgtgtcttttgtacgttcttttcactaaatttgccatagtgtttctattggtttttgcctatataaaatcggaaacgaagaaaaagaaacgaactggaaaataaatttgtcaaaagagtatatttttttctcataatttccaagcggatctttcagatatgttatttgaggactttttgcctcagactggcgataaaacaagtgttctacaaaatacctccgtaagacaggcctatcagtggcagctcttgtccccgctttgcagaagggaaaaccaaggctccacagagctaaggggagttcctctcagccaatttgtaggggcctgtgggccagacccgggggcagaattgagatctgttgtgaaggctgtccggcttctttattctatcagcatttcaaatcctgaaaacctcccctttggcattttgaaggaattcatccccagtttttgctggtagccgggagggaaccgtgctctccccctgaggaaggccctttggagtaactgcagcagtgagtgcccgggctgtgcttggagtaccagtgctcgcccggggctatactgaatgagtaagcagccccgtctgcttttgctgtgcaaaggtaagggtggaggccgctccactttcttcaaaaggccccgctctgggacttgtgaaattgtgctctcttaagctggtccttgcaaccccatggacgatatccatgcgactttcctacaaaaataacataccaaagccgctttaaaatccgtaatttttgggttgcaagactccaagacaaagtcaaatgggcatcaaaaaatgtaatccaaaaatacagaggcattggttctaccctatatgcatttgctatttatgtaaaactacagtgtgctctgagatgagactttttttttctttttatacctttttttccgcccgtctggtgcgtttgccgacggttcttctcggccctgtgtctcgggagagtcggctgccgtctgggcctgtgccccacctgcgtgcgcccgggccgagccagccccgccaggtcgcctccgcccggctgccggcccgagcgcgcggctccgggggcggactcccgccgcccagctgacacgcgattcgtcactcttgcagaactttccccctgaaaatccctgcaccagaacccgctctcccgccccggggaggttttgattttagtggctttcttccttttattttacgtcgtgtgcggatttcgctgcagagcgaacttgcggctcgtccgagtacatgtgagcggtaatcgcccctgcagctggttatcctgacattatgcactccgaagcagaagaatccaaggaaggtaggattctggtttctcctgggggccggccaagttctgcggaggaatttggaggaaggcagtggtagaagaggatgggagttttaaagtgagcggtgggcactttgtccgcttgccctgcgccttcgaagccaagtcggagctggataagcggagcccgggtctcatcttgggctcccttctccccccgcagccgttcagaggggaggggaggaaaagtcggacctagttcagccagcccactaagtctgctttttagctttctctggaaacgaaagagccccacttggactccaagaatgcaaaatgtgcttggaaaagggctgcctgcctgcatcagaaagactgaaagcgggatccctggaagagccctgagtggagggtcccttgaaaaggggtttcagaaattagaaacgctatatgtttccggctaaaaggggaagctgagtgaggggaagcgaaaatctgtatttgagaaatagattaattttttttcattgctgggttttcagcagtgagttcatttcgttgggggtttgagggggctgaaagatatgagggggtccttgtgcagcttgaaactgagaagagtttgtctgtttctaacttcgcaaaagcaaagggtttcatttactccttacagagaacgggtgacagggctggaaaagctccaaccaaaacacaattatacgctggtgttagtttggggagtttatttgtgtgtgagtgtttgtatgctttgttccttgaaactttatgtatacaaaagttctcttgtaagtggggggtgggagtaagggtggttggggaaaattagagagtaagagaggagactattcaagattgtgaaatactctttcttttcatgtagtctcttggaaagctggttaatttcaagtcaatcacagcagttctggcagaggagcagccccatcatttctccatttggtagacaccagttaggaagagcccttgaaacttgtcctcttctgccttttactgattcccctcccagaggaaagctttgtgtttcaccatgtagtctttgtgggctcacgtttaccttattatgctgtgtgagggaaatagtcaataaaaaggaggtttgtttaatagaaatacggggctggcatgaatgaaaaatgacagccaggagcattgtttttgagtttgatgtggagtatggggggagtaatgctttcttgccgtgtcctgtgttctgatggagctgtgtgctgatagatgcttttcttttctatgtctttataccagcagtttattcaaagtcaaaggtagttgaaggcaaataggaaccaggctgagagaactcaagggtgaacttctgtgtgaattacaagtagcacttaagctggcgttttctctcaggtgtgttttccctgtcttttgagaaagagagagtgggagagaaagtggaaaaacagtatcccaaagtgtgtattatacattcccatagcaacatccacagtcttccctcctcgagggcccagctctctggttttaagtttggaagcagcctgcaaactggcctatgaagaggttaatggggccccttctgcttgttcctcaccttccctccacttgtcatcatttacattctgcagatcggccacaaatgatatggcgctctgctttttaaagaaagcccagaatgtttcttttaaaataatctgaggtagtagaattttaaattgatagcaattagggtgggatactgaataactcttgagggagattgaacactttattaatcagatagaatcatatagcttctgccaggaaatgaaggataggtgtctgtgtgttttgggtgtgttttctccaaggctggttcattggctgtaatctagaaccttctggttagctaccaccactcagatgtcgatgaagcgagctatgttgtgtaaataactcagttatcttctctatcgttactagtccttttcctcttatacgtagctttttttttttttttcatcctggtgaacttatgtatcccatttagtgtgagatcaccatgagttcttaagaatgtctgtattgcaagaaaactgcctttggatgcttcatgcctgatacgctgtaagaggagatacttttaagtcatttttctcaactgtagtgagagactagtatactttggggttgaatctaagtccttggaggccagcatatttttgcatatgcgtgaatgtagaagcaaatgactggggatattgttaagccatcagagcttaaaacatacttgactctgtgccaggggtgctggatatttgtccccagcctatagccatctcctaaataattgatttaatttttcctgcttaacaatgaataagtgattgtgcttgggtattaaacagagaaaaataatccaggccttgctttattaaaaactgaatgagtttaaattattcagacatagaataaataggaaagaaggggaaatgaaagaagaaactcacttttttaaaaaggtgactaccattaaaaagaggatatcaacagtttccagtggatggggcttcctgaggagataggctgatagccgtgtatttggcatttagttgtttcctgagtaaattgcttaattatgaagtagttaaagtgagtggcagttgagatctctgagaatctttctagtgctaagcatcaaggcatccagggctcctttgctctggatgttgaagcattgataccagaaattgagaaagccattgttaaggggtgggcgaggtgtcactttgtggggacttggaaaagagtgaggattgagtggtgagtgagtctggctcgctcctccattgcccatagtagccatttcccaccaccacctcacccagttcttactctcatgcctcaccaggcctgctatttcacaaagaaaacagtagccattagataactccctcaacgtcctgttcccagactgacagactcatctccgtccacatctatcctccctgtgtctgtggaacaggtgtcattcctactgcagaatgccccgccttccaccttgggctcctcctacaccagtcagcccatatccttcctggctccttcttttctgcatatagaagaactcaagctccccattctaggacattggcacttgctggtcttcctgcccaaaatatccttctctccacctgacctccttttcttggtcagctctttaaagaggctttttctgaacctaaactcagatcccctgtcgccctctctcagagcacctgttcctttccttgctggctctccccacactgcttaacatctcttctagaccacaagctctgcagggaaaaacaatgtctgttttattccccgctgtatgtctaggacctacagagtaaaaggtgctcattaaatgttgtagattgagtgaatggtctccattctttaaagttaatccttggcaaaaaaaaaaaagtttagttgttccgtagtggtgattaatatcctcttctgtaataagaatcccaatgatattttataagctaccacactgtgtagtactctgttttaacctcacatggtgtggcagcttatataatatcattcatcactaaggactattttgtaagttttctcccctattcctgcccttccccagcctttgctttgcagagggaatgaagagaaaaggaggttaaagcagtggttcagctctgatgaaaccaaggggtatagctgaccttgatgtcatacataatgtaaaaggtacagcatatgctcttaaacaccggactttgacgtgcttatctgtttccttttatgtagtcattaggcttggagtgttgtgtgctgacaaggactaaaagtggaaaatccatttagagatctatcatactctctcctctacagtggacatcacttgataacttggcattgccagacacctccagctctgtaaacttaaatgcatttggagcttttttcccctcacttctgaaatttttatcatattgaatatgcatcctacctttcttgcccccaccttacgccattgaacagtcaggattatatggatgattaaatttcctgctcctgactgttggtgatccaggaagtagccaaaaagtgggtgggtgaaagagaatgcagtagagccagaaaaactcaggacccagcgattgcatttcagaacactgcagaattgctggatttacctataaatcatttatttgtcagcatttctgtctttatgctagcaacttgtaagtcagtgagattagtgtggttatagacctgtcttcatttagagaagattgttctttaaaacatagtgtaagctgaattaaaacaaaaccaaatgatatgtatatctttaatgtttaaggaaggtctgtagtaagaagtcttctgtaatttaaagtgcccttctcccaccaaatacacatagaatcaccatgatttagagctaaaagcgactttgccaatccttctttctgacctcttcattttagaggtgaggcactgaggcccagcaaggtgattgccaagccctttctatcctctttaatacatgttctgcaagcaaggatttttgcaaacacaggttttagcatcctgggtatttgtatgcactctccttgaagtaggacagacctagtctgtttgtatagttgtcattcactacctcttggggggatttataaaacgcagatgaatgtttaaacaaatgaagatttcctgtttcaccttctacgtgtaactcaagagaataaaacatgagacattgtgaaataaaatttagctctgcaagtagatcctattagatcccggattttgaaagttgtagaccaagtgagaggcaggtaaacagtgagctcacttgttttcattcctttgagaatatcattcaggaaaaattagctattgagggtgttggttgggtacagacactcttccttggggagaaggtatgtatgtgtgtgggtgggaagggagtcagcattctgacacagaatgtgctattgcaaaagcagacatcccacagcctctctttctctggagcacattgcagcaggcccggtgcactctgggagtcaggacacctttctcaggaagcatttgcggggctgcagcgcactgcccccccagccgctgaccaagatatctgaaagagcaattgcttaaattttattctaaaagtttataagccttgaagaagaggtacagggatgtagtatgtcctgagtgactaactgctgagttgggaataaattgcctaagggagtgctgccctgggaatctgtaagattgagtaaagcctgttagttaagctggtatttatatggttttgaagatgggggaggggaggagttgtgtttatgtggacttaatgataatacattctccagctttgtagtgaataatagttaattttataagtaactaggaacagagtttcttctaagaaggtgatgaagcaaagagactataagcagaattccctacgtggctctgatagctttaggtgcctgaagcctccagaccacatttgttgaagtcagggttgactgtcaagaagtgaataagcagctcatgaattttccttccagtttgacctgccatttatgcttggtgccagctcacctggcttcaatatgtgttttcatgtggcctacgcagccaggctgagaagctggggaccaggggtgtccccagaggcacaggctgttctgcctgtcatggactgtccagtagactcctgcttccagggtgcagcccctctcccttgcctgctgctgccttctttgagcctcagatactcctaacaacaaatgttaactgagatagcacctcctctgcagggcctggagaagcaaaaatgtgtgtgtagataaccccatcttcagagagtttttggttcagggcatcacacacagcacatgtgcatccatagtacaaaaatacatgatggagagggatgagtacagctcagaggatcagacagtggaccctatgaaagtctagaagagggggtattcaccaaaagtcatgatggacaggagtgacttcaaagaggggtaacttgtattccagctagttcctttaagcaaatggagaagagaaaaagaaagagtgagtgacagggaacctacttatgctgtgtgctgggatcaggaagaatgtctacagaagtgtggagagcagtgatcatggtgggcattcgtggtgatgttgtagtggtacatggggccagtctagaagctggactttcccagggggacattgtatgtaggtaacagagataagaccctgtgagtcaggagactgatcctactcatgactttgttcctggttgtctgtgcaaccttcaatagctacttaatctttctgaagttcagtttccccattggaaaaattaaggctaggcacaatggctcacacctgtaattacagcactttgagaggttgaaggaggtgggtcagttgaccccaggagttcaagaccggcctgggcaacaaagtgagaccccccatctctacaaaaaaaatttaaaaattaggcacagtggaatgcacctgtagtcccagctacttgggaaaatcaggaagatcattcgagcccaggagttcaaggctgcagtgagctatggtcgtgccattgcattccagcctgggtgtcagagcaagattctgtctcaaaaaaaaaaaaagaaaaaagaaataggatggttttcagctggatggaggagggcagatgcaaagtagtgttttagtaatgccaagctggcaagaaccatgagttggtctggagggcaagattgaacctgagtataaggagcctcgccaagaaagtgtgagagtagccagtcacaaagggagagttgattccccatatgtagtctctgagagcaagactgtagggaaaggaggggactgggccatggatttagcttctgagaatatccacttttacaaaggagagaggtagatggaaccaataaaggaaatagaaatggagtagctcaagaggtaggaagaaacaaggagagcatggggccttggaagccagaaaggcgagagccccgtggaggctgtggtcagcctgtctgtagagaagagctgctgaagattgcttcgtcttccttttgggcctcagctaaaaccaggagcctgggtttgaggagctcatcttctaagggatgggaatatatcatcagtattcagttagtatttagcaggtgatcaagggcatgaaagaaggcatgtggggcccaggaggtgactgccctgccaagagcaagtgccccagcctcctgagcagctggccgtctccatttctgcatgctttccaagtcctagttgccagtagattcctttccagattgtcacaccatcacctccaaccagcatttggaagagcatttgcctacaggcctcttcctgtggcatcacacaaaatatgcagtggtacatgagggtaacaagtgaatatgggcaggaaatttaattcatcttaaaaagaaaagtaactggtttcctatacattcacaacattgctgacaccgaatgtgagagggtctttcttacaccaaccagttttccaaatttcagcggacgttgactagacgtcctataatttaactcatttctgacactaattgtccagagttagggcagaccccacaggttaagggctcagtcccacaagactgtcctccaacttgagacagcaattgcaaggccaggcatcccatacttttgaccaactgggtataaattggggatttgcatgacagcccctcaggttcagtaatttcctagaacagctcatgaaactcagggaaacatttactgatttattctaaaggatgcaactcaggaagtgccaactggaagagatgtgtaggacaaaatacagtagagggatgcaagcttccatgccttgtccaggcaggccaccctcccagcacctccaggtgggatgaagtcattggccattggtgattaaactcagtctccagcccgtctcccctgcccagagtgggggaactgaaagttttaaacctctaatcacctgattggttcgtctgctaaccattccccattctggtttatgagtcacctcattaacataaacaggtaagtttgaaagaggcttattatgagtaacaaaaggcacccctctcacaactatcactcaggaaattccaaaattttagaaactctgtgccaggaactagggaccaagaccaaatattacaacaaaagatgcacctatcactctgttgttttagagatagtctcactccgtcacccaggctggagtgcagtggcggggtcatagctgggctcaagcaatcttcctaccttaccctgccaagtagctgggactacaggtgcataccacctgcccagctaatttttaaattgttttgtagagacaaggtctcactttgttgcctaggctggtcatgaactcatgagctcaagcagtcctcccaccttggcctaccaaagtgctagaatcacagggatgagccaccgcgcccagttatcactcttatcatttaggaaattccaagagttttgagagctctagccaggagctagggatgaagaccaaatgtatatttcttactatataacagtatcacacagctcttcatactgggggaaagctttggccactcaaaattagataatttttttaaggtaatgaagggttttttccccttttttcttttcagttttttttttttgttttttttttttttgagatggagtcttgctctgtcgcccatgctggagtgcagtggcgccatcttggctcactgcaatgtctgcctcccaggttcaactgattcccctgcctcagcctcccgagtagctgggattacaggcgttcaccaccacgcccagctaatttttgtatttttagtaaagatgaagtttcaccatgttggccaggctggtctcaaactcctgacctcaggtgatcctcctgccttggcctcccaaagtgctgggattacaggtgtgagccaccgcacccagccaaaatcagagaatttttatttgctccctttggccttcacttcctctctcctcgtatttttttcttcctgtgacaggagtgcatgtcttagaataccactgatgtttctgccaggggtaccctagatttggcatataatttggaactcttaggactttagtcttatacatattaactaggatttgggccacactagtaagctgagccattttgagaaattttagattccctctgagatggtaagcagttgttacaccagtggaaatatgctagatggcttattccttgtgagaaccaatgagataatgttagtgtaaagctcagtgctcagacagcttcactcaggaggtactgtataaataaggaggcttataatcacaccaaaagacagaaccctgcccaggcctgcctcttcattcagttaagaagtcctcatttcatattctctaaaaagcaggtaagagttggcttgctccaataaactttttcctcctgtaaagttgtttgatagcaaaatattagtgcactgagtgttcttattattaagcacttacaaaaccattttcacctttcaaggattaatatgagaattgcatcagttatgaaatatctagaatgaaaatgcatgcctcctcaatatcacaagtctaaacattcgactcaacatcttcagaagaaaagagaattaaagaggaaatctctcaagagagttttccaagaggtagacagaattcaggggcaagtagcacccactgtaagggaaaggaaataattattgggaaatcaaaatagcaaagaaagttaagggagtggcagtttggcagatttcacagttctgcaggaacaatgagggagacatagcagttgggagcgatggggagtaggagggtgtgagagcaacagggtgggtgggatccaggcctgatgagagcctccgagggaagaagtaggagtggagagagagaggaagggaggagtaaggaaataactctaaaatgaaaaaaaaaaaaagtaatatgtgcaaaacttaagaagtgaccagcagtataataggcaagagaccattgtaactgggttaagaagttttggcagcttgcttattttgtttgattttgcagttaacaggagagaaagtggggtgctggtgtccaaagcactgtgcagacttggagccaatgaaatgtggcatttggaggacacagaagctctctagtgcttctgaggcaggattaatgcagaggcccataaacaaggatgtgacattgaggaatgctgcccctcttccaactgctaaattggggccagtcggaagccagggcagtgttatgttggcttggatttctagcaactttcttactgggttataaaaatgatttcctcaaaaaagcttgaaaatggcaaatgatgaagtagaaaagcagtggtgtctgcctgtgggcatcatttcaaagctgcctgtgacatcgtgatgcccatttctggagggccagtggtgagtggtttgttggagggttaaagccatcacttccaaccagtgaagctgtacctaacttcggggggtttccctcattaacaagtctgatggtaagcaggcctcctgaaggatttcaggcagaggatttttaggggtagaactggtttaaattatttggcttacttggccatagctctgacttggtgattaggctgatgaccctagaagtataggggtgattacttgacattcctgtccttgccacctacctattccagcatactttggggttgcctctctgtgcaaatggggagggacatgagggagaggagatgttgattgtaggtctcagcagtgaaacaagctggctagtttcaacatgtgtaagggttaatcgggtaaattataattgctgctaggagaggcagcctagctgagcccacccagccctcagggttgctggggaaagggtcattcttgcaatccttaattgttttcctctttcccaaagatgagttcttaatgtaacatcatggtccattgacccattaataaagtttacattcctgatttgttttagtcctctgcatttctagttctttaaattctcagataacccttcctttaaaaatgcaattcggccaaattaagcaaagaaaggaataatttgatttttttgttgctgttgttatttgagtcattctatggtcttaggcaattttctaaatgaaacgtggaatgtcaactggactattttgtcgtagaggatgggagggagagaactgttatatttggtagtggtactagaatagtatagaacctaccagcaaaagtgtctcagagtaatattgtctgttgtttcctttctatttttttaaatggcaccatctatccctatcttgtgaactagttaaacatgttttaattgtatatcttttaaagcttcagttagccagatttttaaaaaaatgtttgatgttgttttttattccatgaatgactcaattgactacatgtaggcagctactaaacttggcagtttgttgccattagcatgcccttggacaggaagtattcagtatagatatgacaaaccagtttccaggcttaaaaataaagcggggatttctggacagaataggtctttgtcactcatttcaacatgtctgatgagtgttaaagttcaaagcctatccctttgctttctcattttttttcaggccatcactttacctgacatattctattatatagattgaaatttatttcatgatgctggtgttttgttcagtttttaaaaatgaaataagaggatatttgaatagtcatgagaatcagctagagtcagtattctctccttgttatctctttcatgtttagttccttttaagtcatctccccactgaggtaggtaatggtgaaataatgtttccctgcctgtaaagcagcttaaattaaaagtagcaagtgtgtgccaggtacactacatgacttctcttcttgaatctgtggtccacttgaaatagcatttttttccccaaaagttgcttcccatcagtcttgtagttcttaatttcatttgtcaggtagtcacttagcaacttgggaagaatcatactattttgacagatactaacaggttttttggcatcttgttgcctacagttattgctttatgacttaaaaagtaagttcatactttttttgctatctcccgaaataatataattttccctcctgtctgttaaaaaaaaaaacccacactttctcttctttctttcacttacctattctaagcagcgtgtgtgtgtgtgtgtgtgtgtgtgtgtgtgtgtgtgtgtgtgtttgtgttggggtttaagaagccttgacaccacatttcctggaaatactaaattagtcacagcatttattagatgagagtgtctacaacaacaaaaaactttctttttctgaagacttaactccatgcaagtgtcaatctctgagcgtctatttgtttttcaaataagaaactgtgccaggaaaagatgatttgaaatacaaaatgcttgcaagtgtttttagtttggggtaaggtaaagtcaataatgattctttgggacatttttcgggacccaactaaatttcatttgccaaacttagcaataaaccatgtttataaagaatgaggttaagttcttgttctggggcaggacatggctgtgaccctgaggtgcttgtgctctggagctccttgactcttctttcatgatgggagcaggcctgagtagcccctgctatgctgtagattgagcttgataaaactccggccttttgaaattactggaatcctctaccctaaataccctatacctgttcaaataggatgcttttagggaaaaaaagggaactgttaacataagccaaactttcttttcttttcttttcttttttttttttttttgagagggaatcttgctgtgttacccaggctggagtacagtggtgcaatcttggttcactgcaacctctgcctcccaggttcaagtgattctcctccctcagcctcccaagtaggtgggattatgggcacccatgaccatgcccagctaatttttgtatttttattagagatgggatttcaccatgttggccaggctggtctcgaactcatgacctcaagtgatccgcctgcctgggcctcccaaagtgctgggattacaggcatgagccaccgcacctggcccaaactttcattgagttaaatgaatccctggtctgaaactgtaatttctttagctttgtagtgctcaagactcttggacctgaaagtggctggtaagcgtcttctagtttttatgatgatgggcacattgtaggcaaacagaaaatgcctgataaccagtgaggtgtgaggacaggcatatgattcagagtgtaaaatattttgcagaattaaaacttaggcagtttttcatgagattcataaatcatccatacattgatattttttgtgcctctggcctcattgtttggtttttaggcataggactgtgttttactcaataggtagttgtatcatccatggtaccacagtctgtcaaaaccacaccagacattgataatgtattgtgcatatggggtgacctttaggaaggcttggtaggacctttttcttgctggctcccttcgagccagtgtgagtgatattccatctcctagtctgtgttttggatcactgtgctcacgcctaaagtcagaacagacagacccatgggagggacttaaccaggtttgtctaggccgatggagggctctaatggggtcacttcttactcttttgaaaagtggtggaaactgaaatgaattgtctttcaaatttggtccaatcacactttattgtctgaaaacttctgtcacatcttgtggcagcaatggaaaagggaatgttttaggtaacccttgtgtttgaaatgcctgcttttcttttttttattgttttttaaatggatttttgtttattttgccacagaagcagctctctgttttaatttgttggaatttaacatctttggagttcttcctgggttctagccactggaacacaaatcagtccagaagcttattactagttaactctaatttaaaataaaaatcaaatttcagcagaaagattggagaagagaaagatattacttgattgagcaacagagaaacaatgcatgaatccacacataaaactctttaagttgagtaaaggaggctttcaaaccctaattcatgcatttaacaactaaaatcccagcttttcccatgttgagtttacacagagaagttaaaagataaatagactttatcagactttgacagtaaattaaagaccctttatcttcctgcctggaagttctataaaataatgggtaataaaggcaagctattagtcaaaatggtctgaattaagcctggaaagaaaatcttgcctctaagagcagaagggtgcaaaacactggcccctcctgggcttgggcccagagacaaaggaatagtggttactatgacccaacatcagtctgcagccagagttccaagcatcttctctgctatccctaatgatttaaaaatatataaaaatatttcacattctttaccctccatcagaatgcagtgagcagtaagtcagctcaagaaaatatgacccagtgcctaacccgttgatactttattagatgccattaaaactttagagagctgggagattattaaggcctacatttggaacctggaatcttttcctttgggaacctggaatctcaactcaaggattctgtagcttgcttttttgcctgtatctaagattgctctattttgtgataatgtaaacttaatggaagaaaattacttcatagatgctagacattcaagaattaaatccccttttcatgttagctagtgtcaaaacatttgtttaaacatggtttctaaattttgatggggtagcatacatggttttattttattctgtagatgtagtgaaaaaatattttattttgatacattaacaaggaagataagacagcattcattttgagtatttgctatagaatataccctgcattggactgtgcgtggagtctggtatttgtatgtttcaaggaaataaaggtacagagaagcacttgttcgttgcctatataaagactaactgtacagctgacagcttaaaagtactgtatgacactgcatttcttgtccaacagtagcgtctgtttccttcattccaaaaccaaaaaaaaacattaaagatgaatgctgaaaatgtgatagaaaaagaccttcctttttggcatgtccattaactgccctcaccgttcttttccaagcataactgctagactggatggcataaattaaacaattaacaggatactagttcaaggggaaactctccagttagggtagatttaattttcagatttggaaaatgaatcaaattacacattcaaaagacttgattcatttttttctctaagcatgtactttttataatatacattgtctaacatcggagagataaattcagtattattttcctaagatactttctgccttttgtagcagtgagaatactagaaatcagcgaggcgtggtggctcatgcctgtaatcctggcactttgggaggccaaggtggacagaggtggtccaagagttcgagaccagccggggcaacatggcaaaaccccatctcggccgggcgtggtggctcacacctgtaatcccatcactttgggaggccgaagcgggcagatcacaaagtcaggagatctagaccatcctggataacacagtgaaaccccgtctctgctaaaaatacaaaaaattagccgggcgtggtggcgggcacctacagtcccagctactcaagaggctgaggcaggagaatggcgtgaacccgggaggcggagcttgcagtgagccgagatcgcgccatggcactccagcctgggcgacagagcaagactccatctcaaaaaaaaaaaaaacccatctccacaaaaaaaattatttttaaattagccaactgtggtggcacacctgtagtactagctactcagaaggctgaggtggatcacctaagcctggaaggtggaggttgtggtgagcagagatcgtgccacttcactccagcttagcaacagagtgagaccctgtctcaaaaaaaaaaaaaaaaagaatactagaaatcacatcaagaagaaaagttcaataaaataggttgtctttcttcatagaaatgatgttttagagtttattatttataagaacttataaaataacagctagatatgatcaataatataatattttccaagaacaaagatatgaccgtaaaccttgctaatcatttgactaagtaaaataaattcctagctttgttaaatggccaccgctatgtgtgcagattttataaaggctccagtcttttagaaaaagtagcccacataccataaaaatacaagttgaccatcataaattgtatcttaacatttttttaaaaaattatgttagtggctgggcactatggctcatgcctgtaatcccagcactttgggaagccgaggcaggaggatcacctgaggtcaggagttcgagaccagactggtcaacatggtgaaaccccatctctcctaaaatatacacaaattagccaggcatggtggcgcacacctgtaatcccagctactcgggaggctgaggcaggggaatcgcttgaacctgggaggcagaggtttcagtgagccaagatggcgccacttcactccagcctgggtgaaagattgagactccatctcaaaaataaaataaataaataataaagttatgttagttaacactgcatttattttttatgatctttgtcctatatctctaccatgctgaccttggtagtatgactggattcttcttgggtatgtattacacctgaagtcattacagaagacactcagtcccttcatccaccccagacacaaagcttaataaccatacccaaccccttttcgacagcctgctggccacactgactttcctataagataaaaactgccgtatgtgggatagctcttgttagtacaccaagaatgacttcccaatagtaaaattactcttaccccaaaatgtaagagagagtgaagagatgcagatattttccctatgttaggcacttcatgtactaagacatttttcattcatttcatttagaagcttgtttggaattctaaaaagtcacttcaaaactttcctcaccgggacgtcaagacaggcatacaacgggaaagtgactagggataagttaatactggtaccttcaccagaggaggagtatgcaatgtggaagacctgttgctgctgttgagtagttttcagtctagaggagttaacatgcatacaagaaagtacatattacatgggggttagagaggtttcagaagggctgtctgtggctgagatctttgaggcagaactgttgagacggaagggattggcatgaagctttggaagactggacgtgtggttgtttcccaaatatggtacgtatgccactggtagtacagtgactgattttaggaggtcccaggtatagtattaaatcatcttcagtcatatcacaaaaaaattagttccttttcagtgtccttggagtccttgacatcattcacagagaatgcctgcgttttgggctatgtgatctctgccagctcacagaagcttacctctttttgtgccatgtaggtagatggggattcatagcctttggcaggcaacaatatctggctagaaactaatagtattggtgttttttttcctcattgaattatttcttatggttttaaacattttttaatgatttttaatgatatatttaggggagtatcagtttccattcacatagtatatagggtttccttttatgtgaattaatttttttaatacaaatacattaagtaaccataagttaaagtaaaatacaggtagcgtatcgcttatccaaaatgcttgggactgaagtgttttagattttggattttttttttcagatttttggaatatttgcattatacttactggttgagcatcctatatccaaaaatttgaaatctgaaatgctccaatgagcattttgttttagtgagtgccatatcagctctcaaaaactttccaattttggcatattttggagtttggatttttaaatttgagatgctcaacctgtaccgatagtaaatagaaaacaaggcaagtgggttaggatgttcctcacatagatacagcatgacttttcaggggaagagagattccagcaaagatcctgggatggagaaggtaacattttgagagaaaggtgagtaagaagttggcagaagcccagggggtcctgttgaagagtcagagttggacgccttctagctcagcttggttgccagcgcagggaacagagggctgtagctctttgcatcttatactcaaggctgtctgcaaagtgattcagaatggtttgagcccctgatcatttcaatgcggggtagctagggcatatgcctacgggagccaggaaattacccaagtgctggaatggccggggggctaattggagaggaccctgtgtttcccactctcctccctcagtattgccagaaggtcagatttttttctgagaagccagaaatgtgaatttttattgaaagttcccaacttctacaagtttttttaaatactaattacagaaataaaacttagaaccttttgggggccaattttgggggtgatggacatgtcctggagttagatagtggtaatagttgcacaacattgtgaatatagtaaaaaccactgaattgtagatttttaaaatgcttacagtggtgaattttatgtgatatgaattttatcttaattagaaaaagaaaaaaacactatgagggcccagccaaaacatgttgcctgccaaaagtttgtaagctttgcttcaaatggaggaattgctatttgctgcttttcataatcccaacagaaagcacctttccacaggggagcaagtgattgggaattaatgggggtcatgttgtgatccctacgttaacctctaggcctctgtttttcttcctgtggtctccacggcttcttctatctcctaaaataggacccatgatagaaatggtgagatgtggagtggtggactttcttttagagtaacgagtgagtaggtgaaaagacacagctacgaaaggtgggggctgctcaagtattttagagaagaaatttattttattttgcaactacttataacattgattggttgtgttatgttacttgccaaagtttattttacccagatattaaccattagagaagtaattaatcttcaagacagcaagttcgtatattttggaaaacgtttttcagttcttaccagggaacgactataatgatctttttagttattttcttcaagtggaaaatgagtttaatatagcaagtatatgtcatcaacatcaaaggattatataattattttaataaaacaatttgtctttgtaacttttgggaggctctattaaattttaaatataattttaagtttgccgatttcaatagaggcaaaatgttcaatttaggatcttaaagtaaggattatatccttagttaatcttcagctttttttctttcgtagcaaactagcaaagaaaggtagagtttctgcctttttcttatgacttaaacctaaagaatatgactttttaaaaatcttgaaccaacatttgtactaaaaacaattattatttttcaaagtgtgggttattcagtagtttttgccagttccaaatgttatcagatgactttttggatgcctatctttagtgatgaaatgtcgcatttagaataaacactttccacccaaagaacactgaaattaaaatgaaaaaatatatataaacttaaattttcttttttgtttttttttttgagatgaaatcttgctctgttgcccagactggagtgcagtggtgcaatctcggctcactgcaacctccccgtcccggcttcaagagattctcccaccttagcctcctgagtagctaggattacaggcatgtgccaccacagctggctaatttttgtatttttagtagagatgggctttcaccatgctggccaggctggtctcgaactgctctctgtcacctcaggtgatccgcccacctcagcctcccaaagtgctgggattacaggtgtgagccactgcacccggcaaaaataaactttttcaaaaggactgcattggaatatttatttcatatgtaagagtatttgaaatataattaaatctaatgttatttatttgtagcctcttatttcggttgttttataaaaatcagtattcattgtcttcccaccccccccgtctttctgctcccccagaaacaacctgagaatgcttttaatccagcagatacatattaaagattaattggtcatttattgcaaggaataaacaataaattgtaaccaatcactaggatttactttcagggagtacggaaacaaaagtatgataagcagtttccaacagcagttagagacaggatagagcatttctgaatggacggtcaatgaggacttcctgatatttggaaggtgatatttgggagggactgtgggagacttcaccaactcaagacaggtcccccttgattccttcatgcctctgctcaaatgtcgccttttcggaaaggccttccccaagtacatcaagtaccctagataaaataacatagttccccctcccatacacacatttcatttttcttttagcctatattgctgcttgacgtatttatatatgtttgtttgtttgtttatatattaggtgtcctagaatctgtgcttcctgagagtaggcactttgcctggcacataacagttgcttaataaaataaaagtgtattgaatgaggctgggcctggtggctcatccagtaatccagcactttgggaggccaagacaggaggattgcttgaggccaagagtttgagaccagcctgggcaacatagcgagaccctgtctctatcagaaaatgcaaagattaaccaagcatagtggcatgcacatgtggtcccagctacttaggaggctgaggtgaaaggatcacttgagcttaggaggtcagagtgacattgcactccagcctgggcaacagagtgagaccctgtctcaaataaataattaaataagaagtaaaaaaaaaataaaaaataaaaatttgttggagaaagagtgagggaatgaatgggggaaagtttttctgccataaggctcttgactgtgtagagctccaaactggtatggagaatccaagttcagttttctcctgggatcattgtaaatttgtcaaatttaccaccgctctgtgacttagttgacacattctatagaaataaggagattttggtactcaaatgtagcttcctgaagtctatgaacaagtgttatgaaaacaaatcatgatcactcttaaccttcccaccacttcaccttgcaaacccctcgttagaacctcatataagttgtgtttaaattatttcacaaatccaagaccccacacatgcccctcagtttccaacatacgggtacactgctgggccagatttttaattcctgactacccagtaggagttgttccactgaaatataatcacatttatttctgtaaggcagtgattacctacgcaaatgcctacagaacccaggaaatgaacagaaatgtgtagatggccaggagggatgtggtaagctggaaagggtagtcttctaaaggaggcagccataatttagctcaaatccattgttgtcatatgagaacgtgggcccatttggtcagatctgattgttcaaagaaaatcagacacacacatgttgaagctaaatttcccaattttctaacatggaccactaatcctaaagtacaatcctggatgggccaaataatatgatatccaggttacaacttctgcaaggcatcctgatctaaataaaacggggatgcctgggcatgcggagaggaaaggttagaaaggggtaacaaccacttcacagagaatataaatgctgtgctggtggtgagcaatactgcttctatagaactctgggtttttttttcctagaatttcagagcttcagagtgtcttgatatttaaaatgagatcgtttacatgaaagcctagcaaattccatcttactctttgtttacctttaactggatctagcctcctgacattaacatggctatgaaatgcctaacaacatttggatacagttattgaggaaaaattgtgacaagaatgttgagaggttgtgccaagatgcatatttgagagatgcccaagctgaggccaagaggttactgctcctaaaatattcaaacagatgggtttgggatctttgcatggaagattccagaacatttgctgtaaggattgagttaactaaatatggtcacttctccaaacaaaagtagctggttattctgtatgttttggcaaagggcagggaagaaaagcaatagattaaaaaaatgaaaatgcatttcttttacacagcttcctcccctttaaagcaaaaggtggctgggcgcagtggttcacgcctgtaatcccagtgctttgggaggctgagacaggaggatcacttgaggccgggagtttgagaccagcctggccaacatagtgataactcatctctacaaagagagcctggcatggtggtgtgcgcctgtaatcctagctactcaggaggctaaggtggaggatctcttgagcccaggagttcaaggttgcagtaagttatgatctggctactgcactccaacctggatgacagagtgagacattgtcttttaaaaataaataaaacaaaagatagtttgtatccatatttagggttatgtgtttattcatggagtacagataaattcatttattaagctctaaatagaagaaattgagttgatttcctgatacaccttcatgaattgctgtaaaagagagtgaagggttccatggaggcagattagagcatagggtttagtgcaccccatgctagctggagggcacgtgttaagcactttgaagaatacagagatgaaaaggcatgtacctgtaccttacttgtcaaggattctaaatagataagagaggaatttaactctttcacaagacagaaaagcaggttaggagagatttattctggccattggatttggaaaagctttttggaaggggcggcatttacattgagctttacaggatcaatagcactctttcaggcagggatgaagggggaaggtgaaggcagatatatagcttttctttagtttctgttccctgatgtgtttgacctgtgctccttcattttatttgttttatttttatttgatttgatttgagacagggtctcatctgtcactcaggctggagtggagtggcgtgatctgagttcactgcagcctcaacctcccaggcttgagcaatcctcccagcccagcctcttgagtagctgggaccataagcatacaccacaacacctgggtaatttttttgtatttttagtagagatggggtctctccatgttggccaggctggtctcaaactcctgacttcaggtgatctgcccacctcagcctcccaaagtgctgggattataggcatgagccactgtggctggcctgtgctccttctttttagttcgaggagttgctttatctgggggagcaggcaggctctaagaagtgggattctgcagctggcaagcagcttcatggcatttggtaggcaatttataaacaatgaacattatcctaatttcacttttcttatagagcagctgtgtgctatagtaagaagtaatgggcctcagctctgccactgtttatgcacccttagataagtcacttgacttctgagcctcacttctcttatctgggtcccccagggttaagtaataacaggaccaaaccagaaattcatttaaaagtgttagtgaaaatatcttgcaaactgtagagtactatacaaaaatcaactgtaagttttcttgtctttgttatgtggccaggagcaacctgatgaaaccagaaagggtgtgttgaccattgatgccagctgtgggtctggttcagtaacttcactctagtgtgctggattttaaaatgttactggttttctaagccctgcatgaatataaatattcatcaagagtcagggcctctggcaggacgggagaatttagggatggaaaagtgtagaaaatcacggagctgttgagaggattatcctctacattctggtagatgattggattatatcaacagtggaaaggttttatgtcttcaagaaaatatgtaaataaatccagcttaattgaaaagtctttagaaagactaatgtatcctaattcaacataataaataaggaagattcatttaatttcaaaagacaaaggatagttcactaagttcagttttgtataaacaattgtaggatattttaatttaatttcaaagccattttgtagcctagcggtagagttaggctctgttcaaactttggtttacagtattatctagaatgggctaacttttctattctcttggatactttatcaaatttttttaaatgtttaatatagtgagctctgtttagaaaacattttatctatattccttgcacaagctgacatctgtatttttgtgaaaaaaatcttgagagggaattaaatctgtccataatctactcacagcatgcctttatagccagagtacgtctgaaaattttaagtatggcattctaggagtacagctcagagcaggcgtgttccaactttactatatatcagaatcaggtagggtgcttcctacaaatgctggctctcagactgcaatcctggagattctgattccgttggtttagccatttctaagaggcctccggcgcttctgtggtggacggcccatgacactaagaattcttcctcagatacctgctatatctatcctctccctgccaaacaaagccttcttgaaaaccaagtattggctgggtgccgtggttcacgcttgtaatcccagcactttgggaggaaaaggatggcagattgtgtgagctcaggggttcaagaccatcgtaggcaacatgttgaaaccctgtctctacccaaaaaaatacagaaaattagccaagcatggtggtgtgcctgttcctgttgctcaggaggctgaggtgggaggattacctgagcccaggaagttgaggctgcagtgagccatgattgcaccactgccctccagctgggtgacagagcaagaccctgtctcaaaaaataaaaaataaaaattaaaaaaacggagtacagagactatataccacagtatagaggccattcccctgtctctttttcctaggatgtagtaagaaggtccactcctgtgagcagtcccagggtcccgggtaagatttcttggttatactcccaataagggtggcactttggccagaggagttttaccagggacagagtggccaatatggtgaaaccccgtctctactaaaaatacaaaattagtcgggcatggtggtgggcacctgtagtcccagctactcagaaggctgaggcaggagaatcgcttgaacccgggaggtggaggttgcagtgagccaagatcgcgccattgtactccagcctgcaagactccgtctcaaaaaaaataaaaaaaaacaccgaacaaaaaacggagtacctttgtagtatttcctgggtcttaacaagctatatataatgtttcaattttttctaaaattcataggagacacatacatccttgggtttctgacatataggtacactgatgaacaaaattttttaattcctaattagccagtaggaattccacagatctgctctgaaatacaatcatatttatttctataaggcagaatcttctttttctttgaagtcaatctccttttgtgaaactttcctcaaacctaacctccctctatcaccccatcagcaaaaactaatgtttccactctttgctaccattgcatttttacatgttcctgttacacaatttatggtgcattctgcctagctgtgtactcatctatccccggaccagtccctgggagtcttgagtggagaagagggatagtgttatttatctttgaaaccacagtatcttatacattatacacactcaacaaaagtttttgttgactgactcatgtctttgggtttatgttctctcttttcgccacactcctttcacaagacctgatcataagacctgtggcatcctataccagcagaacgtttacagtatctaccataataatgataataataataataattgcttacatcagttgacccaattattttatatttggtgctgttctaagcactttatatggattactttcatttaatcctcttggtagtcccatttgcagatgaggaaactgaggcatagagaggttagataatttgctccaggcacatgagcactcagtagcagggcaaggcccctgacccagtctgactctagagccggtgcttgcaattaccataatgcctgggtttacctgactgcctgtcttgtactcccctatttgcatctgataattgtgaattcattccagaggaataccaagaaccctagttaatttgttagccaattattttcactgactttattctacaaatttgttatggtatcctttgtgaaattaatttgcaaaacttgggtaagcaaagttaaaatggttctttattgcactaatcctcaaagcctttagtattattaaagcattttgtgcatctccaaaggggacctttgtgtacactgtttcccaaacttatttaactagagataattttcccccataagactcttttagcttattgaagaattaaggttttgtttttttaatgtagtttgtaagagaagctagctaatgcccttgggcggttgccaagaaatttctcaggtcttgaatatttaggtaaatccttatttttgacactttcttatttagtcataaatagggtgaccacttacattctgggtcagtcacagatctgttgtcatggtgtaattactaacagcactgtttccaaaagtattccctttggatgataaattatctgatcactctaatcataatacttgccccccaaccattaaataaagacctactttacatacttgctaccttctcatcacttactgaaggatccttactgataatgtgtgtgtgggaacaaaggtcatagcccgtatttctccagcattttaccattttatgtcctagttttatgtggaattatggacacatatacagtttatattctttcatcactcaaaagttgcatttcttaagaattgcaagcctccaagacttctttgcactgctcagtatctattcatgtatttgcttagttatgcagggagaaaaaaaacaaatctaagttgtctcttggaagcaagggcaagggttgagggtcagaactgcagtgggtggcaaagatgagaaagagcttttccattctgtatattctgacttttgaacaatgtaagtatattgtcgttttaggttatattttaaaatgcttataaactgctcaagttcttccctggaagctatttcaagcccagctgggttgatcttccttatggtctgtttcttccctgcagggagacctggtccctttcttttctttcatcttacttcacttagctagacattattagatcttcctatactaaaagaagaggaagcttcttttcttaagctcatgtattatagtgtaacagcttggagttggacatatctgagttcaagttaatctctgccacttactgtaagaccttgagatagtaacttaatttctctgggcctcagtcacctcatttctaaaatgagtataataataacctccttcctagggttgccgtaaagcttcagtaagataacgtggcccggcacggtggctcacgcctgtaatcctagcactttgggagaccgaggcgggtggatcacctgaggtcaggagttcgagaccagcctggccaacatggcaaaaccccttctctactaaaaatacaacaattagctgggcgtggtggcatgtgcctataatcagctacttgggagactgaggcaggacagttgcttgaagccggggggtggaggttgcattgagccgagattgtgccatttcactccagcctgggcaaaagagcgacactccatcttaaaaaaacataaaaaataaataagtaagataacacaagttctaggcggttccagggataatgtagtacaaattcaaaaaatgggggctgctgttattattgttatcactgtaatcattattgcctagggcaaccaatgagtcttgtggatataaacctctggctctgactttgggtaaccacaaaattcatttcccataacctctatcctaatattttgagactgacagtctttgaggtccaaccatactgctttatactaacatcaccaaactttcttccattactggtatcagaaacctagaagcagcagggatattttgtcagagtttatgccataaagaaggtatcatatgattcctggggcaaattgatagaaaaagagcagagatggggtctgatatgaagttagaggagttgaaactcaggaaatgacattttcaaaatcgtcataaaactaagccacaggaataaaagatacacggttgaactcaaaatcatgatgaagagattccagaattaaagcctgagatcacagagggaaaggcttcatcctgttttcttcaaggcatcatttttcttgtccacgaatttggcaaataagggatgtaaggagaaatggcctagtacactgctggatcttttcagatttataagtcattaaatctcatttaagccacaccaacttgaaatgacctccagtgtagaagatgagaaaactgtgtttcaaataaattgcacccaagtttacaacctgggactcttgactttgagccttttgtttccatccatgctgttcttaattggcttcacgccctgctgttggatctctggttctctgggaggcttcagaaactgcatgagaacgctgtgacttctaaagtgaccttgtcagcccctgtggcttttaactgtggctttatttttggcccattacctttgcatcttgctgctgttgcatagcttttcatggatgttgactaggcttctcctcttgtcttgtagtaggctctcattctgttcgtgataggccagttttctctaggcagaatacccctattttaactagcagagtcctcgtagtactaaatctattgctaacaagaaagtaagcaccttaaaaaaagagaaattcccttctaaagaaagtttttaatatgttatatattttaaatatcattatgaaagagaagatgtaactccttattagctgaactatgtgaggtctccgttttcacccagccatctggcattttgcatttctcagttcatgatactaccagaaggaattaattttggccaaatgtgattctgtactaaagagcatcagaatgtatttgaagtttaatttgttgtgttctttaacctatgaagaaggctgttctgtgatagggattgtgtgaaacacatctatgtggtccatgtccatttatctctggaacaactccaaaaagtggggatcattgtactcatcttacagatgaggaagccgagtaccagtaatatccctgagcagtgtggcagttcatggaaccattagctacagagtatttggacttttataagtatactatagttttccaggaccctggggaaataagttgccacagaaaaagaacactagtgcattaaaggttcatactgcagtctttttaaaaaaaatgttttcggtggaaaacattctaatatgtgttacaaggtatgttttttaagaggataaattcatgactctcatataaatacaaattgcacatattgaagattttacttaactcatttattaatgagggaaccagtaagctcttatatttggttcaaggaggatcttaagagcagtcaaacaagaaaatcaggaatcaattgcatgcagctccactgaacacattttatttgtgtctgtatgtagaagagccatttgcaatattatcagttttctacaatttacagagtataaaatagctaagcgaaggacaataaagggaatctggaagagtgccttagacaattcctaatactcccgtcaaaagaacccagtgttttgttttgttttgttttgttttgcgggggaggagtatttcaaagtcaccattttctctgacatgtcttctttactatgttgccttttaaggttagcatgtatttttctggagtataagaaacagagtgaatgacttagcttgccactgtaatggtgcctgtcactggttcttaaccacttggggggatgtgcatataccccaaaatgtgcattccgtatcaggttaaggacttcagatgtattgattctcccaagactatgttctgtgtgacagcctccatctgtgtggcataaggccaattttgggattaaggtgcctggcacttgtcttctctctctagttgataagattgcctccagcttgctgccatggtcgttgcttctgacccttccagggcagccccctttagagttcatatctgtgctgcttctactgggtctccctccctccctccctccctctctttccttccttccttccttctccctctctctttccctctgttgtttcttctctatgctgttgaatttctgactttgggattttgagtatgaaagctggtgacactgacacatcactagctactccgagcgttcattgcttttctctggagcactgccaaatctccatgtagggaggtcaactcttcgcctgctgacttcttatgacaggttcgttgtttgttctggccactttcttatcaccaaagctgactttttactaagtcccattagatttagaattatttagatacaagagagctaaggttttatatatttatttaaagaacttttattaacagacaacagccagacatgctttccaaattattatcttttctatccttcctaatattggaaacctggatcgagttttaactaggcaagaatttgcaatgtatgtacatctgttgtcatcactgttaaagagtcccaagtataatagatttgaggggaaaaaattatgtatttactggtaagactgtaaagaaaatgatttgagtactttattagaaaattctcagtgggagtagttatgttatggggcatttttgttaattttcataaaactaagtattaataacaaaggacttttttttccttctgagcatattttttcttgaatatttgggtcagtatattttaaccatatttatctctaactttataattttgatgctaaagccagaattccctaaatatcactttgccttacagcaaatgttgctgaaatggccaagggaggagatacagagacagagagggagggaggtaagataagtaatgtaaaataacatttacaccctatttctagaaaataatcttaaacagttttaatgtggtggtaatgctttgtatttttttttaaatacagcattattcttcattaatgaacaatttacatgtctgtttccaaacacaagtgaattgatcttaagaggcaaaaaactgaatgaatattttcagcactttctccttggggaacatctcctgtttacatcttagttgcttcccaggacatgccttaggtatccctctggcacatgtctaaacatagatccagccagaagtagaggtgggcctgtgtttaatctcctgctacagttcaagtcagaactacaccttgcttttactctaaatatttgcattattgtccttggatgttttcccattatgcacaacaaatctctcctctttaaaagaactggttgatgacagtaagagaaatcatactctggagcgcacttagagggaagaaaaaccacatgtttagtgaggtaaaacaaatacctgtttttctaccttttaatacaacaaacaaaaacacccactaatgtatttacaactctcgttttacaggccaacatgttttcatagaaaagtatttgagtatattgtggatgagataggggaaattgattgctgcttctggaccagccactctctaggcctgcaagttgacacagtgaacatgatacacagaatctttgctctcagagtttaaatcctagtagggagaggcagacaataaaaatgtaggcaaatgaagaggatttaaggaacaaggaggtgtgatagttagcaaagaacttacatgaagcatctttttttttcttttcttttcttttcttttctgagacagggccttgctgtgtcgcccaggctggagtacagtggcatgattatagctcactgcagctctgtagccttgaactcctgggctcgggcagtcctcccacctcagccccctgagcaaataggactacatgcccagctatttttttttttttttgagttttttttgtagagacagggtcttgctatgttgcccaggctggtctcaaagtcctgggctcaagtgatcctcccaccttatcctcctaaagtgctgggattacaggtgtgagccactgcgcccggccccatttgcaaatttcatttcttgaaactctggctgatatgtgaaaagagatagaaaggggtttggactaggctgctgtccgtggagatggagggaaatggatagaattcagagaaatgcaggaggaaggtggaatggaaagaacttaataatggactgggtgagggagagaatggtatggtggatgatccccaggtctctgatttgattgagcaaaaggttggaagggatgctattaattgagatcataaagagtgaaagaggagcacttagtagggaggcaggagagaatcaaagatcagttttgcatatggtaaatttgagatgcctgcaaaatagtcaaggaaagaaaaatcttgaatgcacttacaaaatgagtccagaaaagaggtcagggctgagttatggctatgggagtcattggcacatgggtggtatctgaagctgtggcagtggatgagatcacacgggtgaggatagactgaaggagaaaaacttgatccaggactagctctgagatacaccagacttttaagggatctggtagagcatgtggaactgacaaatgagcctgcacaggaatggctaacagcagttaatttgcaagaaaaagaaacaaacttcatgagcacagaccacacatccctggccagcgactctcagccacaagccccagttggctccaaaaaaactttctctaatgctggaaaataaatctactcatgcatgtcttcttggtggagggggagaaagagcttcagatggtggaggggaacaaggagcttcaacctcatttaaaaagacgacttcactggaataacccaaagaataaaaggaaagtgtgacacagctgctgtgtttctggagcggggtttgaagttcctctaggataaatatgaaagcctcagagatcaacttctctatcttgattcatacttgattaccagtaaatggggaatgatcttgcttagttggcagtagatttgcctgttacacactctcttgcaggaagttgaagtgctgtatcatagagtttttgttttccatgtttgaagttaaatgggatattgagatttaatcagaaaagtagctgagaagaggtgtaaacatgaaagtccagtcttggataaaggagaaatcttatgaatacctctccctctggtttcaatatttcacaacataaagtatgtccaactgatagacttgtagtaaatcccaggtaagatatttgtagactgtgccatgttctaaaacattaaaaaaaaacacaataacatttcaactttatatgtaatatattactgaaatcctggttatctgctgagtagctgaaaatggttgggtatccctatataaatcaagtttattgattttttttgaggtctatatcaggagttctaagatgaaatatggtccctggttttaatgtgatactgttagctacatggatgccatttcttttgacataaattctttagtgtgaattaatctttatactcttttgcaaatcattgaagaataggaatagaaacagatttctgcttaaatgataaaaacataaaacattaaatgatggaaacttctccataaagttggctgtttctcacacattttcactttccttctctttttcaaaatatattttagttcttctgcagtttcagttcatgtttcagaagtttaaatttcgacatttgtgaggggaccctttcttattcaatcaagacattctttgagtggatgtatggcactgtatatttataaatgatgttcaggtcataaggaaccattttgcagctgcctctactatataccacgaactactttggtccaaatttcaaatctaatttggttcttcttttcctcaattttatttaattttaattttttctgagacagggtctcactttgttgcccaggctggagtgcagtagtgcaatcactgctcactgcagcctcaacttcccaggctcagattattctcccacctccaactccctagtaactgggactacaggtgcatgccaccacacctggctaatttttttttttttttttgtagttttttgttgcaatggggttttgctatgttgcccaggctggtgtcaaactcctgggctcaagtgatcctctccctacctgggcctgccaatgtgctgggatttcaagtgtgagccaccacaccccgcctttccccaattttaaatccaacatggcagttctggattaagggagtcactcttcctatatgtcttcccagtctggattttgaagcagctgcctttttgcttcctaatgatgctagcctatccaaactagaaataatcttatataatcattgatgccttgactcatttgtatgtatctgtatttttaaactttttatctttcattaccaaatgactgctttctgatacccaggcctaggcttaaacactggcatatatggagagaacagttgccactcgactcagagattgagtagacacccaaagaactgcagttcttaagccttaggagaagcgagagaaatgggccaggtgcggtggctcatgcctgtaatcccagcactttgggaggctgagatgggcagatcacctgaggccaggagttcgagaccagcctggccaacatggtgaaaccccgtctctactgaaaatacacaattagccgggcatggtggagggtgcctataatcccagctactctggagactgagttgtgagaatcacttgaacccgggaggtggaggttgcagtgagccaagatcacgccattgcactccagcctgggcaaaaagagtgaaactccgtctcaaaaaaaaaaaaaaaaaaagattgctacatgcatggagtggggaaaattgtggtagaagaaaagtaaacttggtttggagaataaacatttattgagcattttcacttgaccagctctaaggtgggaagattacatatagtgtctgtttaatatttaatatgtatagccattattatgtatattgtaaacatctgtcagaagttataattccaaaagtaaactctaagcaacagctttttcaaagtatatttttcatgtagcacatttcattagctcatgaaaaggttatttccccaaaatgtgtaaaaatgtaaagtgaacaatggccattcatcagaaatagcaagtgacaatgagctctccaaggagcacttcttttcaacactcgacttctggaggctgaaattcaaggtacttaggacagccaaattggtaggcactggccaatgtcttgggaaatttgactttttgcaaccggattataaaacaaggctttccttttgatttgcttaatctgccattttactcaatattatggctttgccatttgttcttcttccatttaaatgaatttcttttaaatcgcttgtggttgctgttgcccagatgacaggtatagagttgattttgtatttttttttttgttttgagacagagtctcgctgtgtcacccaggctggagtgcagtggagcaatctcagctcactgcagcctccgcctcctgggttcaagcgattcttctgcctcagcctcctgagtagctgggattataggtgcccaccaccacgcccatgtaggccgggctggtctcaaactcctgatctcaagtggtctgcccacctcagtctcccaaagtgttgggattacaggtgtgagccactccacccagccaaaaattcttttctgaacagagactaatgtcggtagatgtaagacaaaccacaaatggtgggaaaatgaggaaaaaaagtgctcccaaatacctgtttttagttcgcttcacttgctgatatttactaattgttaattcttttcctctctttttttttttttagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtcactgtgtctatgatttttttttttttttttttgagtctcgctctgttgtttaggctagaatgcagtggcatgattttggctcactgcaacctctgcctcccaggttcaagtgattctcctgcctctgcctcccaagtagctgggattacaggcatgcaccaccacacccagctaatttttgtatttttagtcgagatggggtttcaccatgttgcccaggctggtcttgaactcctgacttcaaatgatctgcctgcctcggcctccgaaagtgttgggattacaggtgtgagccactgtgcctatgatttagtgtactctcttgccttaaatttgcctgcctcccagaatattgacattaaaataatagtttaccaggaaaggttccacaactaaaaattccagaagttgagatctgctctaacccatttcagcctagagagggtggtcagtttctctgacaccctcatttgcttggctaagacaagcagcaaaggtgtagagtttcttcctgtttgatattaaatcctgacactaagatttgaactgaaagtatcattctcacttcctagagccagtaggtgatcagtatatgctgtaacaataacacagtgactacagaaatgacccttctagcttcataacttgctaagtggcttataaatggaattcagcagccttccttgaccagctgttttcctcacatgtgaaggctgagaatgtgatggggggtgtgagctactgactggatgtgttctgttctccagatctcaaacagcagaggtatgggaaacgaaagccctgggcagtccatggatgcttcttgctcatctgtagctatagacaggaccaaccagagagagaaaacgtacggagggagaaatctggatctctctggacacactggatcatagggttgtgccagcaggctagcaatcaaatgtgcatgggattgggggagcaatgcttcatctcccacagagggaaggcagtgaggagtagaccgaaggagggaatcctgtttgctaccatttctcagcattttctggaggggacccatctccttaccagtgctgtgcctgaaaagcatgtcttggatcaggtccaaagtcgtgattagcaagttcatttctaatacaataggactccccttgagcatttagggtggcaaggagcgtgggagctgggaagaatccccacgtgcttagggtagataaatctgagccgagttaatactaatttggggatcctatgaacctttttataaaatagtatctgttcacgttttgaaaaaaattgtgttgtaattgattttattttgtgctggtggcttctctgcaaaaattatgagtggatatgataagtggatgataatactaatggacaactaacgcagagtagtttgtattatgtgtcgggcacattaactcatttaattctgccacaatcttcaccatcttatagataaggaaactaggggaatagaagttaaggaatttcctgaggtcacatgtgctcgaggtgtcccagccggaatatgtataaaatcttattttcacttaaagatgatatggctaaaggcagtgctaggaacatctttggctcagagaagcgtgggcagtatgctgctgaaatggttcctcatatagtgacattttaggcagtacctaagtcagcacaggtctggcctgttctctaaagatctgtgtagatgttgtacaaagacatttttcaaagttttcaacatgactcctactttgggggcatcttgtggctcagttttctgtctcgtggaacttcacttctaggtgctcacaatgacttttaacgttgacttctgaggtgcagtgagctgctcccccacagctgtccctagcagtggtgggttcagagcatgacaaggcactcaatgtgcattcaccaagagaagcaaggaagcagcagttcagtactgtgctccctagagtaggcacggcatcagtttcaaacttcaacattattttccagatttggaggctcaaaatatttgagcaagttaagttaagaaatagcctttttctgattattaggcctttcatatacaactcaaaattagtttaagagtaaagcatggggtgggtgcggtggcttatgcttgtaagcccagaactttgggaggcggaggtgggaggatcacttgaggtgaggagttcgagaccagcctggccaacgtggtgaaaccccactgctactaaaaatacacaagattagccagatgtggtggcaggcacctgtaatcccagctacttgggaggctaaggcaggagaatcgctggaacctgggaggcagaggttgcagtgagctgagattgtaccactgcactgcagcctgggcaacaagaacgaaaccccgtctcaaaaaaaaaaaaaaaaaaaaaaagcatgagttaagaactttgatcgtacagaaatattgcgttttaaactcttatataatagtatgccattcacaattatctggaaagttctttttctcccaccatgtgaatacacacacacacacacacacacacacaatttttaagcccccaaaggcttaaaatagtactttttgtggtctgtaccggtcagttggatttttactaagaattttaatttatccttgagatacttgatgagtgtatataagcagttgcaatttagcatacaaaacctgacaaatggtaaataaaagaatatgtttatccaaatgatgaaatatttgtagtaaaaagtgctattcaattgccaggaaattaaaatactccagtaaaatgaattaaattagcatgttaataagagtgataatatttaaaagttttagtcaatcttgcatttccatacttgcattatctaaactagttgaacttttcagtgttttacttgatatattgcattcttgagcattaggcttctaggtgatttgttaaactcatagcaggttttagtacacagtgctgtttatgacagaaaaaattttatcctacctctgaaataattgtactttctgtgattcagataaaaactttatagaaactccctaatgaaaatattgaagcattaaccagaaaatgagtcagctttttgtttccaaaatgatgcaacaggaaaacctttaactacttataatcccgtatagtcaccatcaccacgaagtattgaaaatctgttttctcttttactaagtgtctgcacggtcacttatgtatacccaaagccagaaagatatttttatctcagggaaattccagaaatggaaacatttttgtgtaatattgattcatttctgtctcaccaaagatgtgttttccacgtagcaaagaacatcagccccacgttatagggaacaagcgagtcccaaatcgtaccatctgctgagcactgagaaaggatatggacaagtcagtcagcattcacaattaagagaaaaacatctgtgctttggaaaatgttcttcaaggatagagaattgtgccctatgtccaccaaatttgcatgagatctttataagattagacagccagtggataaggccccttatctttcttcatggatggctgaggaaattctccgccttccctgacatcagctgcataactgtatttctgcctcgtggaaataaagtagatgatcaggcacttgcggtttgttcttaatacaagaaagacaatttgatttttaaaagttttgatttgtagaataatgtaagacaatatgtttctttctactttggtttttccattcaaaagcttacagatgaattcattcgtttaaaactgccaggctgagtgcggtggctcatgcctgtaatcccaacacttcgggagactgaggtgggcggatcacctgaggtccagagttcaagaccagcctgaccaacatggtgaaaccccatctctactaaaaatacaaaattagccgggtgcagtgccacatgcctgtaatcccagctacttgggaggctgaggcaggagaaccacttgaacccaggaggcagaggttgcagtgagccaagattacaccactgcactccagcctgggcaacaagagtgagactttgtctcaaaaaaaaaaaaagaaactctgtctcgaagtaaataaataaatttttaaaaaccaacctgatgtgaagttgaaacacaagacgcggaaataaaaactcagagtataaatatctatattgttaccattatctgggataattgatgatttataagaagctgaggtttcgtcttcctagaaatggacttttattaggccagcaagaatgaccacttagccatttaaatgatttgtcagcatcttttgctgctctcttctaagaccattggttttcactaaaggataaatacctgctaagcaaattataaaatactataagacatttaatctcctggaagaggacttgctgataattggatcaaagttccagcattattgctcttttcgaatcatatggacttagtgttctcatgaccgaggagtcacatttttagcttgctaaaatattcactggagaacatggtgaaatccacgagtggaaacgttccatggtattttcaaacgccacgtgtcaggaatttggcatgccttcctctgggagaggcactggagtgtggccagatggaacccagcagggtacagagggcatttgtgggagcagttaggaaaccaggacgtccagcttctgcctgccagggagctcgctcatgttgtctctgaaatttgcataagagcaattacctcatattctaattttaaagatacaatttttaaagacatggaaggctctgaggcctcctgaaggctattcctatgtgaggtattgtttacgggtggcctttcactatttccaaatcagcgatgaaaagaagactgagtctaaaataaatgaagcaacagacttcagcagcctgagagaattttgttcaattccagtctccttaaaaaaaaatcggtttttgctttcaatttaggaaaattgttttgggttgcattgttgaaagtaatgatttctagcagctacttatgtataatctcttaaccaattaaattctgaatctcttaaatcacttgattattcatgctggttttagttatccactgctgtattataagccaccccaaaatttagtggtttaaaacaacaaccattttgttcccgctcacaattctgtgcgttgaatgtgctcacctgggcagttctctgatttggggtctatcatgtggttgtggtcagatcatggctgggactggagtcttacaaagatttggctgggacacctggatgactgggcctctcctctccccatggtctctacttactacttactaagagcaccccaaattgcaagagcagaagtttccaggcattcttaaggctgatgcccagaacaggcacaatatcatttctgcctcattctactggtcaaatcaaatcacaggctgtattggggtcaccaagacaccctcaggtttgatgattctctagaaggactcagaaatctcagaaaagctattgtactcatagttatggtttattatagcaaaaggatacagatgaaaatcagcaaaggaagaaggcacatagggcagaggccaggagagacgaaggtgcaagcttccagctgtcctcgaccagtagaattttatagacagcacaaaattttcctagcaatgatgtgtgacaacatgtacaaaatattgccaaccagggaagctcaccccagccttgggagtccagggttgttaatgaggcatggagcactcacatgactaaccttagttactcaggctccagcccctccagaagtcaaactgaaacagggaggcccagagctccaggtgaatatcataaatcacattgttagcataaacaatgtgtcatggctcaagccctaggcatacaaaggcactcttatcaagcactatattccaagggcttggagactgtctcccaagatctagtcaagggccagtcctttctttggaatttgcagggttcgaacttcccaatcttgctgagttaatcctttactgcacacaggctcaacctgggtttagtacaggaggaactacacaagggcatgaattctgggatgcatggctctttgaggccatcttcgaagactagatgccatatgattgtttcccaccctcttggctccagcaaaaacagaattcttggggagtctggagttcttcacataatagtttgtttttaattggaaacaaatatataaaataagggtggactaacctgaatgtagttaataactacattcctgtccatgtgaacatgtgagtcctgacaagttaatctacgtaattcaagaaatgatgattaaacagctactatgtgcctaacgccaggctgtaccctggaactatgcagtaacacctagttctttactgactggtggggacacttacaatgcacaggtaacttaataccgaacggggcttcccacgatgcagatgaacctaagaaaggcttttttagcccagcataggctttctgatgtaacaattttcaaacagtgttttgagctttaaactgatattttaaaagcaataagctcaaagtagcggccgatttctttttcaaaatcagtggcaagtatgtgtgctgggggcgggtgggggaggtggtatatgtgagacagtataagtagaagataaaatgggccatttttcctttattttcctttataaatgcatgttccatgcatttcctttagttcctgggcccagtggctcacacctgtaatcccagcactttgggaagtgggcaggtcacttgagcccaggagtttaagaccagcctggacaacatggcaaaaccctgtctctactaaaaatacaaaaattagcggggcatggtgacatgcacctgtagtcccagctactctggaggcggaagtgggaggatagtttggatggcttgagcctgggaggcggaggttgctgttagccaagatcttgccactgtactccaggctgggccacagagcgcaacacctgtctgggaaaaaaaaaaaaaaaaaaaagcttacaagttatttttttttttcaaaataataatggttataaaaagcccctggcaaaatgtagattataaattctactgaatggaagaatgtaaaataatattttaaacactttttttggttcattttgttaaaaaacagagttttgctctgttgcccaggctagagtgcagtggtgtgatcatagctcactgcagcctcggcctcccgggctcaaacgatcctcctgcctcagcctcctaggacgttaggcacttgccaccacacccaattaatttttaatcaacatttaagtaacatcttatttaacattctgattcttgggactatctgagtaatagcaacatgggagatgcttttaacattttaaaatcgtttatctagaaattagattgcagcctgatttatgaagctgcataaactctgacttcatatccttgtgcccagtgaagcatatgtgtgtcccttgacccctcaggccaggacacagaagtacatggttgaagaggttcagtttgtgactagccatgccataggcccagatctcagtgggtactgctcaccatttggttctgtctgttggcttgtccctatgactaccctgagctccctgagtcttgaagaagaaacattaacaaaacaatccatcctcttgctggcaaatgactggcaatcaagctcaggaacacagccctgaggacaaagcgcagtgtggggttgaggctgtggctttccctggggctccagacaagacaaggatctttttcttttcactcccttacattcagagagttggagtgcaaggtccttttttgaatgaattacaagactttctaacacttgctaattcatgaaagaattttacaaaaatatgggcttttgtagttccagttttagttttaaaaattgtaatctcttgactaaactgtgtaatttcaaccaagaacaataatataaacatggctgattgcttaaaaacctaccctatgttcagaatcaatttggcttttattagcaggtcgagaaagatgtctactctactctattctgccttcaagtagcctttgccacactcccctcccccagactctaaaagaaacaaacccaccaaccggacgttggctccccactcctttcagcttaaggaaagggaaagctactgtcttggtaagagactctgacttcctggttactgttagcaagaattgagttcggaattcaagacaaactaagcttttcagtctttttccaatggtaatttcaatacatctgttttccctaatagctcatctttaattcctctgtttagttctcataaatcttccattcgtatataaagtttcctattttagaaaaagagcctgaagttctatgttgatgtggttctcgtcacataaatcatcgcaagcccaaggagcaagagatcaaccagagtgtctaagaagcatggtttggttgctcctttcccttatcttttgtgagtattttctgtaaatgtacttccaagtaggacttgtgttttccactgaccgtgcttcacactaaactacaggagttggggagttccagccctgcccgaggggagcggcattcataaacgtgtgtggctaattcaaattggacagggtcaaagattcttctttttcctttaaacttaaaaaagttattatagactcataagaagttgtaaaaatagtacgaagagtcctgtgtcccttcatccgctttgtcaaatggtgacctgtaatgtagtacaatatcaaaaccaggaattgacactggtatgttggtgctagactacagacttccttagttttcactgttgtataaatggaaccatacagttgtaatcttttcagattggcttttttttactaagcataatacccttgagacatagccaggttgttgcatgtatcagtaattgattcctttttattgctgagcagtatcctattgcatggatgcactagagtttattcaaccactcacccattgaaggatatctgggttgtttccagtatttttctagcatgaataaaactgctatgaatattcatccataggtttttgtgtgaacataatttttcatttctctggaataaatagccaagggtgtgattgctgaattgtatggtaaagactgcaaaaactattttccagagtggctgtgccattttacattcacactagaaatgtatgagagactctgtttctctacatccttgccattatttgacattaccattattgtttactttagctgttctaataagtgggtagtgatattgcattgtgattttaattatgatattgaatgtcttttcaggtgcttatttttttgcgtgctgttttgttttaaattccatgcatttcctttagttcattctttcatttatttccctcctcttcctccttgccccctctttctcttcttcccttttcttctttctcttcctcatcttcttcttcctcttcctctcagtaaacttactgaagttcaatatacagaaaatcataagcgtacagttcgagaaatttctcacagagtaaacataactattaactagcaaccacattaaaaagcagaacatttctatcacccagaagtcccccacccaaggtaactactattttgacttctagagatttgttctgcctatttttgaacttcatgtaaatggaatcattcagtatatatatactcttttgtgtctggtttcttttacttataagattcatcaaatatttttaaataacctctaagactgactgactaccaattttaggcagcaaacaccatgaggatgctctcccaggtatgttgtaaagtcaaatataagagtgtaataccactctcagctccttgctcacttgagcctaatgccagcaatcaagccaacaatagttctaaggcctgataaacaccaaacgcc

SEQ ID NO: 497 - DNA, 2034 bp, Homo sapiens
cgccgcccagctgacacgcgattcgtcactcttgcagaactttccccctgaaaatccctgcaccagaacccgctctcccgccccggggaggttttgattttagtggctttcttccttttattttacgtcgtgtgcggatttcgctgcagagcgaacttgcggctcgtccgagtacatgtgagcggtaatcgcccctgcagctggttatcctgacattatgcactccgaagcagaagaatccaaggaagtggccacagatgtctttaattccaaaaacctggccgttcaggcacaaaagaagatcttgggtaaaatggtgtccaaatccatcgccaccaccttaatagacgacacaagtagtgaggtgctggatgagctctacagagtgaccagggagtacacccaaaacaagaaggaggcagagaagatcatcaagaacctcatcaagacagtcatcaagctggccattctttataggaataatcagtttaatcaagatgagctagcattgatggagaaatttaagaagaaagttcatcagcttgctatgaccgtggtcagtttccatcaggtggattatacctttgaccggaatgtgttatccaggctgttaaatgaatgcagagagatgctgcaccaaatcattcagcgccacctcactgccaagtcacatggacgggttaataatgtgtttgatcatttttcagattgtgaatttttggctgccttgtataatccttttgggaattttaaaccccacttacaaaaactatgtgatggtatcaacaaaatgttggatgaagagaacatatgagcacatgagttaagattgtgactgatcatgatttatttgaagatggagcactgctgatttatgaaggaaaaaagaagaattttctaaagattacacatatttcagaaagactttacccaattcagttgtcagacataatgatttatttgaaggcttgttttatttgaagaaaagcatattgccaaaaattctggttaaaagcttcctaacgggtaacagaccatgggagagatatgtggttgggtaatgcaaatgtagttatacaaagaaaaatacagatgtctccagacctgaggactttttaatagggcagttgttgtgttggtggcacattggatatttctaacatgtacaaagctatgtattttgatttactttcatttcttgctatgtatatgtacttttcttaaaatgccaagaactttctcttgctatcattgctccttttgaaacaattcaattttcatgtctacagctgactgttttgttaagattgagtcatcgacattcaggatttaagtctgaggtagtcaaccctcaggaaaaaaaaaatggcttatctgaaatcagtactgtggaaatgaactatattagctattatgaataatgtccagtataagaatatgcttctggaattgagttctccttttaagtaccaatgatacttaaatttctcagaaatgtaatggtgtgtcattgccttgaaatgcttgcttagggcttcttttatgttatcttaaaaagtgctggtgaattttccattttttacatccatttcacatgtaagagacaaaaaagtctagattggtcttgatattgagataataaaaagtaagtagcattaagaaaggtaacaatcttcattctacagatgaactcattgaaacaatttaggggaatgaggggcaaaaggggagaaatactgctaaagaacatgagcataaaaatgcgtgcgtttcagtgtttaagaaggcttgataaagaatgtcacttttttatttaactgataagatttttgttattttttactttgataagtaaaccaaagaatatttgtatttcaagcagtttgtgtggtgtttctatataattttctgtgtataaataataaagtaggcatttgtttattttgtaaaaaagaaatgaaaatctgctggccagctatgtcctctaggaaatgacagacccaaccaccagcaataaacatttccattgtcact

SEQ ID NO: 498 - protein, 198 aa, Homo sapiens
MHSEAEESKEVATDVFNSKNLAVQAQKKILGKMVSKSIATTLIDDTSSEVLDELYRVTREYTQNKKEAEKIIKNLIKTVIKLAILYRNNQFNQDELALMEKFKKKVHQLAMTVVSFHQVDYTFDRNVLSRLLNECREMLHQIIQRHLTAKSHGRVNNVFDHFSDCEFLAALYNPFGNFKPHLQKLCDGINKMLDEENI

SEQ ID NO: 499 - DNA, 74520 bp, Mus musculus
  misc_feature (1)...(74520): n = A,T,C or G
ataaatgagagatcatagctaaagcacttttttttaattgaagtagataaaattaaacaaaaactagcattaaatgctctgagtcattctgtaattcagacagcttgttatgtgggcggtttactattaaagaaaaagctttatataaatgcaaattaagagtttaattgaggaaaaatatgattcttaggttggtatccctcagaaccagaaaaggtccagagaaccctcctctagccttaatgttggcagaaaagagaaatcagttgcttatacttggcttgactggctgcaggtcaggatttgccttattggaacaaggtcttattagttggtggcctgtgatcagctaaagctcacatgattctgaacctctcaaactcttgtagtccctagcaaaacagatgctcctgtgggtagactttccatttatttgtgtgtcaagttgttatctatatgtaactgtggtatgaagacaccgttgtaaagtcaagttgaatgtaattgaacatgatgttgtacttcagaatgccagtgcactctttagccacccactcctgtagactttcctttattcttctcattactggggcaaaacacgtggcaaacgtgtggtaaagagggaaggcttggtgggtttttgtttcactatttgagggggatacagttggtccatcaggcgggaaggcagcgttaggtggctggtgtcaaaagacagatgtaaatattgctgctcctcttccttctccatattatttagtctggacccatggagtggctctgtctacatctctaatgggtcttccttcctcagtgaaatgcctcaggaaacgcccttactgacatacccagagatatgtctcccaggtgatttctagggactgcactgtagctcagcagttgggtgcttgcttagcaagcgagagaccacagagtcaattagaaaaagccaacttagactgcacaaacttcaataaaatacattacattttgtcttttgtcttctttcgaaaagaggtctcatgtagccacagctgcccagcctcaagctttctatgtagccaaggcactcctgaatcccctgcctttaccttccaagtgctggaacacagtatgtcgctccatccctggcctagtgttgtccacttacgaaaagactggaattttgaacccattttcatcttcctattttaaaaggggagatgggtcttagaatatttttacattttgtttgatttttgtttttcgagatagggcttctctgtctggccctgactgtcctggaactcactctgtagaccagactggcctagaactcagagatccacttgcctctgccttccgagtgctgggattaaaggcacacgtgtctggtcccggatattttttaattgcaaaacaaagtaaatgtatattgcaaatatcttaggaaaaggagataagtggttactagtatttctcatcgaaatactagcttaagtttcttgatttatttagtttcgagactggttctctttctgtagcccatgctgttctattaacgttcgcacttaagcctatattaattttttttttttattaaactccacctgtacttcataaactggatagtcctgaaattcttttctgcacccaagctccaaattccggtttggcttgaactgaagtttctaatctaggcaagctccttaggaggctgagggtgtcagcgccggagctgtgtctctcctgacccttctcacctctgataatactattgcaacaaagttcatagttatattcatctatttgaaactttcttgaacactttgcactaagcctgtgccaaacatttgagacagagaggaatagaaccgcctaatgccttccctaagccaggaagccatttgagcagatttttgttaataataagacgaaagaagtgtcaaaacatggaaactggatctcaccactggtacctgacaattcattttgagattcttgggttcttttttaaaaacaaagtaggactggtgggtcattgttatcggcactattttaaaatctcggttgtttataataaaaaaaataaagcattactaatactgaagagcctaaacctttctaaattatcttacttaatgagttggaaatgcgcaaagataaccgcgacaaggctaaaagaggtttctagcatcacttttacagattccctcggggcgccggggggggggggggaagtggtgcatcttgggacttgtagtcatactaggagtaaggaacctgcacctcctcacagttgaactttctgtcctaactgttaggttgatcccttacccgaagcacagctcggttacttttagataactcctgggtcttacagtgtttacactaggctcaaagtgagcctgggctcctccacaagcctcaaagagattggcttttcttcaggaaggggcggagcagtaggtacgtttgcgcctcgggattggctcactcacgactagaaaaggcgttgctgccgtgtgtcccactggccattcgggagccgtgaaggacttctcgcgatactttggcgcaagggccggagccgcgtagcgagcgctggcagctgctgaaggcggcggggccgcggctgggctggggccgctctggtgaggagcagcgcggactgccgcgcttctcgggctgtgcggcccaccgacccggctcgggaggatcgtgtggacagctcggtccccgcgggccgcgccccggtgagcggacgcccgccggnnnnnnnnnnnnnnnnnnnncgagcagcgcttcacggtgagcgcgggagaggccgcacggcctccgctccaggcagcgcggtttggggcttaaaaagaaagaaagaaaatgtttgactgacttcttctggccaaagtagttcctccaaaatgttagaagaatcacgactttggggttcgggggatcagcgatgattttcccgctgcataggcctggaatgtggaattcatttacattcagtagttcggatttgctgctgctgctgcttttttttttcaggtcaaggttctaaggtcaagtctttgtagttaaaagagtgggtgtcttaaaatggttactgattattaagctagtttaaatgacaatagaatgaaagcggcgcctttctatttattttcccttaaaagttcaccgatgaaaaactttgccaagaaaatagtctccattcattcctcacgtcctttgagttacttaggcaacggccttgtagtccttgaaaagttttgttcgaggtaattcccgagggtttcacctttgcatcttcagcctgtctcctgtttgctaagggcaagttaagctttagccagtgtgacttgcttgtcttttctattctatttccagctgttggaaaaaagagagtctcacatttctgccttcgtgggtttactgacacttttccatcttagtttagcttttctaatagttttaagtcacaagtcagtagtggatgtcagacctctagtctgaacatatttatagtgctgatgtgtttagctacaacttttttattaaatgtaaaatttaattttgtacaactaaaacacaaacagcttaacatgccccagacttagaaatcttaatttctctctctctctctctgtgtgtgtgtgtgtgagagagagagagagagagagactcagacttttgttagaataagcagtactcagcatttaatgtgctttaggcatttaatgcttagactgtacttttagagttgtgctagcctgtgacttcccagtggagtggcacatgacactagcacttgtcaagattctaattcttgatgtttgcctagtctaaaattctcaggggaagtgaggggaggagatcccgtcttcgcatttgtcaccccatagctggatagtgctatctctccttaaggaaggaagcattgccaacgaggtttcactgaatgtctttccagtgagagattctaggataatgatgtattgtcattttctgccatcccctaagcttaatgagagctttctccaaggcaaataaatgctaagaacttttgaaaaaggcattctgaatgcacataaggcagtgtgggtacttcaaagcatgtataaattgacagcccgtcaatacaactacatgcattagtctataaaatataaaaccttggcaaattgctttcatgctagtttttaggagctaagggttaaatagcaaccatatactagcatgtaacttgttgcccacttctgtttttaaagtcagtttttccttaaagcaagctgtgatgaccttcctctaagctggttgtagattgcttctagataagcatgtaatcacataagttatacacacatttatctacacattagatacttaaacacatataatataactacattagtttggtatacagatcccaggtccctttaattctggcgacagtttaaagattatggtcctgctttttcctcctgcagccttctggagttccatttcagcaagtttcttgcgcttactttcctgaataaatgggtgcagctcatatttctttgtctttgcccattttctccttcatgtttatgaacagtctgttgttccttccttgagatttgtttttaaccttttttggaagaatgtcagtgatggcactgaggatcaaatcaggtctgtggcattcattctagtcaagcatttcgccaagctccaccctcccctggcttttgaatttttattttatttttatttttttagcaagagcaaaattaatgatacataatgtacaaaggattaaaatcttcatgttgcagctgtacctgaagtatggacttgagatttgcagcctccccttgaaggcttctttcatccgtggtggtgcttcatggtttctctgtagatgcgtccgtgtttgcagttcttccctttacacacttgcaagtagtgcaatacttatgttgaaggatttccaagatcaagactctggttcctgcttaaagttttgacagacttcaaattgaatttgaatgacaatttttatgttttaaaatgcgcaattactaatataggttagcatatcaaaacattcaaatttttttcccaattatgtcaagtgccatcacactagtttggatttgcccttagaaagcttctagtgggcaatgaccgtgtgactcctgctttcggaattcctttatttcattattaagctgtcttgctttgcttaagtatcctcagtggcttcattgtgagtgcctagacagttactgaggtaatagtgatacttagtacttgagtcataacctggtttggtttgaagcatggttctttatagttagattgctttgtggtttgtttgcctgcttttgtttttgtttactttttaaattttgcttttgtttttattctaaggatcaagccagtgggccttatgcatatgcttacatgctatggaagctttctattactgaactctgtccttaacactgctttcactttttcttttgaggcagggctttgccacactgcccaggactccagcacacagacacacatgcatgtacacacacatacacacacacacacacacacacacatacacacatacactatttgctgactagctgaggccataggtcattagttggtttttttgttttgttttgttttagcaagttctctattaacatctaattttttttttttttcccccgagacagggtttctctgtatagccctggctatcctggaactcactttgtagaccaggctggcctcgaactcagaaatccgcctgcctctgcctcctgagtgctgggattaaaggcgtgcgccaccacacccggccatctaaatttttaaaatcatcttttaatggagctctgtttggtgtttgttatgtgaaatgtcaactcttaattcaattaaggttataattcattgtatctaattcatttagtttgtattagaaagtactttataaatagtggttgatttgatgagtgggtacagaagcttattgcaatgcagttaataattgctttaataatttagatttgattctcaatacaatatttttactaaaagtccttgaaattttaacacagttcatttgttacacattttatcatcaacataaagtgaggaattaggagacactgggtgtcttagtcagggtttctattcttgcaaaaacttcatgaccaagaagcaagttggggaggaaagggtttatttgttcagcttacacttccacattgctcttcatcactaaaggaagtcaggactggaactcaagcaggtcaggaagcaggagctgatgcagaggccatggagggatgttacttactggcttgcttcccctggcttgttcagcttgctttcttatagaacccaagactaccagcccagagatggtactacccacaatgggccctctccccttgatcactaattgagaaaatgccccacagctggatctcatggaggcatttcctcaactaaagctcttttctctgtgataattccagcttgtgtcaagttgacacacaaaaccgaacagtacatttggccctttatcaactgacacacaaacacatcactattaaacctcaacccttactttcttattcatccccaagatctaaataactttaaaaagtaccacagtctttacatattaaaagtttaatctctttaaaatatccagtatcttttaaaattcaaagtcttttaactgtgggctccactaaaatactttcttccttcaaaagggaaaaatatcagggcacagtcacaatcaaaagtaaaattaaactccaactgtctaatgtctgggattcactcatgatcttctaggctccagctgcctgtactccactgctgctgttgttcttagtggtcatctcatggcactggcatctccaaaacactgctgtcttccactgtaaggaggcttcagcaatagcctctcataggctcttttcatggtgccaaagcctcagtttctttgcatgaccccttcagtcctgtgccatcagtggcaactgaggccacaccttcaccagtggccttctgaggcctctcacagtgctcagccttagctgctcttcatgaccccttcatgccttcaaaaccagtaccacctgggtgactcttacacattaccaagtccagccacagcacaaggtataaccttggctatgtctggagcacagcctctgtcctctcagaaaacacttcccagaagatgtcacctaaatgatgctggtctcttcttaatccccgataatttcttagctccagctaatcagcattagtaatcccagtaatgtaaagttttctctttagtagttctggtatcttgttaatcacagctgattcttcagtcctggctaactaaaaccacagattcttcacaatcaaaatagcaacagctctgataagagtctttaatcttccctttgaaatttcacaagccaggcactgttcttaacattatcttccaagctccaacacaacatcccacagaatacttaacatctaatgtatcttctagcccaaaagttccaaagtctttctccagtcctccccaaaacatgatcaggttgccacaggaataccccactcctggtaccaatttgtcttagggtttttattcctgcacaaacatgaccaagaagcaagttggggaggaaagggtttatttgttcagcttacatttccacattgctgttcatcactaaaggaagtcaggactggaactcaagcaggtcaggaagcaggagctgatgcagagaccatggagagggatgttacttactggcttgcttcccctggcttgttcagcctgctttcttatagaacccaagactaccagcccagagatggtactacccacaatgggccctctccccttgatcactaattgagaaatgccttatatctggatctcatggagaagcacttcctctactgaagctcctttctctatgataacttcagcctgtgtcaagttgacacacaaaaccagttggtacactaggtacatcgggcaaaactcttttccttgtttacagtcatgcttacctcattctttttgtgatattctgtgagtgttctaatcctgacctattaatagcttttgttttttggacggagaaaatgctcagtttacaagacacagtgatttaaaaagagacaccattaattagaatctagatttcttaatattttctgtagaatactgacataaaataaaataatacttttccttttgtaattcatccatacttagtgctgacaatgtacacttcctgagtatattaccttcagtggtaagaaacctatcttagaattccaaactgataaatttaaatgatccatggatttttcacttaaagatttcacactcaaattcattgtttagactcagttttccaccttgtttttgtttgtttccctatttcagttaccttttgaaaatagttgcaagttctgtctgcctgtctttttctttttttctctttttttgagaccaggttggcctcagactcagagatccttctgcgtcttccattgtgctgggactgaaggcatgtgccactgccacccagccctagctggttttctaagcttgaggcttggtagaatcatcagcccctcctccaactttgtttttcaagtcctgttgagtctacctcctaaatagttttcagatctcttcgtttgtctttatctctactccctcaatgaaatagccctttaacctatgtccttgaatgcagttatgcatatcttcagtttaatgctgccagagcagaaggcaaattaagataagtgtgacctctttgggtattttaataaatgtctctagtctcctgccagttttgctgtagaactgccttcttaaacttgaggtatatctataatattcacaatttgcacagtaggaatcctaaatactttgtttctcttacatccaaatactttggcagatttattcaaacaactttttcaactcctgcttttgtggaaaaggtcttaatatttatctgctcctcattcctaaagccttagagtagaagtctctagtcagattagtctgttcctcctgtaattaattatttaattttgagtcaaggtctttttatatagtcctgactggcctggaactcactatgttgatcaagctggcctcaaactcactgagattctgcctctgcctcccaagtgatgggattaaatgtatgtgtcaccacctatggcccctatgtttttatttttaaactgtagcctagttctttatttctgatatcctttgtcattgcattcccaagcaattagagaggtagggagtagtaaatacatgagaataagtaagaaaaagagagagcctgggatggaatcaactgctctaaagactaagcatgtttatggtcaggtggtccttcttaagaacagattcctgcatctttggattatatagtgttagatatgtttgattttaaatggaaaaaagaacagaaggaagagcattgaaaggagagggaaggaaacaggcaaaagtgcctgagatggatttatagaaggataatcacgtagggtattttcataggaagaaaggagttagggactttattgcaagtgtagtaggaaactaaaatttaaacagtgattataacttgattcagtaaacttcttcagaagtcattttggggcaggggttgaaaacagagacagggatttaagcaattggattgttaacagtaggacaacagacagatgattttgttacaaataggatgaggacattcaacgaagatgaaagaaatgcatgtgaatttcacatggggttggtttttgtagttgagttatatataggaaggaaagaaaatagttgtaacaaaggctgtctcagaggcagttaaaatttatgttttaaacaatgtgtaataccagttttgtacatactttttgaaatgtttatcatttttattttaccttttaggcctatgcatctggatgtgacattgtaatactgggaagtaattttgaaagattacagatcatcccaggcgctaagcatggaaatattcaagtgggatgtgtagactgttcaatgcaacaaggcaaggtaatcttgtggtaacatgtagatttttatcagaataatctctgaaatatctatctccaagacccttccaaggacaaagctatacatttctttggctctccaagatgaattttggagaatgtcaggaattctggtggtgatttgttgttgtttgaaaatatttatttttattttatgtgtatgcctgagtgtatttatgtggactctgtaagggtggggtggtaggggtggggcacaaccatggatgtcagaagagggtttggatcacctggacctggacttcacaggtggttgtgagctgcctgacctggattctggaagcagacctaggccctttacaaaagtagcaagtactcttaattgctgagccatctcttcacctggttttgacttttgagacaaggtcacactgtaacctagcttgtcctagaaatcacaatgcagcccaggctagccttgaactttctgcagtcctactgtctgtctcttgaatgttgagattataggcataaactattatacccagttaggaactccatttttgtgtaattttaagatgtagtataatctttactaaatgagatagaagcatagtacttattatttataaacatctgaaagcttattgttttggcattggaatacagaattgataaaaaactaagatctcttgagatgttagtttccttaaaatggaaaaaaatagcattattatcaaaagacaaatcatttggtagtcatttgtaggtagactttattctagtaacttctagaaaacagaaagggtacataaactaaaatatggaattaaaaactgttagaactatgtatatgaaaagtaaaaatagtaagttgaataaataataataaaataaataaatagaaaaaaataacagcaaatacaacacagcatagttcttgttgatatctctgtggagtatcctgctcggcatcatactaggcaacatacattcctaaaaatagcaccaagtaagtatagccgactaggcttagttatatggtttttgagacaagatctgcctaacttggaacttgctttgtagaccaggtggccttgagctcacagattgtctgcctttgcctccttagtgctgggattaaaggcatacgtcaccatgttaggtactttatgatactattgataaaaggtgtttctatgtcagtctttatctatttgttgtacttccattgtcttttgtcactttataggtcttcttttcaatgtagttgcaaatatctctcatatatctgcctcttgtttagaccttgacatgttcttctttttaggattctaaaactgtgaggatttttttttcatggttttagtgtttgcttgtctagctctttagttctgtaatcttttgttattattaaaaacttacttaaatatccagattcatagagctaagtaatgttggaaatgtgatagcttccagcaaaagcttttcatgaagattcactaagttatacaattatctaggttaggaggaagtaatttgattttatgatcaaactaataaaaagtaagttttcttattaataggtagtgctatggtcaaagcccttttttcttaaagtattaggaagccaggcatgatggcacatatctgtagtcctagctactcgggagacctaagcaggagggtttcttgaattcaggagttctgtgctgtagtatgctgagcccatcttgtatctggactaaatttgatatccatctggtggcctcctaggaataggggatcacagggttgcttaaggataggtgaataggtctataaagtatcaggaagaaaattttttaggttctggtactaaggtacttctgactgtctttaagaaagaaaacactatttgatgtcagcaacatatatcattaacattttttctttgtataaccaccaaattagtctgagagactgtacctgtatatttcttgtttttttttcagcttcaaaacttcttattatcttggaaaaattcaaattgttcacaatggcatgaatcattgtataataaggctcagacctatcttttagtcttatgttcatcattctgttacaaagaacacttctagctaagttggtcatgagtcacctgtaaataactgtattgataatatgccttcattttaaaattggatggatacttaattttcaaaaccaactcatacttcgggcccagtatttcttagctcaacacagtgcagctgatttgtgtattctataaactcagtttatttagcatacttattttgaatttttgtatacatgatatcctcatctctttctttccattagaacatattgttcttttatttaactctacatttttttttttaatctggttgatttggaactatgtagaccagattggccttgaactcacagagatcagcctgcctccaccatgcccagctgactgccttatttatttatttgtttatttacttatttgttgcctgtttggtttaacttttgtttttgagatagggtcttaactgtgtatctgatgctgatctatgattcttttcccttactcttctaaattctgaggtggcaggtttgtgccatcatgtctagttgatttctaatgttttgatagtttcattcaagctatcgtagttgctgacttacaagaaggaattaaatatgtagctcattttcagtatactgtgtaagtatctctgtgtaagagacctgggatcaaattatgtgttcctgccctccacaaaataaaaaacgaaaaaggaagaaatttcaaaaacataaatgttaagaattgtactcattgtgtttataaagaataggtcttgttttatttttattgagttaaattatttgttgggaaaattaggaactccaacgatagataaccttaaaactcattttaaaatcatgtcagagtttgtatttggcaaagactgtatttacatgcttcctctgtgaggaaatagttgtcattattatacatgctaagcattttatggctgttcttttcatttcttgaccataggactattcaaaagatggtgttatgtgtattataaatgcagacagagaagtctctgagtgtgcataaaaaaggtagcagtgctggggttctaacatcatgtgatgtcttctagattgatattcttaaatactgatgggtgaaatcatatgcttgcatattttaaatataactgcaatagttatttgttcttttgatctataggtatttttaatttatatttgtttttctttttaaaagattgcagcatcctatgggaacgttatctctgtttttgaaccagtcagtttgccgaaaaaaaggaaaaacttggtcagtattttattatttttcttttaggaattgaaatagatctagtatgaaagaatcaaaatgaccatactaaatataagttataagtccatagtataagttatggactataattgaagacacatgttaagttcaattttcatattaaaatataattaaatttttcattagaattgaattagattatattttgtcaacaaaatataaagtgttctgttttccttctaacagttttatttgatatcatataaagtgtcaataacttaaagtttggaagttactttattgctactgtcagaaaccattgttgagccaagagataccttattatttggtctatacagcaatcttaagttttctgccttttcatatgtttattcatacagttacatgatttgttttcagtattacaacatttttaggactttcttttttgcttttattatgtaatacagttgctgtcagatgaataaatgctgttctttataaggaaagtatataagaaattagaaagtttgttaactagtcgtttataaatattgggagtatgtacttagatttcatgtgttttagtgctcttgagtataacaggccatattcttctccatgtctttgtagtcaccgtgaagattaaaccagtgattcctaagccacatgaaagcatcagcatggggaactggagggataggcttagaaattgtagaactgctgtctggtttttgtttattagatattttctttatttacatttcaaatgctatcccgaaagttccctataccctccccctaccctgctcccctatccacctactcccacttcttggccctggagttcccctgtactggggcatataaagtttgcaagatctaggggcctctcttcccaatgatggccgactaggccatcttctgctacatatgcagctagagtcaagagctcctgggtactggttagttcatattgttgttctacctatagggctgcagaccccttcagctccttgggtactttctctagctcctccattgggggccctgtgttccatccaacagatgactgtgagcatccacttctgtatttgccaggcactggcatagcctcactcgagacagctatatcagggtcccttcagcaaaatcttgctggcatatgcaatagtgtctgggtctggtggctgattatgggatggatccccgggtggggtagtctctggatggtccatcctttagtcttagaactgttgtctgttttttctgttgcttttacttatgtgaacttaatttttttctttttttcaagatagggtttctctgtatagccctggctgtcctggaactcactatgtagaccaggctgggctggagctcagagatctgtctgctctgcttcaggagtgctgggattttgccaccaaactgggctcctatgcgattttaatagagaccaccttatgaccctctttgctcaactttgaaattaactgggatttgttcatttttgatagagttgttacaaggatgatatattaaagataagaaatgtagataattaagtggtgttttaatggtggaaatacgcttatataacttctgatcattttgagactgcttttatttgagacaatactgtcttataaattgccttttctctatcctgtcccccttacactttattggtctttttgaaacagaatcttgccatgtagcacaagacaagtacagaacttactgtgagtccagattagctctgcactcccagttgtcttgtctcggcctctgaagggttgtgtttacaggcaagtgccgttatgctgagcactcatgagcattcagtttcatgaagagcttccaaaattctctctgatttctgttagcatctgtggattatctagtttatccagtattagaagcctttactgctgcattaaataattgacagtactaaactgtacttttaaagtgtttattacatttatttaactgggaagagaccacctgtggaggccagaggacaatttgcaggaattctctcttaaaagtggtaatgataccccctagttgtaatatgtgtatatagtgtcacatgatttttttctttttctttcatttttactgatttgtaggttcaaataaaagatggttgaaagaatgggaaagttttatattaaggaagtaatatatcttagagatgagagattgagaaagatatttaaattagttgatccttatatacacacttaaagttaaattttagactttaataaaatacaaataatgtaagcaatgtttggtataaaatatatgtttactggttatttatactaagaatagacttttagaccctagcagcaggtagtctgaatagtcttttaaaaaaatagtctttattatctaattcagtgattctcaaccttcctaatgccgtgaacctttaatacagctctttatgttgtggtgacccctatccataaaatcatttttgttgctacttcataactgtagttttgctactgagcagtgtcttagttccaaaggtgatgtgaaatatgtgtttcctgatggttgtgacccacaggttgggaagtgctgatgtaactcatattctcctgacataattgtattgttcctaaaaacaactgcattattatgagcacagtaaacatgacatgttcatttgtttaaaaaatgctaatcataattagctaagtgacttttttctgattttaggaattttatagtcagtggcagaaaagtggccaattttttctggactcaatagcacataatataacctgggatcccgcaggtaaggaaattaacaagaataactagaacaattttatctgtgtgacagtggtgagtacaaaagtaaataagacaaattgtgcccttttataatttatattgaaatgaaggcaatacaagctctagtaaatgacaggacatgataaatgatatacagaatacctattacttttgggaaaagatacttctctctggaaaataagattttgttgacctgacttttgatagatttttaacaattagggcagaatagattaaattaattctgagataagatttctgtattatgctatgtatttgcattaaaaaatacatgtcgtagggctggagaggctggagagatggctaccagttaagagacctggttattctccagatgatcccatttctattcccagcacccacatggtggcccataagcatctgtaattccattctaaaggatgtgcacatacaaaataaaaataaatattttatagcagaaagcagcattaatttttctgcttatgttttgtgggtcagaattgctgtagggttttgtgggatgtgtatctcttacctgtgtgttattacttttaagtagcatgtagaggaaccaagaaagactttgcatacctgaacctttggctaattttagtgtattacctttgttcttcatgtggtctgtctctcgtggtctctacagctgagtagtgtaattacacggctgttaacatttgaaagcgagaatttaagctacaaatactcctacaccctggcctttccttatcagaggattgttttgttgtggttgtttcattctctgttcaaaagaaggtaggagtccaggtattcaagaaagagacaaccacatcccattcttctaaggtgtatgaaaattattttgcaggggtccttgtacagactttgtacacgtttcagttaatccttacaactctaaaaagctctgaatataagaaaactgaaattcaaagattgtccaactagacccaatttgcatggctaagtaaatgagttaaatacatttctaaatttctgtcctaaagtttgtgcttttttctagactaacacttttttctctttttttgctttctttctattttttttttttcaagacagggtttctctgtgtacccttggctgtcctggaactcattctgtagaccaggctggcctcaaactcagaaattcacctgcctctgcctcccaagtgctgggattaaaggcatgcgccaccacacctgggtttcctttcttttttcaaacttccccttcctcctcctcctcctcctcctcctcttcttctcactcccctccttgctttcttcttccttcctccttcttttcttcctcccttcttcctccctcccttcctctttccttctttctttcctcattgcattttatgagggttttgagcatactgaatgagagattatttccaagagtatgggctctctcccagtgactataacacaaaataaagtgtcttttctctctcaggaatgaaaacctgtagatagtcaagcaggggtggttcctcattggccctgccccagctaccattgtctggttagactccccaagggaagggtacaagattcatggaatcattccctcctatagtagttgacagatccaagctcttaaattattcttttgtttttaatatatatatgtgtttatcaagattacatttcttatttatgtgtacgtatgtatgggtgtgcacatgctatatggggatcagaggacagcttggaggagttggttctatctttccaacatgaagattctgggaatagaactcaggtctttagaattggaagcaaatgcatttacccagtgagccatctagccaaccccaaattattcttttgcagtttcttttttaggtactctatcgtactttatagtattataagaaatcattgagtatatatcttaactcagtgctaacaacttacataataaatgctgttcatatatatgtatatttatttaggtaatcgtcttttaactggttccagctgtttgcagctttggtgtaactcaagaaagcaaactgaagatgaaaatccagataaaacagatctgaactttggaaattggatgtgcatttggcattgcaagtaagtaattgactagacagtttttactggtaaacctgtctttttttcttctttttttttaacattggttgtatatatgagttttttagtctgttcactgtgaacagacattagggtcaaaggttacaataaatacataggttgtcagtgaaatggctttactccatagatgcttgctacaaaggctggtgacctaagttcagtccctgaccccatgtggtggaaggagaggactgagtcctccaagttgttcacacacccatttgtcatttatgtcatgttgctcttggacaagaaaaatattgtttggatgtaaggaaatagattttctaaaatgacaccaaagttataaagtgacaagagggaaaattaataggtttgactatccaaataaaacatttctctaataaataaaaacttgaggggaaaataggtacagttctggagttaataccttctttaaaagtgagattagtttaaaaagactagatcactagttatcagtagtgagtcatgaagactgggctttacttttgtgttctctgcctcatatgaagataactactggaagagagacttcagagttgcagtatgaataactaatggacattttaagaagcaattaacttatttctaaataaaaaatgtgaagtgttcagaaagaagagtatgagtaacattaatagtgagtgttcaaagtatatggtgaattgttgataataacactagattattaatattttttctaggaatttataaatatagcttaggtttaaattttgtatattttgattagcattttcaggtttctgtcattcaacaaatatttgttggttgcataaaatgtttcaggtatctgtaaaattgtttgaatgttgcattgaacagataggggaagtccagtgttagacaagtaaactgaaatagcaggatgttaaatggatttcttcttactccatcttctatgaagtgatagtagagtgttattaggtgccaaatgacagacctatatatacactaaaggcagacttatatactaagtttgcagaagtgttgtaggtagaaacacgttaatatatggaaggagaatagaattttgcataaaaatttttagaaagactgggctttcttttgtgttctctctgcctcatatttatagatcaagatgtgaactttcagctgttcgcagcaccgtgcctttgttttgctatttgcttttaagttattgaagcgggggggggggggtatggtgtgtgcttattctttcctatagttgtatccaaagatttccatgaaataaactgagaacataaaatgtactttgtgcgtttgtaagaagggagggaagactgttaaaggtcagagaatgcaatagtaacttagaataggcatgataactattgatttgatactgtgtcttattaagcaagtagaaaagcctgagaatagaaactgaagcttaagatgtctagagaacatctcaaagttcagttttgaccacattccttattagtgatgtgcttcaaacactgagatgaataagaactttgaagacaaaagtaagcaaggtaaatgaaagagagctgaaggtgacattagagaatcatcctgaaagaaatgagtgtcattgaggacaaagttccctgtgtgtgagtgtttaacttgtggctagagtgacatgagcagggcatagaatgatagaggaagttgtttatatggcatcgtgaggtcatttcaggaagagggaactgtcttgctatgttgctcaggcaatcttttatactaaagtgatcctctagcctcagtcttctcagtagctggaaatattggcattgctgctgtcctagttacttttctgttgcagtggcaaacaccatgaccaaacattgttgtttaaaaaatatattttggagtataagagatacatggctctggaaattaggtatccagatgaaaactgaaaccatctctcatatttagagagaatttgctattacttgggtgttagacttgtcaaggttttgggggtttttgtttttaacaattattacttgtgtgattcttaggaaaatttttaaaaatggtttttgagataggacctcaccattacagccctggtttacctggagtagtcacagtgtaggccaagttggtttcaaacttgaagtattctttattctaccttttgaatgctagaatttcctgcatttgcaagacttggaaatctatatttaaagtttctcttagtaactacttcgtttttggaatattctaaaagttaagagccaggagaaagctctagtaaaacatctgcttagcatgtacaggctctggagttcaccccaacaccaaaaaaggggaaaaacaaaacaaaatttcttaacaacaacaaaaacttcgtgtgaacctttagagtcactagtggtactctgcatttccagctgtgttagaaacaggcctgcttaacctggtatttaaccaacctgagccgcagagcaagacccacctcataaggggaaaaagcgttactcaaagttctgtaatcatgagaaattgctggagtttaatttggaaagtactggttattttgagtctactttccttggtgattaactctcacctttttaatttacagaactgcttcccaggtccacctaatgaaattttcaccagatggagaattttttgccactgctggaaaggtaaattttgaaaatatgtgtgtctgttttgtgtctgtgcgtgcgcacaagcaccaccatattgttttttatggagtgagatggagttgtttattctgattgaagttcaaaaatggaacctaatactaatttctttgtattccccccctttatttcccaagttaagtacaaatgagggtggacatacatataatacttgatttctaatattttgtgtatctgtgaatgggtatgtgtggttgtgtctgtctgtcttgtctgtatgcatgcatgcagaggacagtttgccagagttggttttcttttaccatgtgtgatccaggactgttagattttttttgaaatgccctaaataaaatacttctacagtattagttattaaatgattttcattttcaatattttcttaaaatgataatttatgaacggccttgccatctatctcggttatctggattgtctataatttggagatagtattgctttctttctgtttggtttggtttgtttgttttaagacatggtcttcctatgttaccttggcaggcctaaagctcactatgtggctcatagatagctttctttctgcctcttccaggattagaggggtgtgccatcagtttgcaactagtattgcagtcttagttgaatttttgacttacgagagaataaaaccccttaattttcctttttctgaataatgtttgtggttatatggtcactagatgctttttggtttttctccttaggatgactgtcttctaaaggtatggtataatgtagaaaactggcgaccagctgttacgtctccagataaaaattcagaaaaacaatcccaaggagaaattgacttttcttttgtgtatctggcccatccacgagctgtaaatggattttcctggcgtaaaacaagcaaatatatgccgaggtcagtgttttcaccgtgtgttagagagcatcaccaacttgaactgtcagtgtttcactgtgtgttagagagcgtcaccaacttgaactgtcagtgttttcactgtgtgttagagagcgtcaccaacttgaactgtcagtgtttcactgtgtgttagagagcgtcaccaacttgaactgtcagtgttttcaccgtgtgttagagagcgtcaccaacttgaactgtcagtgtttcactgtgtgttagagagcgtcaccaacttgaactgtcagtgtttcactgtgtgttagagagcgtcaccaacttgaactgtcagtgtttcactgtgtgttagagagcgtcaccaacttgaactgtcagtgtttcactgtgtgttagagagcgtcaccaacttgaactgtcagtgtttcactgtgtgttagagagcgtcaccaacttgaactgtcagtgtttcactgtatgttagagagcgtcaccaacttgaactggttttcttacgttgaacctttgaagattagagtaatagtcgatgattgtgccaggctgcacatgtctggatatgagccaagtaagattaatgcttagcataagagcctcaaagtgaatttgaggccaagataatttatttccatattagatgtctttgtcatgcagttctacacagttttctttcctttgttttgtgttccattgtgtatcttatacagattgctatttgtgtaggttttttttggacagttaccaccctcatttgtacttgcagttgaatcctctggtatccttttttaaaacaagcaaaccaaaaaacaaaatagcatttattgaagtccttttcttctttaaggaaatagagttaattcttgaaattatctttccttgagttgggtattagtttaacccataggagctcagtttaactcatacgagctcaaaaatatgtctgttagtatttttttcttttctgtagtccttgaaaaactacctaacatagaatttttatgtgttctttgagtaggttacatagatttagtaagtatatcggcaaatctgtcttgaactccgtggagtgcagattgggttgtctgtctcacctttttggttctgttgagatgttcaggtagaactgtggttatgcgctcacatcatttgtcggctttattttgtcccttgggaccaacaggatgtgtacctattagagtgttattgtcctcatcctagccctccattccaagtttagtggagaaaagaaactaggaaaagtactgattctgctcttattttgtggccgagtcctcaagctaagagagagtgatctgagtaatcggtattgccagcagaaggaaccgtatcgcaggttcacttaagttctagttctcttgcctacatactttaaaatgtgttttcaataaaatgatctcattgtgtatgttaattcttattttataagttgtaagtgactccagcttgatcattacaaatttgtcttttaaacctatctgaagaaaactattttatagaaactaatttcttctgatatataataaatgaatatactcattttttaaaagatttatttatttatcttatgtatatgagtacattgtagctgtcttcagacacaccagaagaaggcatcagatcccattatagatggttgtgagccaccatgtggttgctgggaattgaactcaggatctctggaagagcagtcagtgctcttaaccactgagccatctctccagcccaagtatactcatgtattgatgctatagccatcagaatactaaacaggcttatgcattactgaagttttgtggactgacttagcttaagttgcgatggagctgatcacagtgaagactgaaacagatagcagatgcctaaaactgggacatttaggggttcctgcaaatagcaatgaagtaatagttactctcctacctttgggccattttattaagttaccctcgttcccactccctctccctcgccctctctaatgtggctttgaaggtcaagcttaggatacatactcctaagaagtggaagcaggaggaccacaggctcaaagtcattcttgctggagagtccatttgaggtcagcctggactacatgaaactttatctttaaaaacaagttgaatgcagagattctgttgaatttagaaagaacagtagacatgtctgtgtagtaagcatattctttacattccctcctatggagggagcaacagtgtcaacaggccagacccccccaccaaccaaagactatacatggagcagcccagggcgctggccacatatgtggcagaaattggccttgttggacatcagtgggaggagaggccctccagcctggggttgctcaatgccccagtgtaggggaatgtcaggacaggaggatgggactgggtgggtgggggagcaccctcatagaggtggggggggggttcttcagtttctgaaggaaacctggaaaggggaaaacatttgaaatgtaaataaaggaaatatccaagaaaaaaaaatgggtagaatctgaaaaaaaaaaattgaatgcagagagtctgttgatttgagaaagaacagtagacatgtttgtgtagtaagcataatctttactatttatttaaaaaatgatgaatataggccaggttgtaaggtttggtgacattctgcaggaacctccaaaagttggctggagataacaaattgcaaaactatcttaacttgttgtttcatcagtgtaggacaaatgttggagacatgtagtcaatcacagggttgctttctgtgagtttaaatctattgtttgttgcttttatatgccgaatgaactctgtatcaatatgatagactaatggttctcaacctgtgggctatgatccctctgtggaggggggagcaaatgacccttctacaggggttgcctaagaccatcagaaaacagatacttacattatgattcataacagttgcaaaattgcagttatgaagtagcaatgaaaataatttttatggttggggtgaccacaatataggagctgtattaaagggttgcagcattaggaaggttgagaaacactgtgctagaccatcaagggaataataaacattgtaagagaagtgaagaagggcagctccagtctttgatattgactacagatattctgaggagtcacttgaagctatagacatgcattaagattgctgcactctgttgatttttagttggcttctctcttgacttgtttgtttctcttaaattcttttgcttcatctgattgctatctagtccaccgtttagttaccgcctgctactttcctttgtcagtgcttctatgctagttattcattgacagtatgaacttttggtattgttttttgatttattttcttgttaaatttgcttacttttaattttattgctatggtctatgtgagggagaaatgcaagggatggatatatattagagggaggaaataagtataggcaagggacagaagaaaggaaggagaaattcaagggatggatgagtgttacaatgatgaggagtgagaagcaaaaggttcaggaagaaatcaaaagagtgcattgtagaaggagagatgagaggtagatggatgggagatgaaaacaaaacatggcccagagaggctgagaggatggtgtcagggcagaaaaagggaagaagcattggggagaagaaaggaatgtgaaggcatagacagaaggtggtgagagagctggacgggagaggtgggggaatgcactggggaagctgaagctgacaggggaaccaaggaaaaacactgattttgcttcatttttcttttgtggtgctgggtctttctaatcacaaagtgatgaatgataaggcagttgctgtagaatattttatttcattcctcttagctttcttctttctgttttgtctttactgccctcctttcctccctccttccatccatccctcctgtcctccctccttccatccatccctcctttccctcctttccctcctttccctcctttcttcctttcatttgctaaattacctgataaaagatttctttgtggtaatagctgtttatactttttattttgaggatgtcataaaaggaaataactcataataagtccagaatgctaagtccattgctaatgatggatgtggttcgatcaggtctgtcatgaattcttttgcacatcactgctttgggcctaggtaggctaagagacaataagtatactatatgcttacatcagtttcttaatgactttgcagaaagtagcacttgaacattaaatagttaaaaataatggtcattcactgaataaataggaacattttattaggaactttgttttgtgtttgttaattgaggaattaatgcttgatctaagtcattgctctttagatgtaataaaaatctcaagattattgtaacaaaaactattttcttctagacagaagaaataggttgataaacattttctcttgtgacatcaatatatacatgttctcttgacttttttataagcttttatatgtatggttgttttgttttcatgtatatctctatagtgcccttggaaaacagagggtgttgagttccctggaactggagctaaaaggactgggaatcaaaccctagtcctcaaaaggaatagccatctgactgctgttatctctttggctctcttgttaatattagttaaatgtttaaatatgtatagaaacactgcaggatgtttctgatgtgttatgtaattagtaatatctctaaaatatttttattcctcagggcttctgtatgtaacgtactgttgacttgctgtaaagataatgtatgtcgtctttgggtagaaacatttttaccaaatgattgcttcctgtatggaagtgactgcaaccactggtgtgaaccagttagtttaacaaataacttaaagagaaatgcttccagtaaagaccgagttcaaagtgctctagaagtaagtgtttttattatattatgtgtttcctacagattttaaaaactttgtatacagtgtatttttttttcttctgggttacataataatattataagtagtagtatatcttaggaaaacaattatagaaatgttccttttatctaagtaaagaaaatacatttaagtacttttttgtaacttatgagctatctttaattatgagattaatcttagcttaaccagttacaaaataatggaaataatggtaacagtttacttggcaaatgtaaaatctgagaattcaaagatttgactataaaatatattttctcttggagcataaggtagatttgtttttatattctgttgtaccatttgccatttgttatctttcgacccgtcagaacacatctttagtttataagcattgatggtaaaactcaatttttgatgtttgggctaattgaatatagaacaaattttgctcttttgagacaaagtcttacattgtagctccaggctgatctcagccttatgccaatcatcctgtctctgtctcttttgttctgggattacaagtgtgaaaaaccatttttgattgaaaatagaatagaaatactgactcagtatttctgttctttttctttttggttttgctttttgtttgtttcatagacagggtttctcagtatagccttggctatcctggaactctctctgtagaccaggctagcttaaactcgaagatcctcgtgcttctgcctctgcatcctgagtgctgggattaaagacatgcatttccatacctggcttcttattccttttttagtattaaaacatgaagtggcttgaaaatgatttgtttaaacttgtatagtatagaaaacaaattttccccctcttttggtgtttgaacagggtctcattatttagctctagctgtactggaactcattgtatagatcaggctggactggaagtcacagagatgatggctgagaatataattaagctgtgtgacatattcagtggctttgtatattaatcacgtaacaaaaagtgttagccaaggaatctgttctactctgcttcttactagctcgataaccttagttacggtctatatgaattatttcatgccatgaaatattaaaatagcatgtttaaattggataccacatgagatcagataaaatgatctctgtgaaaaatgatgctttttttaaaattggataacttggtatatcatggtaatattcatagtgacagggagcaagttgtgggcaaagacatcaagcagacagatctttgttggtactttatttttggaaaaaagggcttcattatttagcattggctgccttattgtatagaccaggctagcttattgtatagactcagtcagagctcttcctacctttctcccaggtactaagattcaagtgtccatcactatgcccatcttactattttttcgggttcttgatttttttttttttttttttaacttttaagttctggaaattgattttagatgttgaaaagcaaatatggaaaatagtaggccgggtacttattcttcaagattcaaatttgataggtcaaaaaatggagagttatttttttacatgtataattatataaaatagcatttttattcattctgacaatcataatatgcagtcactttactttgtttttatatatacaggtaaatctgagacctttccgtagaggtcggagtagatcacttgctcttgtagcacatactggctatctgcctcatcagcaggatcctcaccatgcccacaggaacacaccactgcatgccaatgcactttgtcactttcatattgcagccagcatcaacccagccacaggtaattaactaccataccatctggataggtacctgtgaacttagagaattaagctcttatcacttcagtaaatattttctatgagtataaaaaatcaggggtcacagatgatgcatttaaagtagtgtatcaaagtgtttctttttttaaaaaaaggtaatacttacacataattaataccacctttatggaaagtggaaaataaatgactcctttgatttttacactttagtccctttctctagaacaaaaatttattttttttatatcttgtagaatatagtccctccttctcttttcctatcttttttctttactctccccctcttgcctctctttagacagagtctagttatatagccaaagctggcctcgatattacagaatattcttaagcatcagttaagcagaaccaatttccatggagctgaaattgcagtattgcattttcaaagaaatatagcagtggaattatcagttaattacttgagtagaattctgtctaccagagtgaactctgctaagttaaagtatagaaatacttttgatttatttggttgactgtaatcttagttgtaaaagtattcatgggctaagaaaaatatgtcagaatattgaatcatctttattaaaaaattacttagatttgggaaagatcatctttatcaaatacataatattgacagtgcttatacaccagttacctataaagttagtggcataattttgaaggctcctggtgagccaaggaccaggattaggttgtagtaaagctcactggtaaagtgattttctagcatggatgaggcccttgctttgagttgcagcaccttagaaaaaaaatgaaataaatttaaaaagcaacaatattacaagaataacgaaagcctgaattctcagaaaatgcctaggagattatttgagagaagagccctgagtttgaatgtggcacctcagcttcctaaggagaactaaaactttctttaaattatagatcacctaggaaaacagtgatggtttgaataagaatggctcccacagtttcacatttgaatgcctagtcaccagggagtggcactatttggaaggattagaaggattaggagtgtaccctgttgtacttcactgggcatgagctttgaggtttgcaaagtccatacccggctagctctctgcctacagaacaaaatgtagaactctcagcttctgccagcacctgcatgccaccatgctccccaccataataataatgcactaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatagctgttgtcctgctctcttgaaggctgtaatcagatgtagaataggtaaataaataatcaaaataattatgctactgtatagatataaacaggaactcttggattggatacattagaacttgcctctgatagtagaatcaagggaaaggttctttccggtaccatttatctcttctggtattgtttctacttttgcctttactatagataaatcaaacagataattctgttgatttttaaaaatcttttatcatggaaaaagcttaatttgtggaatattgtttgtgttttttaagtccattgcagcctttatagttctattgataacaacatgattcagattttattgacatgatagacttgaattttctttatctttgtagcaactgattggatttgtacttcaaaatacataattaaatacttaaaaataatgctaagtatgtatcaaaagatggcctagtcggccatcactggaaagagaggcccattggacacgcagactttgtgtgacccggtacaggggaacgccagggccaaagggggggagtgggtgggtaggggagtgggggtgggtgggtaagggggactttttggtatagcattggaaatgtaaatgagctaaatacctaataaaaaatggaaaaaaaaataatgctaagaaatattttttttatttaattttttttcatagaatatattttgatcctgttttactcccctcaaacttcttaagagcctccctactattggattttgtttgtgttatgttcaccccagctcccctccaaaacagaaaaaaaccaataagacaaaagtaccaaaacaaaaagctgaccatggagtctgtttagcgttggtcagttatttctgggtatggggcatgctctggaatgtacttgatatattccagtggcattcccttgtagaaagctgatttccttgtagaaagccgctaagtatctcttagagctgggacttggtgcccatctccccctttcaggactgggcccccatctgccttgaatgttgcagatctggtgtgtgctgccaaagtttatgtgagatcatatgagcatcaatcctgttgtgtctggaagacactgtttctttggtgttatccttatttttggctcttaaaatctttctgcctcctcttatgcttagcgccatcaaccttctacggaaggatttgatgaagacactcatttaagactgactgctacaaagtctctggaaactttccagtagactgtttacatatggcttttcaaatgccctttagtgttagttgtttctcttcatatttccctcttttgtcctgtcttctcatcccttgacatttaattcccctattctattttcccctttatctctccttaacactatatgctatttcaccatccttaagagatctttttcttcccccaggttccttactaatttctaatgtctgtggttatttgattataacacatatgtcaaaaacttaaaagctaaaatccacatatgagagaaaaacattcagtgtttacccccttgggttctggagtacctcactcagcatgtttttctagcttcatccatttacctgcaaatttattttattaaacagctgaataataatctgttgtataaatgtatcactttttcattatgcatttattagttgatagatagctaggctgttttcaatttctggttataaaataacttttaagttaaactgaaaactagataaatttttctcaaattaaagggtaagtataatgccaataataaaaatagaaattgtgtatgctatgttatagaggttcaaaatatgtattttgtcatttgtttttctttatagatatcccacttcttccatctattacatccttgagtttaaatgaaaatgaagagaaatgtggaccttttgtggtacactggttaaacaataaagagttacattttactttgtccatggaagtcttcttacagcaacttagaaaaagttttgaacagccctcatctgaagccagtgtagaagattctattcaggcagatttaaaatctgatgaaggtaaagtttaagaaggatgaaactttaaatttgcagtccaaaataagtagtttttatgaggataaaactagttattatatgagataatttcccatggtcattgtggcataatgtaatatggactagcttatttaataactgggtatggatattcttgcttacattacttttttttcagagctttctgttcttttggatttgtcagcctgtaaggcttgtgactttatgacttaagtatggattaatggcatcaaatgtattatctcatacactacacaactactttcctgaatctgcaatttaaatatagttgatttatatgtacattagagttgagaaacactgtatgaaagaagaggcaattatgcttaccactaacaccacagtgctttgtattcatcatgctgttggatgtggagaaggaagagggcagggagagagtacaagcgttttctctgtgccttgatacataccccttccactctggctacactggcaaaagagactcacagagtcccaagtgctctcattttctagccagtttgtaagcttttatttatttttcatttaaatttgataaaaaaatttgtaattgcctcttttaatatgcctcatccaggaggtgaggaaagggtattgagtctgggctttttgaaagaggtaaagatatgcatgttcacagtcctgctagctgtctgattactaagttaacttcgttgatcttatttcttgttaatacaaaagtatgttttttcacttttaatttatttagaaagctctgttttaatttgtagtgataattttattggttcatgaactcttgcttatagaactggatgatggtgttgatgatttaaaaataaatcatgaaaagaaggaattggatgaagacaaaatgttaccaagttcaagttttacaccattatcttcagccgccgtcgatcatcagattgaagtgcttctgtctgaatggagtaaaaacgcagacatgcttttcagtatccatcccatggatgggtctttactagtttggcatgtagattggctggatgaataccagcctggtatgtttcgtcaagttcaggtactgttaatcatctatgaggagctaattcttttttttttatgtgaaaacttttttaacatgtttttatgtaattatatgttctaacacccactttcttaattttaggtgtcctttgtttccagaattcctgtagctttccccacaggtgatgcaaactctctttgtaaaagcatagtgatgtatgcttgtaccaagaacgttgacttggctattcaacaaggaaaacagagacccactggcctcactcgttccacatcaatgcttatctcctctgctcacagtaaatcatcaaataacttaaaattaagtatttttacccctaatgttatgatgatttcaaagcatgctgatggttctttgaatcagtggctggttagttttgctgaggaatctgctttttctacagtgcttagtatttctcacaaatccagatattgtggtcatcgttttcatcttaatgacttagcttgccactcggtattacctttattactgacaacgtcacaccataatgcattaaggacaccaaatgttggtaaccaaaagcaagctcatgatgctgtaaatactgaagaatgctccttggcacaacaaaataaaagcaacgttgatatggcatttcaagatcccaatgcaatttacagtgagcttattctttggagggtcgatccagttgggccactatctttttctggaggagtatctgaacttgcccggattaattctcttcatgtttctgccttttccaatgtggcatggctccctactctcatacccagttactgtctaggtaagcacactgatttccattttagtgatttagattttaagatacttaccgaaaggttgcattttaaatgtttctaaatactttctaggtgcatactgcaactctcctagtgcatgctttgtagctagtgatggacaatatctgaggttatatgaagcagttattgatgccaagaaacttttatatgaactttccaaccctgaaatttctgtaagtacaagctatatgaagtttttggattcttaacctgtcctagcttgacctgttctagaattgtggcctataatttgtgacacttgtatagtgattttaagtttagctccttcattatttctaggctggggttgagctccttattattattattgttgttttgtactcatggatcctgcaaccaaatatgttggttatgtaataaaacaccaaggaggtcatagtacattacaataagagtagtcagaaagaaaagcagagagttagcctggttgagcatgtggtccatgagttcaagtcccagcctctccctccatccctctcccgagtctagttatatgcttctttactcaaaggtagacagaggcttccaactgtagaaagtgttggttcctctatagttaaaaggagctagaataataagagtagaattttaatcttaaacatgagaagaaaaaacccttggcttagttgcagctcaaggaaatctatcaaatgtcagtgtaagacttttaccatgctagagaccctcttcttcctaagcctaactagtgaaagcctactgtctgtatttactgatccctccatttagagaatatttctgcgtttttcagttctagtgtttagatgagtttttgttttgttttgtttcattttgtttttctgtttgagttggttacttgactttacaaaaagaaaaacatttttctagacataggctaaccttgaacacccaggcttttttgcttctgtctcctgtgtgctcctgttgtaggcatttgccattatgtcaggcttattggtgttttcaaatctctcctgaggcagacggtacttaagtttcctgcttaggtgattctagcctaagttgccagtagttagtttttaatgctcagaatgtaaaaggagtagagttgttgcttaattatggtcttgtgaagttttttaaagcataattttataaaacaatatcttgtaaagtgtatgagtatatatgttacccacatatattgctttagtgaaaagaggcatttattgagggtctttcatttgttaagcattgttttaactgctggaaatttgtctataaaaagccagaaactgatactagaaagctcatcctagtgaagcgagatagctggtggaagggaactagctaaaaatatatacgttagttaacgagcaccgtggagagaaacagtgctgcaaaagaaagggagtaccccttatgttgctgttcaagggaaagctttatagaaaacacatgaaggaattgaatgagctagatgtgtggctataggaagagggatccagaaagaaggttggcctgttcatggaccctgcagccaaaatgtgtgattatataacaaaacactaaggaggtcttagtgcaataaataaagctagttcgagtagtcagagagaaaagagagagttagcctggtcagatcctttggacttttgtctaaaatgacatggaaaccattgaaaattatactcatgtgataataatttgacgtaggatttttaaaaataggttactatgatgacttaagtcccactgtgcaaaaaagtagagtgagggagactaatttaaaaagctattacattagtctaggagaaaagttaaggaatcaagaatggcaatgagtgttaatgttagaaacactgaaaacttgtcaagtattagatgtagtttgaatgtgaatagttgggtttggacaggattttgtatgtgaggaaaaaatgactcaattctatgtcagctaagcataaagtagacttgctatggttgaaatatggaagaatgtaggactagcagatttggaaaggtagaatttaagagctttgctttggacatactcattttgtctgacatccaagagattcaataaagtggactttggattttagaggaaagtctgagctgaagatataaaataagtatctgagtctagacatggtggcacaccccttcaatcccagcattcagtctagacatggtggcacatcccttcaatcccagcattcaggaggcaggcagagacaggcagatttctgtgagttccaagctagcctggtatgcatattgagttctagtcccagtcccactaacatgaaaaaaacttacctgaaattcaaatagaacattattagtgtagagaaactatcctattgatgggtaattaggaaactcttagtcagggaatgtaactcagtgagacagcatatgtttatgaggccttgggtttcattcccaataccacaacaaaataaataaatatgatatcctgaaaaattgatgttttaaaagcattgcttttagtatattaagaagttgaggatagtctttcactttggttgatataaattattttccacctaagcttaccaagtgttgcctttccccctctatacctactaatatagctgtattcgaatcattcctgtgtagtttctattaaggtaaaatcctatattgtttatagttgaaagaaactatatttataatacttgagttcatgatttatcttaatgaaattttgtttttagggtttttttttattattaaagaagttgttttttttttttaacagaaatatgttggtgaagtgtttaacattgtcagtcagcaatcaacagccagaccaggatgcattattgcattagattctattaccaagcttgtaagtattatttttcttctatttatcattaagtaaatgacctgtatatgtcaatttatgttgttatttatttacttcagcatggcagaaaaacccagttgcttcatgttttccaagaagacttcattttgaataaccttgagaagaaacgtctgggagtagataacattttattggattcaggtaagaagaattttgatatgatgataagtatttgcagcttatattatatagtcagtaaaaatgaactaatacacctcaagttgtatttcaggttggtatttttatcataaatactactacctttttcttctgagtatgaatttatattcttatttatatggtctgataaaagtagcttaaccttgccttaaatcccatgctcaagctatcctcttgcctcagcctcctgaataacttgaaaacagccatacaggccgtctcctggcttagctttttactcttaaccaggaaataggaaaaaaaaaaaaaaaaccaacaaaactgaaataccacaaatcaaagcaattaactgttcctcggttgtatgttactttactcttagttcccacctgctgcctggtctccttccaagatattaagctaagattgagccttacccctagcccagtttcatgttactttaagtacacagtaggtggagtctgttattgccatagtaagtgagtgagtgagtgaatgctctttatatggatgtattactgacttgaataatgtagacacctggcttttcagaagcccataatttaaatagatagatagatagatagatagatagatagatagatagatagatagatagatagagatagctagatatgtcattaaacagtgtcttaatataaatatttattagtaaaacctggctttccagatgcccataatctaaataaataaataaatagtaatgccattaagcagagtcttaatataaatatttactagtaaaacatttataataaaagttaacttttaattaaattctaccacctaaccttattgttatcttacatgaagtaaaactgagaaaatagagataaaattttcttggttatttaattacagaggcagaccaaagtgcgtaaaattttcctgaagactaaaatccgaagtaagcaattacactatgttagtcaagtcagttattaagtctcagataacattaattaataacatgacttatttgttcaaggatttctcttacaatacatggtttcttccgtgtttcccacttctcttctgagcagcactccttagagctctgcacactggcagtttcttattgtgctttcagttcatgtttcatggtattccctgagcttccatgaactgtaaaagcacgcttttttcatgtggttttgtagttctggacatcctggccatttgttaaaaataaagggaatacagggatggtaagctggctcagacagagaaatgcttgtcacatagcatgaagggtctgaggttgatctctagaactcatgtttaaaaagctggacacagccgtacattggtaatgccaacattgcagagacagatgcattttgaagtgagagacctgtgtcaacatacaaaggagagagtgcttgtgaaagagtttagcatcaacctctgacctcaacacacttgtacatacttgagcatcccccacccccaaaaattctattcaagattgagagaaaaacaaacaaacaaacagagcagatatgctgtaaatcttgtcatctgctaggaggaggttaaagaagagaaaaatacaagcctttgaaagttagtatctgagaaagcaaacatgtccgcagtagaggacaaggaccacatggcaagggtagggagcaacttaaggaaaagtgagaaagaggaccagagtgttgcagaaagcatgcccaggctttgaccagtgtttgaaaagaatagaaagccttgtgagatggagaatgcttttaatctcggctcttgtgaatctgaggcagctagaagtttgaggtcagcctggtttacataatgagctccaggccagacaaggctatgtagtgagaccctgtctaaaaacgttgaaaagaaagaataggcaaaaggaaaattccatcagactacatgacaaagtaaccacagtgctgcatgatagttggccctgcaagtggctacacatgtctgcatcctatttttaataaatatattacaaccaaaattttaaagggaaattactctgcattacagtaaattttgctatgctgcttatgtttctaatatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactacccagtgaggttggtttgtgtctgtctcccccagtgattgtgtgtggtatctcgctgtgaacagttccatagtgataactataatagggattgtaaggttaaaatgctcaaagtaaatatttaaaatttagatcttggaaatgcaacttgcatatagcatgtatataattaaaatttcaaattaatgcaaattcatgtgctaatgacccattctgtaatctgctttgcattttaaagtttctttctattaaaaaaaactattttaacttcatatattatgtataccatctcatccatctgtcttaatgaaaaatattcctgatgtcaacagacagctcatgtaatggattttctgaaaagttctacctggttgtgatagagtgtactgaagacaaccgttcactgttacgcatgtgggatttacacttaaggtcaactcctgtctcactgggtaagtctactttgttttttgtatattcagatagacctgcacttcaagaaagtatacatacacaagtagaaaactttaggccttttttattttaaagaaattcatttttacttgattacataattcattacacaattcatgaaatcctacatatttaaccgagaaacaattttacaaactaactatatgtattcttatacgtaatattaatattaatgtatatattaattattcaaagtaatgggtttattattaccttttcgtatatgtgtatagttacttggccatatccttcctctcacccttcttcttcctcctcctattatcttttcttgaacctatcttccttcccattgtttatagagtgagttttgaaaccatttttatatactgctgataattatagtttatttagaatactgaaagtaaaacagctttctttctttttgtaaatagtcactaatgtgtctacaatgttatcttttatatttcagctatttatttaaaagtagtgattacaatacttattcgtaaaggattccctcccagattttgtttttgtttttttattttatagatgaaagaatagacacaaaaatatcagaagctagttggctaccagaagaacattattcctcttctccagagaagattctatctccattttcacagaaattccaggcttgcagagctaatctccagagtaccagcaaattgtctctcttctctgaaatggtatacagcaaagagttggatttgccagaaggagttgagataataagtgttaagccttcagcaggtttgtacaatttaccgaaagagactaatccaactttgtaagccttgaatgcttaccagggttttaaaaagtaaatactgtacctcactctgaagtacatacaaagcagtatgtactttgaatgtacattgaagacttactatgtttttaggttatatgacatttgtcagccaactctatttacttttcttactgcttggagtaaatatctgaaaaagcaacctaagaaaggtttattttggctacagttccaaggtaaagactatcatcgaaggaacttgaactgtctggtcacaggaaacagaaccatacatacatggatgctggtgctcagctcagtttactctttgtgttatttacttttctattgccataatagatcataccattgatcataggaaacatataattagacttaacattttagaaacttagagttttatcatggcagggtggcaggacagtagggcagcaagcagcagcttgcctggaacagcaactgagaattcacaacttgaaaagcagaaaacagagcacactgggactggcccaagttgtagaaaaccttacagcttcaccttctgtgacacttccagcacagccactcttcctagtccttacagttctaccaactgggaaccaagaattcagatattccagcctccatgagcctttctcattcaaaccaccacactcttttgttcagtctaagaatcagcccatcgaattgttttaccaggtttagagtgggtctgacttccattaatggaacctaaaaactccctcagaaacttgcctagacctttgtttccatggtgactctaaagttgacaaagttgacaaaactatcacattagacaaagtgaaagtttataggtggttacaaacattaccccatttgccatctattttagtatttatagtagtttctggagccatgtgctaataagatagaccattcaaggtgcctgaatcatcacctttattctaaggcatcattcagactgcattctgagaatgctatctctggacctggagcagcagcattctgtgaacttgttagaaataaagttactgatttgtgcacagtggcttagtgcccagttatctaataagcatttcatgtatttgatctatgtgtatcaataatataaaacaaaagtctttatttttggactgcttataaacaggagtatctcaaagtggtcttaaattctccaactcactcattttattcagccttccaagtgcagggactgtagtcactccaaactattctcaatcacctatttattaagtaatcaaattcttatgagagtatgacactttatcacaaacactaggttagagaccagcaagtctgatgtaagtaacaagtactgtggtgacttttgtgttttcaggtatagagtcagtgtgctaaggttctaaacagtggttatcaagctttctaatgctgcaaccctgtaatacagttcctcatgttgtgggttaccccaaccataacatttcattgctgcttcattactgtaatcttgttactgttacgaattgtaatctgtgttttctgataatcttttggcaactcgtgtgaaggtggtttaactctcaaaggggctggatccgcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaacaggtatttgttttatttcataaaagcagcatgcaatcaaatccggtttattcctgtaattcccacagctggaaggcgaaggcagaattgctgcaggttcagtgctagcctggtctacatacccaattccaggacttcttgtgttatatgaggccatactaaaaaataaaaaggtgtttagggagcatatggtgaaagcttttctagggtgagatttgtttatttattcagtaaattgtcttggaaaggattaaaaatgtttttattcagtttaaaggaattgacaatgaccttaaaggaattgtaatgttacatttggttaaggctttaaagttacattagttaagatgatatgtgctctaaaatatggtatagagccttatgggattgttcagtggataaaggtgtttgctattaggcctgacaatctgttaatctactgttaatcccagaactgacattcagcatctttccttggtcacttgtatctttctttaagatgtattttaaattatgcatatatgtgtggggtatgtgcatgtgaatgcaggtacctgtgaaaggcagcctgattctctgaagcttgagtttcaagtggttgcaaacttcttagtttggttactgagagtcagacttaagccatctggaagaatagtgtgacctcccttacctgctgaactctctctagctttcctcctttactttttgaggcaaggtctctcactgaatctgaagctcaaacatttagctaggccaataatcagccaaactacctctttctgcccacttatttctactccacaaggctaaagagctgctattcccagcttttctttttatatccctaactgttatttccttccttaaattccatttatatgcacttctaccatgtctctttatttttaataacccatttagtccagtcagtgctgcctatatatgcacacatatggatattggaatcctaccaaggtcattaaaagaatgattctctgtccttcagaaacttaaccaattactcatagctcctcaataaggagtagtacctagatactatctactcaccactgccagaatttcagctgttttgattttatgcaagtaaccacgggtgattttgttcatgagtgtgatagccatgtcatatccagaatatagcatttcacaaagctccccctcctccagctgactcttagagtctcctgccttctcttcagtgatgttccaagagctgagaagagggaacttgatatgggctgagcacacagtctcttattagcacttggaccaattgtgcatctttccatagactgctgcccgctgcaaaaggaggtgtctctgaccaaggttcagagtagcctaggttatagatataaacagagatttaaccacatgaccacctaataaaataataatagcagctactacgcctgttcttttgactaggattattgtaccagacatgaaatgtcttcctttgtagcagacttcagatcctatcagtaagcatttagttaccctcgctgataggtcagtattctgacaagcatggtccagagttgtcttgtctcacccagtatcctgcacagcatcctcatactgtgcaagctcaccaccatagaggaatttttctactcagttttagactgattcctctctatcctaaaccagtgtgtacagtgtctatttcattgtggttggtcatcaagtgcatcatcatgtactatttcgtagacttctaaagcctttctgacaatgactagtagggaggtataccataccttgcactgtcatttttatttaatagactatatattctgggagtgacattgttctcatatgtaggataagtgcatttgatctcttttaagttggtttttgacaattagcttactaaccagtgtgtttcatgctcagcttttcgcatgggttctaaatactcaacctcagatccttatacttgtacatcagacactgagtcaactgagccatctccccagcccagttacctacatttttaaataaatttggtaatatgtagttataatcatttgtctactattgcatatatttgattttatacaatgaaaagttgagtagctgtaatagagaacttacatctgccaacgcctgaagtcgttatcactgtccctttaaatttgacaatctattttgggaaactaatagaatatataatttgtttaagtctgataaaatattaagtttcacttaggaataaattagtgctataaatatacttcagtattataagactttggggatataaactaaatatttagaagacagcttaatgatatgtcaggttaccgaaataatatcagttctccactcgggactaacagtcaccatcaccatgtggttttgatgtggttttcagtactaataagagaagtctctatttctagtgattagtggtcaacgtagacccatggctgcaccaagtactgatagtaaatggtagatgagtgttcaaatctaagaaatatattatctccccctaaagctcagggaaaattgcagaaggaggcggggtgtaatataaaactagcagataggaagaaggctgcggaatgtcattctgggcaagataaatttttggcaattgtaggtgcccatacagggtttgtatataaatgagtctctcatcaagtcaagcatggatggaggagggactgttttccactgatagggtcagaaaggggatatcattgccttcaagggctccaatggtaattttaatccactagtgaaatagatggccttctttaataagctagatggatcaaaaaacaaaattgaaagccgtgagccttggaaagacactggtgaatgtgagtggggagtgggtggtagtgatggaagggagacaagagaaggtgaggagtatgagggagagaatcagaatgtattatagtacaagtgtacaatttatcaaataataaattaattaaaaagaaaagataacaaaactgtaaagtgaccatttagtacttagataaggattggccgtcatactgtttctctctgtgtctgtctgtctgtctgcctgcctgcctgtctctgtctctgtctctctgtctctgtgtgtgtggcatgtgcctgtgtgtttaaacacatatgtcaggacaacttaaggaagttgattcttttcttccatcatgtctgttctgagaattaaactcaagattgtcaggcttggcagcaagtattcttactcactgtgtcatcttgacagccctgtagtatatagcttattggtatcattaaaagccaggttgttaacatcttgtgttttttaacacattttcagcaaaacagctaaaactttttttctatttatttatttatttattatatgtaagtacactgtagttgtcgtcagacaccccagaagagggagtcagatctccttatggatggttgtaagccaccatgtggttgctgggatttgaactcaggaccttcagaagaacagttgggtgctcttacctgctgagccatctcacaagccctcaaacttttaatacatagaaaatataagtaagccaggcagtagtgacacatgactttaatcccagcacttgggaggcagaaataggtgagtctcttgagtttgaggacaaagtggtatacagagtgcatttgagaataatcaaggttacacacagaaaccctgtatcagcaaaaaaaaaaaaaaaaaagaaaaagaaaaaaacccaaagggggggaaaaaaacagtcattaccagaatttttaatggttcattttctttccaggacacctgagttcatcttccatatatcctgtttgcagtgccccttatttattggcaacttcatgctcagatgataaagtaagattttggcgatgcagagtaacgaatggagaatcagcaacatcaaagaatggaaaactagatgttgtgtatgtttgggaagaatggccattactcattgaagatggacttgagaacaatagtagtgttactgtccctggtagacctgtagaagtgagctgtgcacatacaagtcgcttagcagtagcttataaacagcccactggtaatagtagatctcaggaatttgtgatgcatgtaagtatctttgaatgtgagtctacaggaggctcatgttggatccttgagcagacaattcatttagatgagttaagtacagtgttggattctggcattagtattgatagcaatttagtggcttataataaacaggagacatatttagtcagtaaagaaagtattacatcaaacacaaaacatttggttcacttagattggatgtctagagaagatggttctcatatcttaactgtagggattggctcaaaactttttatgtatggacctatggctggcaaggtacaagatcagactggaaaggaaaaccaggcatttcctctctgggacagtactaaaattgtacctctttctaaatttgtactgttacgaagtgtggacttggtttcttctgtagaaggtgccccaccttttcctgtttctttatcatgggtccgggatggcatccttgtggtaggaatggattgtgaaatgcatgtatattcccaatggcagccatctaataaacaagaacctgttatatcagagtcatacaatggaagcactccatctatactaagtttaataaaacaaagtaactcatcaagttctgggctacatcctccaaagaagactctgactcgatccatgaccagtcttgcacagaaaatctgtggaaagaaaagtatatttgacccctcagtggatatggaagattccggtctctttgaagccgctcatgtactttccccaactttacctcagtaccatcccctgcagcttttggaactcatggatcttggcaaagttcggagagccaaggccatcttgtcacatcttgtcaaatgcattgctggggaagttgtggctctgaatgaagctgaatccaatcatgagcgccgccttagatctctcaccatcagtgctagtggaagcaccaccagagacccgcaggcattcaacaaagctgacagcagagactacacagagatagactctgtccccccgcttcctttgtacgccttacttgcagcagatgatgacagctattgctcatctttggaaaaaactgggagtgagagttccttaaagaaatcaaaacagttatcaaaagaaagttatgatgagctttttcagacttcagttctgatgtctgataatcacatgttagaaacagatgaagaaaatactcagcccagagtcattgacctttcacaatacagtccaacttattttggtcctgagcatgctcaggttctttctggccacttacttcattctagcttaccagggctcaccaggatggagcagatgtctttgatggccttagccgatacaattgcaactacaagcactgatattggagaaagtagagacagaaatcaaggtaaaagtaaattctgtacaagatggaaagaaaaaagatagttttacttgttttttaagagtatgatcttacataaaatgatacggtgccttttttaaaagctaatataaaaatttggttttttttaacacttttaactctgataaatagtttagtctgtaaattatagtactatgataaagtacacagactcataacataactcataactcatcattaatgatctgcttgctacaaaagatccagctgaatccttatgagtttagcaaaagtacagattttaaatagcagaatttaagtatttctgtttttttccttctgtgggaataatccactgtaaaaatttagagtgattaaggacttttcagaaattaccattattgtgtatgcctacctagaataacaaatataaacacagcaaaatgagatcttttcatcacttagagaatatttttttaatctaaggtataaacaaatttaaatggaaattttccattatatctcaaagcttgaaattaataaatttattattttaacccagatattggttagtaggatttgccattgaactaagcttggcccccccaaaaaaaaggattcaatttgacacaaaaatttaataaaagtttttaagaaaaattagtttacactttaagggcatcagtagtggttactaatcttatttgactatgttatgggtaatttaatatgtttaatgaatatattgttatttttaatcatttaaagtaaaaatcaggactcaattttcatactgttagcaaaaactatttcctccagtgttacagctgaatcctagaatgcagatatgacttgaatccgtgtagtaaatgacatagcacagaaaacataaactccttaaaaataaaaggttcaaatcaaatgcagttggattataaagaatattagccgggcgtggtggcacacgcctttaatcccagcactcaggaggcagaggcaggtggatttctgagttagaagccagcctggtctacaaagtgagctataggacagccagggctatacagaaaaaccctgtctcaaaacaaaacaaaacaaaacaaaacaagaatgttaatagactctaaatcaatttattctcatctttatttaactttacttacttagtcatgctcttttccctataatataaaaattgcttagtaaaaagaaatattagaaaatatttaagagtaacaaacattttgccagtttaagaatgttttattcttatatgtggtagttgtgacatatgctgattctactcattttttagtattttatgcttataaaattattttttaaatatttttttaaaatcacaaacacctttttttttttctggtcataggtggggaaactctagacgagtgcggattaaagtttcttttggctgttcgactccatacctttcttacaacttcccttccagcctaccgagctcaactccttcaccaaggtgattttgataatctaaatttactttcccgtagattttgaagtattaaacatgttttctgcatatttactggtaattcatattcttatgattaatgtctttggatcatttactgacttttttatctactaatatattttttctcacatagtatatcctgatcacattttctcctccttctattacttccaattcctccccactgccctcccaatctggatctaccccctttctgtctctcagaaaacagaaacaggcttctaagggatgatacaatacaatacaatacaatacaatacaatacaatacaatacaatacaatacaatacaatacaacacaaaagataagacaaaatttaacacattcaaataagacaaaacaaagagaaggaaagaaaaaattacacaagaaggagatataactgcagagaccctacccatttacatgctcagaaatcccataaaaacactaaactgaaagccataattcataatcagtgggcttaaaataaaagtgaaaaagataattaaaaaaaagagtaataatgtcccaacatgacattatgagacacagaatctccaaagatgtaattgagttcattttctctattttctattgaacatctactgctgtgcctgcagcctaccctcaagaatagtttgtgtccctagtgagactcctttggaggatactacattttcacttgcaagtggatgtcaattggagatagcttctgggttagggatgggagcatgtgtcctcttctcctttcagctctaggacccaatctagtacaaacccaggcaggccctgtgcatgctgccttgctttctgtgagttcatctgtgtgttgatcttgttaatttagagggctttgttttctatcctccaacccttctggctcatgactttcttcctcctcttcaggtactctgacccctgagggtttgatagcgatacctggtttagagctgagtttgactgtttgactatgggtatctatgtttgtatctgctgctggaggaagcttctctgataaccgagcaaggctcttatctatagtgtaatgtcatgagaagtcattttattgaaacattcttttagtaaaatattagtatttgctttcatcctaggtccccatgctatgtagtctcaggttcttgatcagaacctaatcagagtcgagtatcagttccatctcatggagtattggttggttactcctgcaagctttgtgccaccattgcttagtgtatcttggagtcaagacactgttgtagatcatcaggtccgtagttgggttggtgcttatgtcttttctttggtagcatgcagagtacttttttttagcaaagacaataatatataggggtgaatgctctagctaagtgctagtttaacttttctatgtccagtagttatgtaggtgttgtcttctgcggtgccatctgtttgttgagatcatagtcttggtgtcagtatgggtttggggattcccctttggccaacaacccaattagatatagcccagtcccaatactggaaaattaattttgtgacaagagatgtccagttgagacattgtctctccattatttgattttacttagatcatacttcttaatgccacatacttgtttcgagtgtaattttttatttttcttgaggagctttcaagtgtgctgctaagttacttgtatgagatctctcccatttttttaggttgaaacagtgctgtgaatttgcctcttagaaccacctttgtgtcacataaatttaggtatgttgtgtgttcatttttgttcaattctagaaaatctttgattctttttcttaagttctgtcttgatgcatttttcattcagtaatgagttcatttttcacaggtttctgagttctctgttgttttgataaccacctctaaatgatggtggtacgataggatgcatagtatttcagtcttcttgtatgtgttgacatttgctttgtgtccaagtatgtcctcagttttggagaaagttccttgagatgctgattggaaggaagtattgttttgtgtttgggtgaaatgttgtgtaaatacctgtttggtccatttggtttataacatcagttagctccatcatttatttctgcttgagtttgtctggatcacctgggtattgggaagagagaaattgaagcctcctgtcagtatgtgagaattgatatgtgaattaagctgtgtgtcttttataaatttgggtacccttgtgtttggtgcattgatgttaagaattgacagtgtcctcctggtaggtttttcctttgactattgtagtgtctttccatatctcttctgattagttttgatttgaagtctattttgtcaggttttttttttttttttttttttgcttgcaatatctttttctatccttttatcctttggtgatgtttgtccttgatgttaaggtgtgtttcttggatttagtagaagagtagatacgattattgtatccattttattactatgtgtgtttttattgggaaattaagaccactgatgttatgagaaacaaatgatcagtgtttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagttgaggaggaaagggtttattcagcttacattttccacattgcttttcatcaccaaaggaagtcaggactggaactcaagcaggtcaggaagcaggagctgatacagaggccatggagggatgttctttactggcttgcctcctctggcttgctcagcctgctctcttataccagcccagagatggcaccacccacaaggggacctcccccccacccccacccccttgatcactaattgaggaaatgccccacagctggaactcatggaggcatttccctaactgaagttcctttctctgtgataactccagcctgtgtcaagttgacacaaatctagccggtacatttttgtatgcctagtgcttgatttttatactctgaaggaatttcttttctggtccagtctatttgatgctctgtatgcttcttgtatcttgatagacatctcgtctagattggggaaattttcttctgtgattttgttgataatgttttctgtgtctttgacctggatttcttttctttcctctatttctattatttttagacttggtcttttcacagtgtggcatattttccagaggttgaggattacaacagttggtggtctcatctgaccagctctctcctggcgggatttgggtatagagatttgtggcacagggtcagctccaggctgttggtaacatgcagaattataggttgttttggcctgctttgtgctctgcgagtgtctgtggttttcattaatttcagccactattgcttgagaaatttgttctccttttcctcctgctggtagctcaactatacttaataacaaaaccacaattcttcatattcttacagtttcatttgactgttttgagcctgctgatgacttcattggtggcattcttgtttggttggtttttttaaagatttatttatttatgtatatgagtgctctatttgtatgtacacctgtgtgcagaagagaacgtcaaatccatatggttgctgggaattgaactcagaacctctggaagagcagccgatgctttttttttttttaatttacattctagtcattgctcccatcccccagtcctccctccacagttccttatcctattccttctcccccttcccatctcaccaggcctccccacttcgctggggcctcaagtctcttgaggattaagcacatctcccactgaggccaggccaggtagtcctcttctacatatctgctaggggcctcagaatggcctatgtatggtcctggttggtggctcagtgcctaggagctccctgaggtccagattagttgagacttctggtcttcctatggatggggtcctttccctaattcaaccggagggatccctgacttcagtccaatggttgtgagcatcagtaatagtgtctggccttcatgtccctcccccacccttaagtttgattcccaagttgggctggtcactggaccgccattccctcagtctcttctccatttttgtccctgcagttcttttttttttttttttttttaagatttatttatttttttattatatgtaaaagacactgtagctgtcttcagacactccagaagagggagtcagatctcattacggatggttgtgagccaccatgtggttgctgggatttgaacttcggaccttcagaagagcagtcgggtgctcttacccactgagccatctcaccagcccccctgcagttcttttagatagtttttttctaggtcaaaaattttgactggtttactaacccagttcctctacttgaggcccatctgtcttctggaggtggactctttgagtttactctccccaatgttgggtattttggctaaggtcacctccattgcgtcctgagagtctctcatctcctgggcctctggcactttctagagagtcctcccaccctctccacctaggtagcttattttcattcagtctcctggctctctggccttctctcctgttcccccacccctccaaagctgatccttttccccttcctctctcctctcccacacaggcccctccctccctttggccccatgattattttcttcccacttctaagtgggattgaagcatcctcatgtgggctcttaactgctgagttatcttagccccactggcattcttaatatacattttgatttctactatttcctttagatatttattagcttttccatctgcttatttttagtgattttttaaaaataaaggtattctttatactgcatgccatgcagtcatccttccaataagcttataagtaaacagcacaatattattgaccgttgtatagcagatgcctgtagagcttattcatcttatttggtaaaacttgctgcctaatgagtcccctcctctcagtcactgcaaccacaactctactttttaattccatgaatttttttctttgaaatatctcttgtgagtagaataatacattttatcattaatgtgattattgttaaattattagtataatatctgcaaatcttatttgtgttacacattgcagaatttcgtatttcattgtgtatgtaaatcatagtttaaaacccattcttctgtagaagcacatttaggttgttcccatatcttgactatagtgaaccctctagcagtaggaatagagcgctaatgtctcatcaatgagaagaaattattctgtagtatagattaaaaatgtgaaaccacatatgttaaaatcttatgacatcatttattttgctcaataatactagaaaaaaaaatgtagtatgaaaagacagattcagggctggagaagatggctcagaggttaagagcactgactgctcttccagagatcctgagttcagttcccagcaatcacatggtggctcacaaccatctgtaatgggatccaatgccaccttctcatgtgtctgaagacttttcctgaaacaaagatataaatctgaaagggaaggaaggaaaggagggagggagggagggaggggaaagaaaaagggaaaggaaagaagtaagaacagaatcaaatctgagcaatattacatgtactgatcattagattattgacacagatgttacacatcagtattaaaacatcaatatggtcgagcagtggtggggcgtgcctttaatcccagcacttgggaggcagaggcaggcggatttctgaatttgaggttagcctggtctacagagtgagttccaggacagccaggactaaacagagaaaccctgtcttggaaaaaaaaaatcaatatgataaaacagcataataacaattgttatgggttaggttgtattctatattcctttattttattatttcattcaatccttaaaattgtgtaatagcatagtgttctcattatgcacatttttgatgttgttttgtttttttgagacaagatttctttgtgtagccctggttgtcctagaacttatctttgtagactaggctggccttgaactcagagatttcctgtttctgccttctacgtgttgggattaaaggcatggaccaccaccaccagactctctctctctctctcttttttaatgatctgttcatttttatttgtcgttgatgtttggcctgcatgtgtgggtgaagatgttagatactctggagctggtgttacaggcagttgtgagcttccatgtaagtggtgagatttgaacataagtattctaaaagagcagccagtgctcttaaccactgagccttctctctaatcctttatgtacatttttttccattttttattaggtatttagctcatttacatttccaatgctataccaaaagtcccccatacccacccacccccatgaaatcttgagtcattaaaaaattaagtaactttcccaaggtcatatttttttaatagttctcagatataatgtgtatgttctaatttgggagtaataaattgttatacttagttggagttttacttttatatgattgaaaggagttctttaattctgtctgtgctattagaacatctaaaaaagatgtttacagagaaaagagaagcaatactgaagaaaaagcacaccactatgtagtaacagcacttcaagtgcttctgatagtctcagccaaactgtgagagatagccatagaacaaaatactgcagcccagtgacatttcccataagtattttgttggttcaaagaaatagattttaattatgtgcattggagtggtatcatttgtttagagaatcaagaataaaaataactcatagtttaggaacaataaaagttatatgtaactatgataaaagtttgaaagagtacttcttattgacccatgtaacaatctgcagagttagtaagacagatattttccaagggcaaaaggcttgttctgagagagccaagactgtgcaccagagcatctgatttccagttcagacttgttaccatcacagttttaagtagccatagatagaatatgcctagaaatgttttcttaaatcataaacgcaggatttgtacttatgatgatggttccttaaaattctgtcctttccacttagactttatgctatatccaagattttattcttaacatgttatgataaaaggagtctgcaaagttaaagaatatgccatattactctgtattttaagcacccagtttgtttactatgtaccctgacatattaaatgagattatttggagttatttatgccaatatttaaaaatttaaaacagtttatatgtttattgcacaaatatcatatacatttatgatgatcatattaaatatttgcattgcttttaaatgtcatttttggcttttcctcaggcctttctactggtcattttgcttgggcttttcattcagtagcagaggaagaactactgaatatgttgccggccatgcagaaagatgatccaacttggtctgaactgagagcaatgggtgtggggtggtgggttcgcaatgctcgcatcctgcgcagatgcatagaaaaagtaagaatttatttggttataaaaatagtatatttcgaatacttgtttatgtcattctgtctcctctaatattagtttattcccttttgttttagaaacagcttcatagtttgtgtgtgtgtggtattgggtattgatcctggtgctttgtgaatgctaggcaagcattgtatcagtgagcagactccccagcctagcctactttgggttttttatatttaatggtctcacactggttttcaatgtataatccttttgtctaaaactcttgaactgttgtaattctaaacctcagctgctagacctagctatcctcaaactctagtttttaatcacatttatttactagtgtatttccgaatttctgaagtgtttgttgaaaaaaatacagtagtttagccatatatattttgctaccataaatgcttctattactggaattatgtacaacagtatttgtacacttctttaaattttaacatagaaataacacatactaatcttgtatgtaagagaaattatttgttcactcacaagctacttctgtaaacaattgactactgtttcccaattataggtagccaaagcagcctttcatagaaataatgatcctttagatgctgcaattttttaccttgcaatgaaaaaaaaagctgtgatttggggattatataggtaagtaaatgactgcttcccagctcgaagtcactctttactttaagtgaatgcgtaaagtaaaatatgcttttagtgatatgttattagtgcttttgtgtttcatacttcattgggaaaaaattacatgtgtactacagtggaagaaaccagttgatgccccttcagtttgttttagcatttgtcagtctaaaaacatattttctcccttattagcttattctagagacatttccctcatcaccaagaaggagggaggaaagaagtggaatagaaaaaaatttgttgagatgaattttcatcagctttctggaacatggtagatagtgaagtctggcatctgtcagataagcgtctttcctctgttactgaaggacatggaccaggaagtccctgaaattgttactcttgatgctgtatctttttcatctcacttgtcaacagcacctggactccatgatttccattgtttgtttgatgtcctgttcaagaatgacaatctctgggggaaatttttgatatttaatataagtttcctaagaatctaggtttttcagtattattttctatcagagcaggttccattatttgaattttggactatgtaagtcatttctacatgactagaacaatattattgaagagattttaattttgaattagcataaatgttaatgtataaattatctttgtataagtatatattaataaaattttgcatgagtttaaaggtgatttttttctgagttatgctagtatacttcactttgcaatttgaaagagaatttttaaataacttctgtggtttacctataaaagtaaatgtttatctaatcttaatctgctggtaaagatgtagatacattggaatttctgaactggcaaaagttttgtttccattgttataacttttatcgtaactggatcttggtgtgtgcagactgtcttcaaatttgctgtctttctccttgaaactcctaactttaatgttctaaccggaaaagggtgattacaaaattggattttaaaattttcataactttcattcatttatagatctcaaaaagacaccaaaatgacacagttttttgggcacaattttgaggaagagaggtggcgtaaagcagctttgaaaaatgccttttctttattaggcaagcaaaggtttgaacattctgcagcattttttcttctaggtggttgcctcaaagatgcaattgaggtaattagtttaacttctttttcaagtagtgttaccatttctttaaacaatctaaatcttaaatttttatttttatttttactatactagaaataatacaaggctaagaacataaagtaactgataagatttcacagtagcttttttatttttaccatgtagcttatgatatttttatataactgggataaagcagattttgtaaagtaagttactcatatgactgcacattttaagtatatttggctcttttatttggtggagttaaaaaatagctttttaatttgaaaactactctgattagatgaattgaggagagttgaagtttaagaggaataaaataaaattataggtttaattgaaactagatagaattatccattacctcaggtgaaattagtttataaatacatgttttagtaataacatatatttggagatcttatcagtgttaatttactaatgtagataatatgcatgccattattacatttattacttgctaaatttggagataacaaatctttatacatttatagtaaataaattaagtttcttccaaaagctgactttgtttataaatattttttatttataaatgttttaaaggtatgtcttgagaaactgaatgacattcagttggctcttgtaatagcaagactatttgaatctgaatttgataagtcagcaacatacaagtctattttacgcaaaaaagttttgggaattggttctccagccagtgagctcagttcgtcaagcataaatgcacatcatgacccctttcttcggagtatggcacattggattttagaagattatagtgctgctctggaaacattaataaagcaaccagttacagaggatgaaggtaaggtgctcttgcaagattttaataaaaacgttactggtgttttctcagcatgtggtccactgtttaacgtaacatacaatattaaatatttggtctttgtgactaaatggggttttgttctttcagaaagataaaccatttaaaacaaagaactttagactttctgtttttatgaaatgtattaaacatcagtattaccaaaatttggattttaaatatggtaaatataaagtgtaaaaatatgaagccaatttttaatattaggttgggctattacacttgttaatcagttttataatttttacaagaaaaacatactgagcttaaagaaagctaacttaagtaagaggtgtgattagggaaccttaaactggccacatccttgactggttttttcctgtgagcagtaggatagagagattaaatgtaccctttagaactctacttctggttttctttttttctttttttgtgagacattcttatagcctactataaaagtacattcttctgtgaattcataaaaatggtggggtttactttcccaggattttcccctaggcaggattgaactatatgtgtagatgatatagtagtgcattattttaacagtaagtaaagtagcttctagttcatgttgtttaatgtgccactacatatgtggtttgtggtacttaggatatatgtatctttttaaattaagaagaaagctatgagactcaagtattcaagtctcttagccatgtaaggtaaagtttcatactggcctcttcataattgaggggaaacatcactttattaatattgtattaaaatttttatttaaaacttacatgtttttctgtttttaaaaataagtgaatattaatgcaagatcacatatccctagaaccatgtaaatcagagaaaagtgatagtagtggtttagttcatgggcagtgtgagaagactacaggcagagacaagtatttggctataggataactttagtgtagttaaaacacaggtctaagtttgatatggagtgccgaagaattagaaattaactcctgggtttttagcttgactaatagtgaatgatatgatggaatgttgataaaattaggatgccttctcaagttagatgatatttggtcaaaggactggttgactggcttaaataatgcaagtcaatcaaaacagattgcacaccaaataagcccacagggcaaaagtgtttgtatttaagtgaaaacgaactatggaacttggaaagaagagatagagatgttcaacttaacagcatagagatggtgtttaacatcatgggattcttaggagacagaatatagcttctgtggtcagaaaagatgaggtctagacaagctgactgaagaggcagcaagcaagaaaagagctaaggattctacttgaagactttgtttcacttggaaagtagtatggcctttggttaactgtgatataaaatattgtttcctctgagagcaaggggactcttatgattacatattctcagttcctatcgtgaagttctcttgattcatcaaattaatttactttcagatcaagtcatgatgtcagcctgtaatcctatagtttttaatttctacaattacctaagaacacatcctcttttgctaagaagacattttggatcatcatcggaaacattttcaacacacatgactttagcaggaaaaagtggactggcaggaacaattaatctaagtgaaagaagattattttttactactgctagtgctcacctaaaagctggctgcccaatgttggctttggaagtattgtcaaagatgcccaaagtcagtaagaaagcaaaaccgtgttgtagaggatctagttttttaactagtaaagattcttcactaaaattggatgtaagagaagacaagtgttgtgctgctgactggtcaccgtcgctgacaaatggtcttgaatcttcttcagagggttcctcagagaggcactcacattctaccctttcttttgattggagccaaccgagtgtggtatttcaagatgactctttggagttgaaatgggatagtgataatgatgaagaaaatgaagatccccctatttcaatgaaagaaataagacctttgcagagaaagacagttaaagaaatagatgaattgagcagttacacagactctttaagcacactagatgaaaatgacattttaaatccatcagaagatataattgctgttcaactaaaatttagagcatgtttgaagattctcaccgtagaacttcgtactttatctactggctatgaaatagatggtgggaaattgcgttaccaactctaccactggcttgagaaagaggtagtagctcttcagaggacttgtgacttttgctcagacgcagaccagctgcagaccacatttagccagagtgcagatgaatctggatcaactgaggatgctgatgatttgcatcaccaaacaaaagtgaaacaactgagagaaagtttccaggaaaaaaggcagtggctcttgaaatatcagtcactcttaagaatgtttcttagttactgtgtgcttcatggctctcatggtgggggtcttgcatcagtgagaatggaattaattttacttttgcaagaatctcagcaggtatgtaccatttttgttttactgtgaggtgaggtgttatcatgtatctccagctaatatggaattccctatggagaccaaactgaccttgatctcacagagatcttcctacctctgcctctgcctcccaagtactgaaactaaaggcatgtgccatcacactggcaggtatataactttgaacagtcaaacagaacatgtggatgaaaggagaggaataatataattattttaattaaaaatttaaaagctttatttaaagaaaagaataatacatatctgaaatagcttttgaaattgtggtttttatttgaaatattaaaacttgcttttctttgttataattacgttaaggaatgaatctttgtgtgtagtcattaggaattggtggagctatgtacatgacacttgcagaacagatgttttgacttgcttaatttgtatgaacacagtcttatgagtgccttctgaggtaatgagctatactttattgaggggtgttaagggtattatcgttctagatgcagttgtagaagcattttcctcctcagatcataacaatttaaatatgtactttgagtgcttttaatttttaattttgaacacttttgaaagttactctgaattacttaaggagtagattataaataaaaatagttaactttttttctcttcatttttaaggaaacagcagaaccaatattttctaaccctttgtcagaacaaacttcagtgcctcttctctttgcttgtacagccagtgccaaaacagtagttgccaatccattattgcaccttagtaatttaacacatgatattctacatgccataataaattttgattcaccaccacatcctgatagccaaaccaataaagtaagtatgcttcatttcaagctttttttaaatcagcatatattgtctagataaaatgatgaattttattttagtatttttacatatttataagatattcaattgtattttccacatctaccttctgtgagatccctgctctacttgtgtatttattatttttctctctctggttgctcctttctttaagcagtccccttctgccttcaagtacttattttctgattctagttgactttgtttcttgagtttaggctttatttgccttttttggccttaagcattcatttccctctacagaatgataaaatgttaattaagcctttctagcaaaataaatgaaagcaccagactagacatagtatttactgtattaatgattctgagttaaggaaatctggctatagtccagacttactgtgctacttatatcttataggatgcttgaatggttttttttttcagtttagcatatcaattatttattctacacaaacacttgtgcagcagagatgacttagtaattaaaggaacttattaccaaacctgaaaaccttcattggctactttgcatgagagaagagaacagattactacagtttgtccacagtgtgtgtgtgtgtgtgtgtgtgtgtgtgtgtgtgtgtgtgtgtgtgtgtgtgtgtgtgtgtgtgtatttaattaattacaggagtccatgctgtatcacattattttttccttctaaaataccttttgctgctttcgaactattctgaaatagaactggctttaatttggtttcattgttggcgcattgtttgttttggtttgagctaacttggctagtgtcggaactcattcattcattcttccctggtgggcaactagatgattgtaggacaactttatttattttcttgtggttgacaagatttgaatatatgtgtctcatctttaatcagccagcaggcaagcccagtgcattaaactggtctctccagagaagtagaagtgataggatgtaggaaacgtggtggaataggaaaggaagaagagaggaaaaatttgtttataagtaatttgcatgtgtgactctcttaattattattcttttgttgtgcagagacaccctgaccaaggcagcttatgaaagaaaagcattatattgggtgcttgcttaaagtttcaaaggagtgttagtccatgatcattatggcaggaagtatggtggcaggcagacatggtgctggagcaatagctgtaagcttatatccttacctataggcaggagcaaaaagagagagggagataatgtgctttatatgagcctttcaaacctcaaaggccaccacaattgcaaacctcctccaacaaggccatacttcctacttcttcttaaacagtccaccaagtgggacccagacatcccagtatattagtctgtctgagccattctcccttaaaccaacgcagttactgtgaagtctgagttgctcaaggatttgcacatggtaagctagtgaatagaagaactgacagtatagttttagtctaggttcaaagcttaggaagttagttttattttaaattattattattattaatttttcttctttacactccagattttattcccctcctgttcctattcccaccctccaactgttccacgtcccatacctcctcctcctgtccccctccacaaggatgtccccatcccaccacacccccaccagacctctaaactccccggggcctccagtctcttgagggctaggtacatcttttctgactgaatgcagacccggcagtcctctgctgtatatgtgttgggggcctgttatcagctggtgttttctgcctgattggtgatccagtgtcagagatcttgggtccaggttcattgagactgctggtcctcctacagggttgccttcctcctcagcttcttccagcttttccctaatttaaccctaggggtcagcagcttctgtccactagttgggcgcaaatatctgcatcagactcagctgcttgttgggtctttccaagggcagtcatgataggtccctttttgtgaatgctccatagtctcagtaatagagtcaggccttggggcctctccttgagctggatcccactttggacctgtcgctggaccttcttttcctcaggctcctctccatttccatccctgcagttttttcataccagaacaattatgggtcagagttttgattaaaagagctcatatatcagttacattctgtaggtagggaaggaaggatgatgaccaaaaaaaaaatgtatgtatgtatgtgtatatatgtatgtgtatatgtatgtgtgtgtgtgtgtgtgtatatatatatatatatatatatatatatatatatatatatatatatatagatatatagatatatgcatatatatatatatattgtttcttatactctcctcctgataggtcttccaatgcattggtaagtgagaggtcagcctgtttaatcagactactgatttcagaaaaaaacacatctctctggaaatatccttagagactcactcagaggtttatccaagtgtttgtatacctcatagcccagtaacattttatttctgtttttttctttgtttgtttgttgttgttgttgttgttttacaaaaatctcagaggtttaagagcaatgagagtagattttgccaggacttttgagttgtaagctcagttctcacataatacttctgttcattggttaaagaagtcagaaggccatgactggagaaatagatgctaactatatactgaggagaaaatataagtcattgttgcctgcattttgccatattcaatataagctatttttcaccacaggtagtattgatagtagaagccaaagaagtaattagacttctatctatgaatacccatctacatgaaagacttgtgcttcataatcagataatcagataatcttgtatagtccagtatgctttcttgtaccttaatcttattcatccttgttttattatagctactgtcatcttaggttagaatccttttcttctttaaaaaatatttgactttactgcctttcttccttttcctttttctaaagtttccctttcgggtgactataatagatgttagcattttctttgacctgtacataagtgaactgtcatttattaatgtggcttattcatattttgttcaagaaaaagcaggtcgagttttaaagagtatgcttttagtacatggttcatattgttctgggaatacctctcttttggtttggaaagagagaattggtagtaattgtatattttataatttctaccaaagaactgagttttttctttaacatttctaaagaacaacttcattaggcagaaactatgttctaagggggaagagggagaagaaaaaatagctttcagaggcaaaatactcttcattttcatttcatttttcacaaaattatgcctaattttttttttacttaaagtaattattctgtgtgtgttcttacttttacaggtatatgtaatgcatactttagcagcctcactttctgcttgtatttatcagtgcctttgtggtagtcataactacaggtaaatgccttcttgtgaaatttaagatcactttcagtaaatagtggggttatctgtacgttattaatttaaaagtatacacaacactgcttttagtaactgcagaaagcgcatgactgagatgttgagtactttttcatctttgaaaattcatctttatacctttatgacaaaagaatcagaagccaactgttgttattatgatttgcttagttgtctataattaacactgccatcatgctagatactgtgatagactccgagaattgtaaaatgaacaaaatagtctttccttaagatcattattagaaacagttaaatgaattgatattaaataatacaatatcatacttgagtgattagttctatagtttggtatataacaaaaagcctgagacacaggagcaactgacgtgagattgaaaatattttcacagagtttctatttagaaatttctcttcatatttcaagtttctgtataatttcttaaaattcttaaaattgacatgatgatatatagtctagctttagttctttgaaatattctgatattatttagttaaatattatctgacttctattttctactcttaaagacaggtaatataacttgcgtgtccatctctcttttttttttcctccaaatgtcatgcattcttttatctactggtttcattttaaggcaaaccccactttcattttactagatattgatacattctagaaaattctgcagtattttctctttgagcagagttcatattttagaatttttttgcttggtttttttctttttactgaaaatggattctttctctgattnnnnnnnnnnnnnnnnnnnncagttccaccccccacaccctcacatccagatcaattcccttttttatctctcaatagaaaagaacaggcttctaaaagataacaacaaaacataataaagtaaaatacaaggaattcttttttttactttttttattttaagactgcagagttttttaaatgtatgcatattgattgtacatttttatgcagtacagtatgtttttggtttttttagagaagaccataagtaccaggtttgttgctggagttgctatttcttatttgcttttcatatttatttatttatatattttccgtttgttttgtgggtattttaattttgtttgtttgtcttaatgtttgagtacagtgtctgtatatatgcctacatgccagaagagggcatcagatcatattagggtagggaaattagttttattttaagtcctgtccctacttccagttcgtagtacttcctggtagtacttgttttacctgttaaggctagaggggccttttctaatcctttctgttcccttagttgataaattgagattataacaattgagctgtggtacctaacccaaatcatatatttaacacaaacttcacatctcaggctcagggaaagtcatgcaagtggaggcagaaaggttgttaagtgctagagaacccagattcctgctgcatgataggacttctagacataagaaggaagctaaagccacgagatctcagcaatattgtgcctaaacagcatatagaggggaatttctcactaccccacctctgcagatgaagatctgaaaaacagtcagtggcttctgagatagaatcagttttctctacgtacaaacctcttgattggttatccagtcccaactcatcagccctaaccactactaggactcagtagattgtatgtgtaaacacacacacacacacacacacacacacacacacacacacacacacacacacacacacggggagagagatacaaataacatatagcaataataagtcatgaatttgagagagtaggagggataaaggaagagttggaatgaaaagagagataattattatgtaaacagtacttacgaagttctctaaaagtatttttaaaaattaaatggagtaattgtggagagggttaagacttagagactattatatgaggtctacccatatcttcacaagaagatagataattttgtagtgaaatgagtccatacctcaatgtgccttagcttttcctacccatttgatagacgttttctcagttgtggagtgactaggaagttctgaactggtttctgaccttctttcagagggaatcaatccattgataaataattagggtacatccctaggtggagggaagtccggagattcctattccgctgtgtagtctctatctcttttaatcattctcccattttatacatcatctttgtgttttgactttagagaactttttaaaaatataacattcattttaaatgttcttgtaagtttgcttctgtgggtggagatgtttggtgtgtttgttatctcttagatggtatcagctctcatttgtattgacttttggttgtcagttcatctttataaactgtccatgggcaatcccacttttcactgtggttatatgtatgtgtccaaggtagcttcagttttatttctttgaactgaattaatttatgcaattgagtattagtttggtttcatcaaaatgtttctatcttcttgtcataaatctttctacaggcagagggaatttttattattaccctgccatcttaaatctgaaaaataaggcccaataataattataaaagtctcaaaatgtatgaccagtgagatttgccaagtctagccgtaaggcactatcattctaagtgtaaacaatataatcatttactcaatatatattataggagtttttgaagaactattttctagcacatttataagatctttttgctgctgggtatcagaatgttaaaatcctttatgctaagctgttatttgtttatctttccataagttcttaaatgtgtaatgattatcctctttgccttaatagtgtgatgtgtataatttcatcaacaacaatatgataaaaactaattaggttcgattcttccatcctaccataacttttatggaggtagaagctgttttctccattctatgctaagtgcctggttcagagccagacagtggatgagctagccattaaacatgaaattgagcctagactcacttcatttttttatcaaataagtttattttgttgttttgtttttgtttttgttttttgagtcaaataagaaccttaaattcatacatgcaagtttatttctagtggcccaaaatgatgtgggtttttttcttccttaaaatattccttatctttcactaaataaatatacttagatacttgtcgaatttgatttagtttagaaaatatatgtaggtatactttaaaggatactgtattaatagaatatagcactgtagaacatgtaacttaaacataatagtataattcataaataaacattttaaagtatcatagaaattgtatctaagaatgggaatattatatatgaaattcatcttaggtttcaatattgtctcctttcttagttcatttcaaacaaatcaatttactggaatggtttatcaaacagtacttcttgcccatcggcattctttgcgaactggaagtttggatgaatcagtaactcccaacacatcaccagctcaatggccaggtataaataatttacatatataagaattattttttgaaatgttaaatgataaaaagcaaacttgccttagttttaccagttgatgatcattgttaaatattgatagcattgacaccattgcaaattcaatacatattcttcagttgtattaaatttttagctatgagattttacgtaagtttatctgaattgaacaaatgtttcatcaattgctcctaaaaccacaataatctactaattatgaatccagcagaaatatatttaatatttattgagtacatctttttaaaaactcaaaaagtagaaaaatgtatttaatttttaacgttaaaaatttttaattttttgtcttgtttttgataatatcagctaattttcttatttgtcctaggaataaattttctaattcagcttttgaattcctctggggaagaagctcagtcaggacttacagtcttgctttgtgaaattctcacagcagtatatcttagtctgttcattcatgggctggcaacacactctagtaatgagctatttcggattgtagcccaccccctaaatgaaaaaatgtggtctgcagtatttggtggaggagcacatgttcccagcaaaggacaggcaaactcaaaagctttatctggtaagtttttattgtcctgttgtgcactccccccacaacaccccgtccgcctcccattctttccttccactctaaccttcctctcagttctgtctttataagctgaagctttattcattttatggtaactttgttaaatgtaattacatcttaattttatgtaagaaagttcttgttgtacaagaccaccaacaaatactattgtaaaaaatgaagttttaaagtttcttgtgcagttttcaatcttttagatattcctatactgataattaaactatacaatgtagttataatgtctcttagtactaaaatctttatttcttttgaaatacactttggttttattccataccaaatacagatttttctcttctttctttggcaggaaggcactttgctatgcctagccctcaccaggtagtggtattctccatggaatgtgtgggcttttccaaagctctttcagccatcagttctcatagccttcccactcttgcaggcaagatcttagctttagaaataggctcttacagtttagcttgctttatgttgttgtttttcaagggttgcatacagtggggtagtttgttttgtttggcatttaaggaaaattgacatttcttttaatcaagccatatttttgatttaaaacaatgattagcattttagaaaactgtttctgctcttccattaaagtttcaaatacttggtttttgatatttttttctgtcccttaaattataatatttctaagtgtacaaaacccaaaagaaacaaatgctagtgctgatcatagaaaatcacagtatggcttgaaatgattgggaaagcatttcccatgaggctgctttatggtttgcatattatgactggctattagagtttttaaatttctaagtgtttagaataccatgaaaagtaaatcttttaaataaatgtatccttttactacatatactatatttaaataaaattaaaacagtcacctttttgaactagaaaataattttcatgatattttctaaatcttttttttgtgatttattaacatatgtgatagtattggtttttcagttttgaagcttgtctataatactggaaatcctgctactttattgatattaaatttaaaaattattaaaatgtgtaaaattaaatcttcgagtataagtctgaaaacaattttaaatgctttttagaagaaacccttgtcggtacatatataagtgaagcccagcaagctcatctctgaattttactcctcaccacctctaagcaccgtacacctgcactcgttgtaggtttggatgtttatgatttagatgatgaggacttacagaaaaataaaatttgacttggatttgttacttttaaaacatcattgtgggagatgtaaagagatggcttaacagacagaagcactttttcttcagaaaacccaggtttgaggaccagcacccatgtggcagatgacaactgtctgtaactcacattccaggggaaccaacactctcttctgattttcccaggcaggagtcacaccaggattcacagacatattgcaagcaaaaagatgcaagtgaaacattcaaatacataaaataaatttgtaaaaaggttttcaaaaacattagagttcatactctgataaagaaatatttttagacctgaagtattcttctgtaatagaagaaagaaaagtggttattttcaatagtcattataagcagtaatggcatatatttttcacagagctataatcccatgattatagaacaaaattcttggcaacttagtttctactttatcctcacattgaaactatttgctcattttatctgccactctgttactttttaatccatatacgttcccttttcaacagctcaggagaggtaggatacagcctcaaataaacagggattaaattcctgatttttaatgctgagagtcaagcaaattcagttcataattttgagcgaacttcaggcagctgtgttggtacagagatggtttggtatcttgtaactgctcagtcttctcttgtagtaccacagtagcaatagcaaacattaagtaagtatggctgtatttcagtaaaattcagatataaaaggtcttaacccaggcatgatgatgcatgtc

SEQ ID NO: 500 - DNA, 5880 bp, Mus musculus
gcctatgcatctggatgtgacattgtaatactgggaagtaattttgaaagattacagatcatcccaggcgctaagcatggaaatattcaagtgggatgtgtagactgttcaatgcaacaaggcaaggaattttatagtcagtggcagaaaagtggccaattttttctggactcaatagcacataatataacctgggatcccgcaggtaatcgtcttttaactggttccagctgtttgcagctttggtgtaactcaagaaagcaaactgaagatgaaaatccagataaaacagatctgaactttggaaattggatgtgcatttggcattgcaaaactgcttcccaggtccacctaatgaaattttcaccagatggagaattttttgccactgctggaaaggatgactgtcttctaaaggtatggtataatgtagaaaactggcgaccagctgttacgtctccagataaaaattcagaaaaacaatcccaaggagaaattgacttttcttttgtgtatctggcccatccacgagctgtaaatggattttcctggcgtaaaacaagcaaatatatgccgagggcttctgtatgtaacgtactgttgacttgctgtaaagataatgtatgtcgtctttgggtagaaacatttttaccaaatgattgcttcctgtatggaagtgactgcaaccactggtgtgaaccagttagtttaacaaataacttaaagagaaatgcttccagtaaagaccgagttcaaagtgctctagaagtaaatctgagacctttccgtagaggtcggagtagatcacttgctcttgtagcacatactggctatctgcctcatcagcaggatcctcaccatgcccacaggaacacaccactgcatgccaatgcactttgtcactttcatattgcagccagcatcaacccagccacagatatcccacttcttccatctattacatccttgagtttaaatgaaaatgaagagaaatgtggaccttttgtggtacactggttaaacaataaagagttacattttactttgtccatggaagtcttcttacagcaacttagaaaaagttttgaacagccctcatctgaagccagtgtagaagattctattcaggcagatttaaaatctgatgaagaactggatgatggtgttgatgatttaaaaataaatcatgaaaagaaggaattggatgaagacaaaatgttaccaagttcaagttttacaccattatcttcagccgccgtcgatcatcagattgaagtgcttctgtctgaatggagtaaaaacgcagacatgcttttcagtatccatcccatggatgggtctttactagtttggcatgtagattggctggatgaataccagcctggtatgtttcgtcaagttcaggtgtcctttgtttccagaattcctgtagctttccccacaggtgatgcaaactctctttgtaaaagcatagtgatgtatgcttgtaccaagaacgttgacttggctattcaacaaggaaaacagagacccactggcctcactcgttccacatcaatgcttatctcctctgctcacagtaaatcatcaaataacttaaaattaagtatttttacccctaatgttatgatgatttcaaagcatgctgatggttctttgaatcagtggctggttagttttgctgaggaatctgctttttctacagtgcttagtatttctcacaaatccagatattgtggtcatcgttttcatcttaatgacttagcttgccactcggtattacctttattactgacaacgtcacaccataatgcattaaggacaccaaatgttggtaaccaaaagcaagctcatgatgctgtaaatactgaagaatgctccttggcacaacaaaataaaagcaacgttgatatggcatttcaagatcccaatgcaatttacagtgagcttattctttggagggtcgatccagttgggccactatctttttctggaggagtatctgaacttgcccggattaattctcttcatgtttctgccttttccaatgtggcatggctccctactctcatacccagttactgtctaggtgcatactgcaactctcctagtgcatgctttgtagctagtgatggacaatatctgaggttatatgaagcagttattgatgccaagaaacttttatatgaactttccaaccctgaaatttctaaatatgttggtgaagtgtttaacattgtcagtcagcaatcaacagccagaccaggatgcattattgcattagattctattaccaagcttcatggcagaaaaacccagttgcttcatgttttccaagaagacttcattttgaataaccttgagaagaaacgtctgggagtagataacattttattggattcagatgaaagaatagacacaaaaatatcagaagctagttggctaccagaagaacattattcctcttctccagagaagattctatctccattttcacagaaattccaggcttgcagagctaatctccagagtaccagcaaattgtctctcttctctgaaatggtatacagcaaagagttggatttgccagaaggagttgagataataagtgttaagccttcagcaggacacctgagttcatcttccatatatcctgtttgcagtgccccttatttattggcaacttcatgctcagatgataaagtaagattttggcgatgcagagtaacgaatggagaatcagcaacatcaaagaatggaaaactagatgttgtgtatgtttgggaagaatggccattactcattgaagatggacttgagaacaatagtagtgttactgtccctggtagacctgtagaagtgagctgtgcacatacaagtcgcttagcagtagcttataaacagcccactggtaatagtagatctcaggaatttgtgatgcatgtaagtatctttgaatgtgagtctacaggaggctcatgttggatccttgagcagacaattcatttagatgagttaagtacagtgttggattctggcattagtattgatagcaatttagtggcttataataaacaggagacatatttagtcagtaaagaaagtattacatcaaacacaaaacatttggttcacttagattggatgtctagagaagatggttctcatatcttaactgtagggattggctcaaaactttttatgtatggacctatggctggcaaggtacaagatcagactggaaaggaaaaccaggcatttcctctctgggacagtactaaaattgtacctctttctaaatttgtactgttacgaagtgtggacttggtttcttctgtagaaggtgccccaccttttcctgtttctttatcatgggtccgggatggcatccttgtggtaggaatggattgtgaaatgcatgtatattcccaatggcagccatctaataaacaagaacctgttatatcagagtcatacaatggaagcactccatctatactaagtttaataaaacaaagtaactcatcaagttctgggctacatcctccaaagaagactctgactcgatccatgaccagtcttgcacagaaaatctgtggaaagaaaagtatatttgacccctcagtggatatggaagattccggtctctttgaagccgctcatgtactttccccaactttacctcagtaccatcccctgcagcttttggaactcatggatcttggcaaagttcggagagccaaggccatcttgtcacatcttgtcaaatgcattgctggggaagttgtggctctgaatgaagctgaatccaatcatgagcgccgccttagatctctcaccatcagtgctagtggaagcaccaccagagacccgcaggcattcaacaaagctgacagcagagactacacagagatagactctgtccccccgcttcctttgtacgccttacttgcagcagatgatgacagctattgctcatctttggaaaaaactgggagtgagagttccttaaagaaatcaaaacagttatcaaaagaaagttatgatgagctttttcagacttcagttctgatgtctgataatcacatgttagaaacagatgaagaaaatactcagcccagagtcattgacctttcacaatacagtccaacttattttggtcctgagcatgctcaggttctttctggccacttacttcattctagcttaccagggctcaccaggatggagcagatgtctttgatggccttagccgatacaattgcaactacaagcactgatattggagaaagtagagacagaaatcaaggcctttctactggtcattttgcttgggcttttcattcagtagcagaggaagaactactgaatatgttgccggccatgcagaaagatgatccaacttggtctgaactgagagcaatggcaagactatttgaatctgaatttgataagtcagcaacatacaagtctattttacgcaaaaaagttttgggaattggttctccagccagtgagctcagttcgtcaagcataaatgcacatcatgacccctttcttcggagtatggcacattggattttagaagattatagtgctgctctggaaacattaataaagcaaccagttacagaggatgaagtttttaatttctacaattacctaagaacacatcctcttttgctaagaagacattttggatcatcatcggaaacattttcaacacacatgactttagcaggaaaaagtggactggcaggaacaattaatctaagtgaaagaagattattttttactactgctagtgctcacctaaaagctggctgcccaatgttggctttggaagtattgtcaaagatgcccaaagtcagtaagaaagcaaaaccgtgttgtagaggatctagttttttaactagtaaagattcttcactaaaattggatgtaagagaagacaagtgttgtgctgctgactggtcaccgtcgctgacaaatggtcttgaatcttcttcagagggttcctcagagaggcactcacattctaccctttcttttgattggagccaaccgagtgtggtatttcaagatgactctttggagttgaaatgggatagtgataatgatgaagaaaatgaagatccccctatttcaatgaaagaaataagacctttgcagagaaagacagttaaagaaatagatgaattgagcagttacacagactctttaagcacactagatgaaaatgacattttaaatccatcagaagatataattgctgttcaactaaaatttagagcatgtttgaagattctcaccgtagaacttcgtactttatctactggctatgaaatagatggtgggaaattgcgttaccaactctaccactggcttgagaaagaggtagtagctcttcagaggacttgtgacttttgctcagacgcagaccagctgcagaccacatttagccagagtgcagatgaatctggatcaactgaggatgctgatgatttgcatcaccaaacaaaagtgaaacaactgagagaaagtttccaggaaaaaaggcagtggctcttgaaatatcagtcactcttaagaatgtttcttagttactgtgtgcttcatggctctcatggtgggggtcttgcatcagtgagaatggaattaattttacttttgcaagaatctcagcaggaaacagcagaaccaatattttctaaccctttgtcagaacaaacttcagtgcctcttctctttgcttgtacagccagtgccaaaacagtagttgccaatccattattgcaccttagtaatttaacacatgatattctacatgccataataaattttgattcaccaccacatcctgatagccaaaccaataaa

SEQ ID NO: 501 - protein, 1960 aa, Mus musculus
AYASGCDIVILGSNFERLQIIPGAKHGNIQVGCVDCSMQQGKEFYSQWQKSGQFFLDSIAHNITWDPAGNRLLTGSSCLQLWCNSRKQTEDENPDKTDLNFGNWMCIWHCKTASQVHLMKFSPDGEFFATAGKDDCLLKVWYNVENWRPAVTSPDKNSEKQSQGEIDFSFVYLAHPRAVNGFSWRKTSKYMPRASVCNVLLTCCKDNVCRLWVETFLPNDCFLYGSDCNHWCEPVSLTNNLKRNASSKDRVQSALEVNLRPFRRGRSRSLALVAHTGYLPHQQDPHHAHRNTPLHANALCHFHIAASINPATDIPLLPSITSLSLNENEEKCGPFVVHWLNNKELHFTLSMEVFLQQLRKSFEQPSSEASVEDSIQADLKSDEELDDGVDDLKINHEKKELDEDKMLPSSSFTPLSSAAVDHQIEVLLSEWSKNADMLFSIHPMDGSLLVWHVDWLDEYQPGMFRQVQVSFVSRIPVAFPTGDANSLCKSIVMYACTKNVDLAIQQGKQRPTGLTRSTSMLISSAHSKSSNNLKLSIFTPNVMMISKHADGSLNQWLVSFAEESAFSTVLSISHKSRYCGHRFHLNDLACHSVLPLLLTTSHHNALRTPNVGNQKQAHDAVNTEECSLAQQNKSNVDMAFQDPNAIYSELILWRVDPVGPLSFSGGVSELARINSLHVSAFSNVAWLPTLIPSYCLGAYCNSPSACFVASDGQYLRLYEAVIDAKKLLYELSNPEISKYVGEVFNIVSQQSTARPGCIIALDSITKLHGRKTQLLHVFQEDFILNNLEKKRLGVDNILLDSDERIDTKISEASWLPEEHYSSSPEKILSPFSQKFQACRANLQSTSKLSLFSEMVYSKELDLPEGVEIISVKPSAGHLSSSSIYPVCSAPYLLATSCSDDKVRFWRCRVTNGESATSKNGKLDVVYVWEEWPLLIEDGLENNSSVTVPGRPVEVSCAHTSRLAVAYKQPTGNSRSQEFVMHVSIFECESTGGSCWILEQTIHLDELSTVLDSGISIDSNLVAYNKQETYLVSKESITSNTKHLVHLDWMSREDGSHILTVGIGSKLFMYGPMAGKVQDQTGKENQAFPLWDSTKIVPLSKFVLLRSVDLVSSVEGAPPFPVSLSWVRDGILVVGMDCEMHVYSQWQPSNKQEPVISESYNGSTPSILSLIKQSNSSSSGLHPPKKTLTRSMTSLAQKICGKKSIFDPSVDMEDSGLFEAAHVLSPTLPQYHPLQLLELMDLGKVRRAKAILSHLVKCIAGEVVALNEAESNHERRLRSLTISASGSTTRDPQAFNKADSRDYTEIDSVPPLPLYALLAADDDSYCSSLEKTGSESSLKKSKQLSKESYDELFQTSVLMSDNHMLETDEENTQPRVIDLSQYSPTYFGPEHAQVLSGHLLHSSLPGLTRMEQMSLMALADTIATTSTDIGESRDRNQGLSTGHFAWAFHSVAEEELLNMLPAMQKDDPTWSELRAMARLFESEFDKSATYKSILRKKVLGIGSPASELSSSSINAHHDPFLRSMAHWILEDYSAALETLIKQPVTEDEVFNFYNYLRTHPLLLRRHFGSSSETFSTHMTLAGKSGLAGTINLSERRLFFTTASAHLKAGCPMLALEVLSKMPKVSKKAKPCCRGSSFLTSKDSSLKLDVREDKCCAADWSPSLTNGLESSSEGSSERHSHSTLSFDWSQPSVVFQDDSLELKWDSDNDEENEDPPISMKEIRPLQRKTVKEIDELSSYTDSLSTLDENDILNPSEDIIAVQLKFRACLKILTVELRTLSTGYEIDGGKLRYQLYHWLEKEVVALQRTCDFCSDADQLQTTFSQSADESGSTEDADDLHHQTKVKQLRESFQEKRQWLLKYQSLLRMFLSYCVLHGSHGGGLASVRMELILLLQESQQETAEPIFSNPLSEQTSVPLLFACTASAKTVVANPLLHLSNLTHDILHAIINFDSPPHPDSQTNK

SEQ ID NO: 502 - DNA, 134738 bp, Homo sapiens
  misc_feature (1)...(134738): n = A,T,C or G
gccatcttggaaccctccttttttttttttttttttttttttttttttgagacagagtcttgctctgtcgcccaggttggagtgcagtgggccattctccgctcactgcaagctcagcctcccgggttcacgccattctcctgcctcagcctcgtcattagctgggattacaagcacctgccaccacgccgggctaatttttttgtattgtttagtagagacggggtttcactgtgttagccaggatggtctcaatctcctgaccttgtgatccacctgcctcagcctcccaaagtgctgagattacaggtgtgagccactgcactcggccttttttggacagagtcttgctgcattgcccaggctggaatgcagtggtgcgatcttggcttactgcaacctccatctctcagggtcaagcgattctcatgcctcagcctcccaagaagctgggttacaggaatgtgccaccgtgcccagctaattttggcatttttatagagacgggttttcgccatgttggccaggctgatactgaactctaggcctcaagcattctgtccgcctcgagtaaataatttttatgagtataaaaactagttgtcacaattgaagcatttaaagtagagcctggaatattacttgaggaaaacattaaaggcaatatttgcataaggcgttatttgcacaaaaagtgaaaagtgaaagcctcgtttcacctctcctccagctttgtccctctccctagaagacagccactaacaactattgatgaatttttgtttattatggaatattcttttttttttggagatggactcttgctctgttgcccaggctgcagtgcagtggtgtgatctcagctcatagcaacctccgcctcctgggtcaagcgattctcctgcctcagcctcctgagtagctgggattacaggcgcccaccaccacgcccagctaattttttatatttttggtagagaccaggtttcaccatgttggccaagctggtctcaaactcctgaccttgtgatccgcctgcctctgcctcccaaagtgctgggattacaggcggggagccactgtgcctggcctttctttacctttcttttaaaccatagatttgttttggagaaaattgtttacactccttgagttcattctagcctttacagtttagcagacaccaacatgatccaggtttgatttaatgtgatacttaaatttttgcttacttctactaattagggattatttgcagcaactcactggattagtacatcagtgtactcaatttaacattcatatcaaaagtaacaccaaggagctgggcatggtcactcatacctgtaatcccaacactttgggagggctggaggcaggcagatcacctgaggccaggagttcaagaccagcctggctaacatggtaaaaccccgtctctaccaaaaatacaaaaaaaaaaattagccaggtgtggtggcaggcacctgtagtcccagctacttgggaggctggggcaggagaattgcttgaacctggaaggcagaggttgtagtgagccgagattacactactgcactccagcttcctgggtggcagagcgagactccatcctcaaaaaaaaaaaaaaaaagtaagaaagaccaaggaacaaatgcttttttagctgtgtgactgtcttgaatgctttccttgagcgtgagaagggaacctcaacttcagtcttaatgctaacaaataagcagtccatcttagaattagctcattaaagaggttgataggtcagtctattaagtaaaaactagttgttgttgatattaagatacatatgttactagttcctttgacattatggtgatgactttttttttttttttttttttgagacagagtcttgctctgtcgccaagctggagtgcagtggtgtaatcaaggctcactgcaacctctgcctctcgggttcaagtgattcttctgcctcagcctcctgagtagctgggattacaggcatgagccaccatgcctggctaatttttgtatttttagtagagatggtgtttcaccatgttggccaggctggtctcgagctcctgacctcctcgtgatctgcctgccttggcctcccaaggtggtgggattacaggcgtgagtcactgcacccaaccaacatttttcttttattgtggatcagtttaaaatttgcttgttaccaaaatttgttataaattaagatacttctattaacagagctacaaattatagacattttatcatgtgaatatttttcactgttaaacatttatggttaaataaattatactgtatgacctaggacatataatttaatctcctttgcaataggatacattaaatttaccgtttaaatctgttactgttaataatagtggcaaacattatgttggaagtcttcttttacatcacaacattgttatgtgaatttttgacagtagaaacaaaaatagagaactacaatatatgaatatagctaaatacagaatggtgacttttttctcttcaagggtaaaaagactttttttctcttctagtgaattagactgcataaatagaaaaagattgattcattagctttacagttttgcctaggaatgatctataaatgcatttccccacctgctgcttacggaaagtataaaaaggaagttaaaggaaagtttccttgttggttactaccataagaaaggtgctatattctattttagcagggccactatatggaaaatatctaaattaaatgttgttacaaaaatgaattactaatgagattctagctaaggagggcactaaatgtggattttgtgtgtgtatatatatatgtaattattattattgttattatttttgagatgaagtctcactctgttgcccaggctgaagtgcaatggtgtgatctcggctcacagcaaactccacctcccgggttcatgccattctcctgcctctgcctcccaagtagctgggactacagacgcccgccaccactcctggctacttttttgtatttttaataaagggcggggtttcaccatgttagcaaggatggtctcaatctcctgacctcgtgatccacccaccttgacctcccaaagcattgggaatacaggcgtgagccaccgcgcctggccaatatatatttaaaaaatccaaaacaaacaaaggttgctataaaaaagctctgtatgtactgtaagcatataggtttttttctttttttcatgtgtgtttttaaacaatggaagagtcaactgtgttagactaaattatgttattgactgggttcgatggctcacatctctaatcccagcactttgggaggccgaggcggtggtgaagtcaggaatttgaaaccagcctggccaacatggtgaaaccccgtctctgctaaaaatacaaaattagccaggcgtggtggtgtctgcctttaatgccagctacttgggaggctgaggcaggagaatcgcttgaacctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgctcaaaatagcaaacattttcatattagggtaaaactagctacttgtaataaactttaaaattgcaatgacatgatccaaacatggtactagctcatttaataatctaatgtagatatttctgttataggtagctttcttccacatggttatttaaggactgggggttctcattcttctggttttgttagcccttaggactttcctatataaaggactatctgtagactagcagcattggtgttacccaggagcttgttagaatgcatgtctcaaggtccacacagacccaccaaaccagaatctgcaatttaatgaaatttccaggtgatttgtatgtacattaaagtttgagaagcattgaaactaggacattaaatttctctgcctttggccttcagttggtatagagagagagttagagagaaagaaagcatagctatttgtcagctaccttgattgacgcatatcacttacactgtcattcagctggcaagaacattcagctggaattcacagggcccgtgtagttcctgactctgtagcctttatatgctgagaaatggaaagtaagaaactgtggtgtgcagctagccatctctgtgacagtctgtggttcataaatgtgtttggtttttttttttaaagttttgttttaatttgtttaatttttaatttcaagatggtttatgatcattaggtaagaaaaatcaaacaggtacacagatagttatgaagtttccacattgttaagtttgataagtatccttccagtttgattctttgcttatgctcacacaaacatctaaatacagacacttaaaagttgtactgtgggtgtgcatttttatacagaaataatgttctgcactttgtgttttttttttgtttgtttgtttttttttgatggggtcttgctctgtcacccaggctggagtgcagtggcacaatcttggctcactgcagcctccacctcccgggttcaagcaattctcctgcctcagcctcccgagtagctaggattacaggcatccgccaccacacctggctaatttttttatttttagtcaagacagggtttcaccatgttagtcagactggtctcgaactcctgacctcaggtgatccatccacctgggcctcccaaagtgctgggattacaggcgtgagacaccatgctcggcctgtgctttgttttaattcagtcagtaatgggcagtttttcatatcattgtatttaacggctgctgagtattccatgtctaagagaaatgtctaacaggtcttctattgataaacatttaaattaatttaaattgtttttcattattctaggtacaatgacttgtctttttcttttttctgtgagtttttctataatcttgatttctagatggggaatttccagggagtgtagcaatttaaaatatcaataacttctgacaaattgccctccagaaatgttttaccagtttatacttcctctaagtgtatctaaatatatgctttacatccttatcaacattggatgttttcattatattacttttttttttttttgccagttgataacgggacaatggacatcttgttttactttgcattttcttgatgcaaattaagcagaatatcttttattatatttttgcccttctgtggcttgccttttaataccctttatctaatttcctgctgagttttttttttttcttattgatttgtatatcttgacttactttttaaatctggtaaacagtcaaaacttaaaaaaaatatatctcttcagagaaaggctctatattgctaaccaggaattgggggagggtgaggggactgggatttttgaaagaggaaagaatatacatatttacctgtattgataagttgatacacagtttattttttgttactaaggtgttgaaggaaacctggaaattggcaccataaatgcatttccttgaaatgatttctttaagatgccataccagttacaagtccatacacctagaggataactaatgtagcatactgaggtttggataaacctggtactttagagataaagtacaaattacactcaaataatgtattttaaaaactcagtcccaattttagttccaattccaattccttctttttaccatgagcaaaactgaggtccagaaaagtagtgtgtgttactaaaggttaactgagtggttaaatatagaacatctgcattgagaagccagtttacttattttccagtttaatattaggtcttctaccagtaatccactgactcagtcctgtatggctactgattactcagtgaacttcagtgaccttatattcctggagcaaagttacttttaatgcagagcccatttcttattaatatgaaaactgttatgtttttcatcttgaatccatttataaagatatttgtgtgtgtgtttgtactaattgtattagttttgctaaggcattttatgttcctcacactcaaggcaaagagataaaacataatctgaagaaaaatatatacttcttcaaaataaaaagagtcttcttcattatgcagatctgggcatattgtacaatacttaatggctcaaggggatcaaagtaccagtttgatgctgattcactaaatagaatctcattcatatttgatgactggactgtttgcgggctgtgatagattgaaccattctggtgatatccccagatctcactaaataagaaaaggctctacactagaatatgtgacaattgatctggctataaattatgtctataggctctttattattataaggtggcgaaagaggcccctttcttgagcacatgtttaataaaagtattattgtcatctatagattgctggattgattttgtgttgttataatgaagataaggtgcatataccactgtcagattaagaaagttacataacttggccgggcacagtggctcacgcctgtaatgccagtactttgggaggccgaggcaggtggatcacgaggtcaggagttcaagaccagcttgaccaagatggtgaaaccccgtctctactaaaaagtacaaaaattagccgggcgcagtggcaggcacctgtaatcccagctacttgggaggctgaggcggaattgcttggacccgggcagcagaggttgcagtgagctgagatcacgccactgtactccagctggggcaagagtaagactccgtctcaaaaaaaaaaaaaaaatggagcaagtcccttttctgggttgacaattagtcctatattggcattgctgctggctatgaaactcaccaccaaaggtaaacgattaatttgaactacttggtaggtgttatggtaacaaatgatacttttattttttgaaagtccaagttttctcctttcatctgtgcaagggcaaaagtagataagaaactagatctcaaagtatgctctggagcattatcattaagcattacatttactggtttacttaaagtatattgcaaagaatacggataaagagatgtgtagggtgaggtgtggcggaaggggtacagagcttccatgctctccttaggcatgagatctccatgtgttcagctatccagaagctcggtaattcttaatttatagtaataacctgtttgtatttacttggttcatgaactcttttgcttatagaaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtactactgttatttctggagagctacttccttgtttatgtgggtactattttctaatacctctttatataattttatatgttctaacacttgctttcttgattctaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtaagtattctggtttttattacagtaatttagatttgctgacattatcatcaaagggtgaaattttaatatttgtaaatactttctaggtgcatactgcaactctcctagtgcatgctttgtagccagtgatggacaatatctgagattatatgaagcagttattgatgctaagaaacttttatctgagctttctaaccctgaaatttctgtaagtaatgtcttttaaaacagcttaagtatataatattatgttttcagatagtttatatttattgggcatgttctacaattgtgacctataatttgtaataagcatttgtatctttgttttattttttcacatttgtactcttgtaatgatttaaagctcctttaaaaggaaaccatttctttcactctttgaaagaaagtagagtctcatctcctgtaatatgtttctgtaacacttctttactcatagataaatgaggactactgacagtataatgtagaagttatatcggcccccctgcaattattttataggcaggaggagctggaacaacaggaatagaattttaatcttaaacatgaaaagaaagagcccttagcttggttacagttcagacaagagttctttcagtattgttgtaaggcttttgccttatgacaggccacatttgttctcatacccacctaataacaaccttctaactgcattgtcttgggacatccaacaagcaagcgtttccacttttctggttttggcgatttttcttttggtatccccagaggcagccttcggctgtaccaagctttctatttaggagattcaagccatctccctgactaccaattaatgtatttgttaatgctcggcttacagagttgcataaatgtcagtgatctgttccaatcctgtttttttctgtaagttaattttaatgcataattttgcagaacacaaggttttccaaagcatgtatatagtattacagtagaaatgtatatattttggggggggtcttctatttatcaggcatttttaagtaatgggaatttagatgtgaagaaaacaggtaaaaatttgtatcatagagcttatattcgggtgaagggagataggaagaaaacagataaaaatatattaattaaaaatactatggatagaaacagtgttgcagaagaattaggaattgccaagtaagttgctggtcagggaaaatttcacagaaaaagtactatttgattaaagatctgaaggagatgtgggaactagatacgtagatatttattaaagagaatgtgatttgggaaaacggacagccagttcagagatcccaaggccggagcatgtttggtatgtgataaggtttggctctgtgtcccacccaaatctcatcttgaattatacttcccacgtgttgagggagggacctggtgggaggtgattggatcatgggggcagttctcccatcctgttctcatgatagtgagggagttctcacaagatctgatgatcttaaaagtggcagtttcccctgtgcacgtgccgtctcctgacacctgtgaagaaggtgcttgcttctcctttgccttctgccatgattgtaagtcctgaggcctcctgagccatgtagaattatgaatcaattaaacttatttataaattacccagtctcaggtatttcttcatagagtgtaaaaacagcctactacagataattggtaccaggagtggggcactgctataaggataacccaaaatgtggaagcggtgttggaactgggtaacaggcagaggttggaatagtttggagggctcagaagaagacaggaagatgtgggaaagtttggaacttcctagagacttgttgaatggttttgaccaaaatgctgatagtgatacggacaatgaagtcccggctgaggtagtctctgatggagatgacgaacttactgggatctggagcaaagatcactcatgttaatgctttagcaaagagactggttgcattttggccctgctctagagatctgtggaactttgaacttgagagatgatttaggttatctggcagaagaaatttctaagcagcaaagcattcaagaggtcacctggcttattctgaatgcattcagttatatgtgtttacaaagagatggtttgaaattgaaatttatgttaacttacgtttaaaagggaagcagagcataaaggtttagaaaatatgcagcctgaccatgtggtagaaaagaaaaactcattcctggagaagaattcaagggctacagaaatttgcataagtaaccaggagctgaatgttaatagccaaggcaatggggaaaatgtctctgggacatgtcaaagatcttcatggcagcccctcccatcagaggtccagaggcctaagcgggaaaatggtttcatgggccaggcccagggcccagctgctctgtgcagccttgggattcagtgccctgcctcccagctgctctagctccagccatggctaaaaggggccgtggtacagctccggctgttgcttcagagagtgcaagccccaagccttggcagctgccacatggtattgggcctgtgggtatgcagaagatgagagttgaggcttggcagcaaccacctagatttcagaggatgtatggaaacacctggatgttcaggcagaggtctgcggcaggggcgaagccctcatggaaaacttctactagggcaatgcagagggagaaagtggagttggagcgtcccacagagtccccactggggcctcatggaactgggagaagaggaccaccatcatcctccagaccccaaaaaggtagatccactgacagtttgcaccatgtgcctggaaaagccataagcactcaacactagcctgtgaaagcagccacaggcactgtaccctgcagagccacaggggcagagtttcccaaggccgtgggaacccacacctgtgtcaatgtgccctggatgcaagacatgtagtcaaaggagattttggagcttaagatttaatgactgcctggccaggtttcagacttgcatggggcttatggcccctttgttttggccagtttcttctatttggaacagaacatttacccaatgcctgtgctcgcattgtatcttggaagtaaccaacttgcttttgattttacaggctcataggcagaagggagttcccttgtctcagatgatactttggacttggacttttgggttaatgctgtaaggagttaagactttggggaactattgggaaggcatgattggttttgaaatgtgaaaaggggatttgggaggggcttgggtggattgatatggtttattgctgtgtgctcacccaaatctcatttcgaattataattgccacatatcaagggaggcacctggtgggaggtgataggaacatggtggccatttcccttatgctgtttgcattatagtgagcaagttctcacaagatctgatggtttaaaaagtgtcagtttcccctgcatgctttctttcctgccaccttgtgaagaaggtgcttgcttctccttcatcttccgccatgattgtaagtttcctgagggctcccctgccatgcagaactgtgagtctgttaaaattacccagtctcaggtatttatttatagcagtatgaaaatggactaatacagtatgtaaaggaacagcaaaaaggccactgtggctggagcagagcatgtgaggtggaaaatagtcagggataaagtcggaaagttagcctggccaggtcatatgaagcctgataggccattgtggtaacttcaggttttactctgaataacatggaaactatagaagaggtatgaaatgatttaggttttaaatgattcctctggtggctatatagattagacgtgggatgcggaagtagatccagagagaccaatttaggaaccaattacagtagtccaggagagggaaaaaaggagcttagaatatagcaagtggtaatggcagagatgataaaaatggccaaattcaagatgttgtttagaacattgaatagctatgaatggactggatgcggtatgtgtgagaaaaaaagaggactcccaaggtttgtgattgaatattaggaagaacagaattgctgtgaattgagatgtggaagaatgtagaagtagcaggttttgaggggcagggaaattcaagagtctggctttggtcatattaattttgagatgcctgtttgacatccgaaagacatagtaggttagtatctggagttcagagagaggtctggcctgaaaatatacagtagttgtcagcatataaatttgaagttgtggaagtggatgagattgccaagggtgagactatagttagaaaacagaagtgttaagccaggaacgatggctcatgcctgtagtcccagcacttttggaggccgtggcaggtggatcacttgaggtcagaagtttgagaccagcttggccaacatggtgaaaccccatctattaaaaatataaaaattagccagatgtggtggcaggaacctgtagtctcagctacctgggaggctgaggcaggagaatcacttgaaactgggaggcagaggttgcagtgagccaagatgacacgactgcactccagccttgggtgacagagagagacaccatcttaagaagtaatagattgaatgtgtgctcacttcagcagcacataaactgaaattggaataatactgagaagatgagcatggctcctgtgcaaggatgacatgcaaattcatgaagtgttccatatttctccagaagagactggggacctatattcaacatccttaaagaaaaaaaagtcttcaaccaagaatttcatatctagtcaaactaagcttccgaagtgaagaagaaataagatcctttttagataaaccaatgttgagggagtttgccttacaagaggtcttgaagggagtagtaaatattgaatggaaagatcactaccacctaatataaaaacacacttaaatatacacagaccagtaacactataaagcaaccacacaagccagcatagtaaccagctaacaacataataacacaatcagatccacacatgtcagtgctaaccttgaatgtaaacaggcttaatgccccacgtaaaaggtatagagtggcacactggatttaaaaaaacaatggtatgtggtcttcaagagacccctctcacatgtaatgacacccataggctcaaaataaagggatggagaaaaatctaccaagtaaatggaaatcagaaagaagccgggttgccatcctgatttcagacaaagcagactctgaaccaacaaagattagaaaaagacaaagaagggcattacacaatggtaaagggttcaattcaacaagaagacctaactatggtaaatatatatgcaaccaacacaggagcacccagattcataaaacaacttcttagaaacctacaaagagacatagactcccacacaataatagtgggagccttcaacacttcaatgtcagtattagacagctcatcgaggcagaagagtaacagagatattccggacctgaactcaacattggaccaaatgtatctgacagactgctgcagaactctccacccaaaacaacagaatatatattcctctcattgccacgtcacatactctaaattggaccacataattggacataaaacaatcctcagcaaatgcagaagaaccaaaatcataccaaacacactgttggaccacagtgcaataaaaatagaagtcaggatttaaaaaatagcttaaaccagtcaattacatggatattaaaaacatgctcctgaatgacttttgggtaaatagtgaaattaagacagaaaccaagaagttctctgaaagtaatgggaataaagatataacatgccagaatctctgggacacaactaaggcagtgttaagatggaaatttatagtactaaatgcccacatcaaaaagtcagaaagatctcaaactaataacctaacatcactactgaaagaactagagaaggaaaaacaaatcaaccccaaagctagcagaagataagcaataatcaaaatcagagatgaactgaaggaaatcgaaacacaaaataccattcaaaagatcagcaattccaggaaatggctgtttgaaaagattaataagataagtacgttgctaactaagccaatagaaaatccaaataaacccaattagaaattaccaagggaatgttaaccactgactctacagaaataaaaacaataatcagaaactactacgaacacctctgtgcacacagactacaaaacctacaagggatggataaattcctggacatataccccctcctaagactgaaccaggaagaaattgattccctaaacagactaatacgagctccgaaattgagtcagtaataaatagcctaccaaccgaaaaacccaggatctgagggattcatagctgaattacaccagatgcacaaagaagagctggtaccattcctactgaaactattccaaaaaattgaggaggagggactcctccccaactaattttttgaggccagcattatcctgataccaaaacctggcagacacacacacacaaaaagaaaactttagcccattatcctctatgaatatcaatgcaaaaatccttgacaaaatactggcaagccaaatccagcagcacattaaaaagctagttcacagtgatcaagtaggcttaattcccgggatgcaagttttgttcaacatatgaaaattaaatgtgatttatcacataaggagaactgaagacaaaaaacacataatttttttgatagatgcagaaaaggtttttgataaaattcaacattccttcatgttaaaaactctcaataaactaggtgttgaaggaacatacctcagaataataagagctatctttgacagactctcagccaacatcatactgaatgggcaaaagctggaagcattccccctgaaaactgacacaaggaaaggatgccctgtcttgccactcctattcagcatattattggaagtgctggccacagcaatcaggaaagaggaataaaaggcatctaaataggaagagaggaagtaaaactatcactgtttgtacatgacatgtttctatatctagataaccctatgtcttggcccaaaagctcctagatctgataaacagcttcagtaaagtttcaggatacaaaaattaatgtagaagaaatgactagcattcctatacaccaacaacagctaatctgagaaccaattcaggaagacagtcccattcccaactgccacaaaaagaataaaatacctaggaatacagctatccaggggggtggaagatctctacaatgagaattacaaaacattgctcagataaatcagagaagacacaaacacatgggaaaaacatcctatgttgatggatagaaagaatcaatatcattaaaatgaccatactgcccaaagtatggcccaaaaatttacagattcaatgctattcctatcaaactaccaacaacattgttcacagaactagagaaacctattttaaaagtcatatggaaccaaaataagaggctgtgtagccaaggcaatcgtaaaaaaaagaacagagctttgaggtatcatgttacccgacttcaaactatactgcagggatacagtagccaaaacagcatagtagtggtacaaaaacaggcacattgaccaatggaacacaatagagaatccagatataagaccacacacctacaactgtctgatctttgacaaacctgacaaaaacaagcaatggggaaaggattccattaataaatgatgctggcagaattggctagccatatgtagaaaattgaaactggatcccttccttacatcatatacagaaatcaactcaaaatggattaaagacttaaatgtaaaacctaaaactctaaaaaccctggaagacaatctaggcgataccattctggacataggaatgggcagtgatttcatgacaaagacatcaaaagcaatcataacagagtaaatagacaacctacagaataggagaaaatatttgcaaactatgcatctgagaaaggtctgaatatccaacatctgtaaggaacttaaatttacaagagaaaaacagctccatcaaaaagtgagtaaaggacatgagcacttttcaaaagaagacatacgtgtggcaaaaaacatgataaaaagctcaatcactgatcattagagaaatgcagataaaaaccgcaatgtggcaccatctcacaccagtcagaatggctattattaaaaagtaaaaaaaaaaaaaaaaaaaaagatgctgatgaggttgcagtgaaaagggaacacttacacagtgttgatgggagtgtaaattaattcaaccgttgtggaaagcagtactgtgattcctcaaagagctaaaaacagaactgccttttgacccagcaatcccattactggctatgtacctagaggagtataaatcattctgtggtaagggcacatgcaggcaaatgttcattgcagcattattcacaatagcaaagacatagaatcaacccaaatgcccatgagtgacagattggattaagaaaatgtggtacatacacatgatggaatactgtgcagccataaaaaagaatgaaatgatgtaatttgcaggaacatgggtggagctggcattcataaagcaacttctttatggaggccattctttaaggaggccattatccttagcaaactaacaggaatagaaaaccagatactgcatgttctcacttacaagtgggagctaaataatgagaactcatgaacccaaagaatggaaaaacagacactggggacttctttcatgttggaagttgggaggagggagaggaccagaaaaaataactctcgggtactgggcttagtacctggatgatgaaataatctgtacaacaaagccctgtgacatgagtttagcacacgtactcccaaacctacaatgaaagttaaaaaaaattaaagattgaatgctggaatgctcggttaaaagtagggtggaaatacaagggtgaatgtggtgtataatggaaggcaaaagaaaaaaaatatttcaaggaggaagaaggaatgattaccaagatcagatactgctgataaaggaagtctgataaagatttgaaaatagaccactgaatttagcagtgtgaccttgactaaagcagtcaggacatgaatggctcaagagatcagcatatttgaatagtatgtaatcttgtttctttagctctatccttcctatctcaaaattaatgtttaaaaagcactaattattagaacatttctaggagattgaaatcaatttttcacatttatggatgtaatttttttccttaacagttatcaagcattacttttatttttctctgtaccaactgagctgtaatgctttttcattcgtttgttaattcctataaagactaaagacctagaatttttatagttgaaagggactatatttaggcccacttgaattttattgttatttatctgttatgcttgaaattttgttatttactcttatttgcatatgaattgtttagtaaattataaatttttttaaaaaaaacagaaatatgttggtgaagtctttaacatcgtcagtcaacaatcaacagccaggccaggatgcattattgcattagatcccattaccaaacttgtaagtattaattttgggggggaggtatattaaaaaaaagtttatgaaagcattttgcataaaatctatatattaatgtaatttgaaaatttgctatatatttacaggtagattcagtaattaactcatcacataatagataacatattattgtatattttacttcctagacttcaaactagaaaacaaattatcctcattactatattcacagccaaataaattttcaaactttgactcaaacatattagaaatattatcatattaccattagatttaataaagtggtgttaggttcctcatccatggttattgaaaatcactgaaaagaaaactaggttccaatttgtggctaaataaaaaacattggtggatattatttcttacttataaagactcattgtaatgaaagcaaatcatcttgacctaaatttttatattcatctgtttaatctaatggaggtgccatacgcttacgttctgctgaacttttgacttcttattctgcctttaaatatctcattatgaagtattatttttctggctatttagcattaggtaaataacacataggtcaacttacgttgatatttatttatattcagcatggcagaaaaacccaactgcttcatgtttttgaagaagacttcattttgaataaccttgagaagaaaagccttggcaaagacagcattttatctaatgcaggtaaggaagaattatttatggaatgagaaatactatgtacagtatgttaggcagttaataaagatgaattggtaaaatgctttacattgtctatttgaagtaaaaattggggtaggtttgtttattaaatatttatcataaatatgagtatctttttattcttaaccaggtaataaatacgaacaaaattaaaggggcatcttggttgtatgttttttaaactgcataatagaaatgctttattattaacatatgagagctttttgcatggatggggtcctacccatccatttggatattatggacctcctgccttttgaaaatttataatttaaagaagtagcttaaaacttcaagctagaaggtccttaatttaaaaactaattgtcttaattaatgcttttataataaaagtttttaaaatgttaaactcctctcatcaacactttacatgaaggcacactgagtaaaataaagctacagtctcttggtcatctcttgcgattacagagccaaaccaaactcaaaaatggcattcttgaatatcacaatcttataaatcaattatacagtatgtgcctgttgcacaaagaagttatcaagattcatatgttaaatatcttctccatttgttcagacttttttcttctcttttacatcatgtctttctgccaccttttccatttttcttttatgagaagtactccttagagttctgcacttttatgttgacatctaatttcttaccattgcttttagtcttctatcagttttctctgagttaatgagctgtgcaaatacactttatgtgttttttaaaactctgaacatgttggaagtatgctaaaaatggggattaaagatatcaggcgtaagagataagattatttattgtataaacaaaactatccttttcatattaaaatattaatgaacatgttaatattgttaacaatttaagtctctttaaaacttttaaaagaagttactctcctttgcataataaggttgagtttttctgtgttcttcttgtattctagcatttgcttttttcggattcttcaatttttaatgtattttaattctctttaaggctaagatttttcttaaaatattcaggaaatttttacttttacccaaaaactattatgttcattattagagtttcctagaaaatacctaaggagttaatggtttcatatcttttgctctattatgaagaagaaaaatgttttacaaatattttcattattggagcattttttgttgttagtgaaattatcaaaactaggattgatttctattctgtttacttttgttataatctttatccttttctcttaatttctgtattttggatgcctaacttagaatacattaccaaagttaccttttcatttagtctctcaatacaagatgatttaaaacatttatggttaccttttttaatttttttgctatgcaaatttataaaagggcaaagtctttgtgctctaataatacctgctttctcatgttttacatgttctacgatttattttgtttttataatgtaattttcgtttacctaattgtgcacatagtgaataatagattataatgaagaaaacttggattaaaatctattgttaaaaaggtttttcaggcaataataaatcattgatttttctgatgtattttaaaaagatatgtttattttgagcaactcgtgtgctgtttatgcaatttgggagaagacaaattttcttgaatgatatgttttataatgaaaacttatggtttggccattggataaatatcatgaagtcatccattatagaacttattcatttgaaaaatgtttggcaccaccatttcatcatgatatgttgagttgaagtacatattacatagttcctatctgtttagaaatttcctacttcttatggtttaatctttgtgaacaatttgatgatgatgactgtaaacctatcaattcaaacatgaaatagcatacatattattgtaaaaattttaagttaatacaaattcatgtggtaaaggatttgaatatattttataataccacttgtgtttgaagccttaggtaaaagtttttaatcttctttttttaaagtccaattattttaacttggcatgtttagcaagttgtctcttttacacatagtaacagtgaaaaatatcattaataccaacaggcagctcacctaatggattttctgagaagttctacctaattgtaatagaatgcactcaagacaaccgttcactgttacacatgtggaatttacatctaaagtcaattcctgtctcattaggtgagtcttttgtgtgtgtgtttgtgcaactttaataggtgtaagttaacaaattacacaaaattagataatttgggacatatttcttaaagccattctcattaaatggtgataactgtagattattcaattaattcaaaaagcttttcttattttctttctgtgaagaatcatattaatatgtttactattttatcttttacaaggcagttttggattgtaaaatgtaacaatcgtaatatttatagggttcccctgcctcagtttttggttcttttcttatgttttgtagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcagaaatggtttatagccaagaattgcatttaccagaaggagttgagataataagtattaagccatcagcaggtttgtaaattttatgaaaagagactaattttgtaacacatgagtatttaccaggtatttaaaaataggtgctgcaactatctcttaaatccacacagaactagaaatggaaataatatattcaagtaccctaaattgaagacttatagttctcattatgttttcagattactctgacatttatcagccagttctagtcttaaatattgatttctaaaacaaattttctttgtctttttgggaagacaaagggacagtttctggagcggagatggtaactaagttgtactttatttgcagactttgatggtattggcaatagctgcctggagccatgattctgattgtgtggtttctgctatatatttattatccttattccagagcagtggttttcaaagtgtccccaggccagcagcatcagcgtcctggaaacttgttagaaattggccactccatttcttgggccacccagggttactgaatctcagactctgggatggggcccagtggcctggacttacaaacctttaaagtgattcttatgcttgcaaaaggtcaagaaccactgttctggagtatcaagaatactaatcaaaaatacaaattaaggcttatgttttaggaaactaatagtgcatgattactttaagtctaagcaaatgttaagttgtagttaggaatcttctcagcatttgttatggcaaatatacctcaatcatgaagggccctgtaaagtgaccattcagtacttaagtaaacataggccattcacatttatattgaaaaatgtgaaagagaaggagccagtgagtgttgacaaatttaaaaaaatgcattgatacctttaaaattagatttataatgtataaaactagcaaagagctgtgaaacaaattcgggattaactagaattaaattctgcctatgcctaagttgtttgatttaggcccaagatgtttaaccttcaagaattgaagtaaattatctcagagttccctttcaactctaggttttggtgatactttctttttatatacctttctgatgtcattaaaagcctctttcttactattcttgctgcccctttttaacttaaataaatataggctgtctattatgcagtttaaaaaacatacagccaagatgcccctttgattttgttcatatttatagtagttaatacaaaagactaaaatcgtaagtacataaaaacagaagtatttaaccaaatttgacattttgttaacggattatttttattttaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgagcagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtaaaactaaactccgtactgataacatttttacttactttcacagaaaataattttaaataatttttattaaaatgatgccattggctaggcacaggggcttatgcctgtaaattcagctctttgggaggctgaggcaggaggatcacttgaacctaggagtttaagaccagtctgggcaacatagttgagacccccatctctatgaaaacaaaaaaaaattagccagatatggtgcctcatgcctatagtcctagctactcaggaggctgaggtgggatgatgcttgagcccaggaggttgagctggcagtgaactgattgtgccactgcactacagcctggacaatagagcaagaccctgtctcttaaaaaaaaaaataccatgaaggttttttttggaaacatctttgctaccttcacaacagttttaactttttttccccccgagactatcataaacagcaaactcttaatatgcactatttatcctgtaaatcatagtactatgagcgagtgcacaaagactcgttatgctgttcatttttactaattttctgctcaatagtataaaagatccaactgaatctttctgagtttagcaaaatttaacagattcttattaaacaattattttaagtacctaaaaatgtggtttctgggttttttcccctcattttgtaataatccactattaacaattataatttggtttttaaaacattgagttttttttaaattagcattaatgtatgctcctacctagaaaagcataatgtaattaggtcttttcctcacccagagagcatttaaaaaaaaaatactgccaagttatgaacagtttgccataaaatctcaagtaagttctgaaatgaacaaattgagccttgtagaccatatatacgtcagtatccctttgaatgaaacttgaaaggaaaatatagggtaaatttaatataataacaaaatttaaatttaagaaaaattaagttggttatgaatcttgacacttttagagatattactagtagatactatttttgatgtgaatatgttataggtgttttatgtttttagtttttgcttcaaggaaaaaatatcaggccctcccaccatagaactgtttctcccagtgttaacagcagattattggggtggatgtatgattcgaacaaactgtattggttaaagataatactgtacatgtgccacagaaaaggttaaactgttcaaaaatcagtcacattttaatttaaataagatttcagtcagaagaggtcagtttataaagagtatcagattctctttattctctttattatttttccaattgtttatactattttttctgtaatgtaaaattctgtagaaaaagataaatgttagaaaatattttacactgataacttttttcttggtcaggttaagaatgttatatgcctatattgggtgttcttttgcttacaattttttttttaatacattgcttcccctttctcccattgcaggtggagaaactcttgatgaatgtgggttaaaatttcttttggctgttcgactccatacctttcttacaacttcccttccagcctatcgagctcaactccttcaccaaggtgattttgatagtaatctattaaagggaaataaagcgagtagaaaatgagagacttgggagtttttaaacttgtttttacccaaaaatgataatgatgacatatttaacatattttaagtttcctttatttgttaaaatgtttattttgtcataatctttgcttaaaacattggaatttttaatggtaggcaaaaggagttaatgaagaaacatactggagatgttctgtgttatgtttttaaatgcatgatatgttcaaggcaaattagtattgtttcattttctttaatttcttctttagattgtcttttctctccttttttttgacatttatctaaattcagtttttccaccaaacattgaataacatttgtgttataatacattctcaaattttaaatatttcacagagtacagaatattgaaagtgtaaatttacccacacttaaaactactgataaaatatgtatttcagatattagtttagtatatttcatgtattctatatttagtgctgtatttcagatactgttagttctcttactttgaactatcttagactttgaactgtcttagcataacgtaatagattcttattaaacgattattgtaggtaccagaaaataacattgtcttagagagttcaaagtaagagaaatctcacttaagttcacttaaacaaaacagcatgttttttggctcatctcccgggaagttcaagaaatagagctgactttcagcattattggaactataggtttaaaaagtgttattgggactttgcagtttagccttttagcctctgctccttggtctcagtctcttgctcgtaccttatgtctctgtctctttgtttctctcactattttctttttctcattttgcatatagctttgaaaaaagtaaagttgaaaattctaaatcaaattctttttagttttttttttttcttttttgagatagagtcttgctctgtcacccaggctggagtacagtggtgtgatttccgcacactgcaacctccatttcctgggttcaactgattctcctgcctcagcctctcgaatacctgggactacaggcgcacaccaccacgcctggctaatttttgtatttttaatagagatggggtttcaccatattggccaggctagtcttgaactcctgacctcaagcaatccacctgcctcggcctcccaaagtgctgggcattatgggcgtgagccatcttgccaggccaaattctctttaaaatttttagattgtaatttagcacattaaaattgtatgtatttatagggtacaaagtaatgttctgatatatgtatacaaagtggaatgattaagtcaaactaaacatatccatcacctcagatatgtaaaatatttgtggtaagaatatttgaaatgtactctcttagcaatattgaaatatacaatacactattattaaaggtagctaccatgctgtgcagtagatatcaaaaatgtattcctcctaactgaaactttttaccctttgaccaatgtctcccttctcatcctgtccccagccttgggcaaataccgtttattctctgtttctttgatttcaattgtattcgattccacagataagtgagatcatgcaatatttgtctatgactggcttatttcacttactgtaatgttctccaggttcatccatgttgttgcaaatgacaagatttcgttttttaaggctgactggtactccagtgtatatacaggcatactcctttttattgtgttctgctaggttgcattttgcaaatacagcagtttttacaaattgaagctttgtggcaaccgtttgttgagcaagtctttcagcaccgtttttccaacagcatgtgttcacttcatgtctctgtgtctcattttggtaattctcacaatatttcaaactttttctgtcatctgtgatcagtgatctttgttactattataatggttttggagtgccatgaactgcgcctatgtaggacaatgaatttaatcaataaatgttgtgtgtactgtggctacaacactgatcagccattcccctgtatttctccctctgctcagacctccctattcactgagacataacaatatagaaattaggacagtttaacaaccctacaatgtcttctaagtgttcaagtgaaaggaagagctgcatatctctccctttaaatcaaaagctagaaaggactaagcttagtaaggaaggcatgttgaaagccgagataggctgaaagctaagcctcttgtgccaaacagtttaccaaattgtaaatgcaaaggacaaggtccaaaggaaactaaacgttctccattgaacacataaatgataagaaagcaaggtagccttattgcttatgtggagaaagtttgagtggtctagatggatcgaactagccacaagattctcttatgccaaagcctaatccagaacaaggctgtaactcgtcttaatttcatgaaagctgagagaagtgaggaagctgcacaattaaagtttgaagctagcagaggttggtccatgaggtttaaggaaaggagctttctccgtaaactacaagtacaaggtgaagctaggtcttctggataacatgctgaagctttctacgtcattcagcacttgcttcagcatgttttccagaggatctagctaagataatggatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccactgtacaaactgtggatctagggaattttcttcttgtaccgcaagcaaatcagctgggatgggaacaggtgatgtgctcaaagtgagactgttactcttacccttctactgcagtttttgtttggttctgtggtcctcgcaggtgtctcagctcattcccaagtttgggggtaaaatggcattttctaatctgtggctagttgctacttaaactctctttgtgcaggggtgtctgtcttttggggcttctataacaaatatcttagactgggtaatttgtaaataggaacaagttatttttcatatttctgcaggctgggaagtccaagatcaagacaccagcagatttggtgtctggtaagggcttgatctctgctccatagttgacaccttcttgctacatccttaaatgatggaactggtaaaaaggactacctatgtctcttgatcccttttataaggatgttaatcccattcacgagggcaatggctagttatctccttaaggctctgcctgttaatgctgttacattgcaggttaagtttcaacatgaaatctgaagggatataaatatgcaaatcatagcaaggaatgaaacctggaacttctattcctgccatcttactgatgtctaaatcagattctttaattatttatgaaaatgtattgaagttgctggagagataacaggaatccaaaaatttgatttagaataatagtccattcacaatgtagggtttttttgttttgtttttacctttcatttattttcaaagtgttccgtatagaaagcatttcacattgcttggcatgggaggtgattccttgcttggcttaggttaaaaatttgaggccatatatctcaaagccacatgctataattaatcatttactttacctagtaatgctaaacaaaatgtattatgaaaagtgaaaatagaagctgagcaataaacatgtgtaggccactgggttgagagaattactgacataaatgatgttgtataaatatacaaatatcttattaatatggtgatatggagtaataattactgtgtgccagattctattctaaattttataactatattatttaattatcaaaactatgttataagatagttccatgattatttgcattttttacatacagagagattgaggcattaagagacaacgtaacttatccaaagattatatgaatatattatgctggtacaaaagcaactgcagtttttgccttttttgatggcagaaaccacctgcaattacttttgtaccaacttaatagtcaacaatagagctggaatttattttttgtttttattttcatttttgagacagagccttactctgttgccgaggctggagtgcagtggcacgatcttgcctcactgccatgtctacctccccagttcaagtgatttttctgcctcagcttcttgagtagctgggattacaggcacataccaccatgcctggctaattgtatggttttgttttgttttgaagacggagtctcactctgttgcccaggctggagtgcagtggcacaatctcggctcactgcaagctctgcctcctgggttcacgccattctcctgcgtcagcctatcgagtagctgggactaccatgcccggctaattttttgtatttttagtagagatagggtttcaccgtgttagccaggatggtctcgatctcctgacctcgtgatccgcccgcctcggcctcccaaagtgctgggattacaggcatgagccagcgcgcccggcctaattgtacgttttttgagtagagacagggtttcaccatgttggccagactggtctcgaacttctgacctcaagtgatccacccacctaggcctcccaaagtgctgggattacagcgtaagccaccgcaccctgctagagctggaatttaacatatgcattatgattctggagtctttgcagtgctattcctaattcatcaacctgaactgcttgcttgatgtttttttttttttttactaattccatggaattacatccacaaaacaaatgttgaccaaacaaaggtgaaaagcagctttgaagacagaaatatatcaacataaaataatgctttaagtgttactcattttttaaaaaggatccgaaatacatcagcacagtggaatttgccataagcattttttcttttcctttcaaaaaaatgctatttttgcaaaacatatatgtgctcattggagtgatacagttatttgaagaaggaaaaacttaaaaaagcccatatttccaatcttaaactgtgagtctcatagaagtttacacatttatattgaaaatatggaacatacatttctgataatcatataagcatatttataattcttataaacatcattttttacatttcttcaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtaagtgttttattttggtgtataagtgaattaatattttttggacgtttctttaaatggcatttcatatcttctctgccattactccctcttgtttttgaagcagcaaaaggcttttgaatagtctttacatttcatttataacgtgtttcaaaatatctaaagttttaaaatgtatattctaattcccaagtttttaattgacaaacttgttagtagtatatgtctgatttttacaaaataatatatatgtttagaaaaatttaaaaatagtacagaagaacttgtaatgaaaggcaatagtcctattattctctgtatccattgaagccaccactgtaagtcacttttgttattattttatatatacatgcacatattattcatatacatatttttaaaattttattaaacattcaatggatatgtgccagcctttcatatgaaagaaattacttgttcaaaactgtttctgtgaaattttgatcaatattttttgattataggtagctaaagcagccttttatagaaagaatgatcctttagatgctgccattttttaccttgcaatgaaaaagaaagctgtgatttggggattatataggtaggtaaaaaaaaaaaaaaaaaagggtgcttcaatgtgaaaacctgttcataagaagtaaatgaatgaagtaagatttgttgttcttgttgatgttgattcatgtagattcttagttgttttatatttaaaagagagatttcgtaaggaaaaagccccaagtgtttttcagagtggaagaaacctgatgaggtcagtttaatttgttttcagatttatcaatccagaaacaatattttgcttaagaacttctcattatgctcctataaaacaaaggtaatgtattagtccgttttcatgctgctaataaagacatacccaagactgggcaatttacaaaagaaagaggtttattggacttacagttccacgtggctgggaaggcctcacaatcatggcacaaggtgaaaggcatgtctcacatggcagcagacaagacaaaacagagcttgtgcggggaaactcctgtttgtaaaaccaacaagtctcttgaggcttattcactatcacaagaatagcatggaaaagacttgccccaatgattcagttacctcccactgggtccctcccacagcacttgggaattcaagatgagatttgggtggggacacagccaaaccatatcaggtaactaaaccagaaacttatgcttgggacagggaagaagatgaattaaatggtggagtctggaacaggcatttacctctgcactatgggccagcctaccccacaaaactatctccttcctgtgggccccaccttctttctgagctgaattcacttagaatttttctctctcacttctgagcaagactggtgaacatgattatcataaatagttcatcatttgttttgagtttatttccagatgacccacatgaacagcgacctttgggggaaaaatcacgataacaaaatcggttttctaagagacttgatgatttacgggttgttttgattcaaggcacattctttagatttttatctcttaggtcattctcagatggcaggggtgaaaagatactggatgagtttcaatggtggcaccccaagttaatataaatcaaacattttgcatggatttaaaagtaattttcacagtcctgctaatggtagttttnnnnnnnnnnnnnnnnnnnnnnnnnnnnnnnnnnnnnnnnnnnnnnnnnnnnnnnnnnnnnnaatgctttttctttgctaggcaaacaaagatttgaacattctgcagcattttttcttttagctggttgcctcagagatgcaattgaggtaatgagtgaaatttaaataacaaagtatagcaatgtcatcttttaaagctccttagtgcttaaatttttatttttttaaattcaactttattggaaataacacaaggccaaatatctgaaataactgttaatatttaataaagacatttaaaattttgactgttaacttgaacggtatttatacagaattaagattaaccaaatggtgtttgttagttggtagagataggtaattgatttgactcttgagaatattcaaaaaattaaagggtttgtcctaccagtttaaacatatttgaaccccatatctggctctctattatttgatgaatgttagaaaatccttaactgattatttcttagtaaaccttaaaaaaattatgaatatttaagatacaacatttctgtctcaaattgcccttttgctcagagtttcatacaagtaattcaaaacaaccttttaatatggagactaaagtctccaggggcggatggagaatagtagaggttcaagacagaaataaaataatatagcttaaattgacgtcatttaaattatccattgtttcctcatttagtttaatttttgcacatatatatatatttagtactagaaggtaggtttgcagttattaaatgttgtcaagtagatttgctaaaatctaaaagcaagcagcatatgttttgtttcttatccttctttgctaattttggatatttataagcctttatatttttctagttattagtgagttaacagaatttatcctaaaatgaaacctgctcctgcttatttaaaaacaatatttttttttaaaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatggtaagctgcacttctaagatgttaatgattaagaatattattggtaattgctacatgtgcagatcactctattaggtggtaagggtaatacaaacaaattgaattcatggtctttataacagtttttggttggttgtttggtttttttctccagaaagataaatcctttgaaaacaaagaacgttggattttctgtttttacaaaatagatttacataaatattgaacataaatattgtcaacacttgaatataaacattttgaagaaatactgttataaagccagtttttaaatcttaggttgaatttagtgtgtttgtcaatcagttttagaattcttacagtgaaaaatgtgttcagtgtaaaaacaagttgacttaagtgatgtgataagaaaatcttcagctagatgaacttttgactgtcttgttatgaactggtagagcttatgtactcttttgagtctgctagtaccttttcttttagaaatcctctttgctaaagctttcttagaggccagtataaaatggaattttttatatagatgcatataaaaatgagatttacttttcagatatgttttcatagattgaattgtgtttggtagctgataaaataggtattatattatttggaatactaattggaaaagggtctagttcatagatttttatgtgctatcatttaatcaggaagtggccttcgccttacttcctaaacctttgagaaagctgtgtgactcatttgtttaagtctcctagccatttaagctaaagattttcaaactagcctctatgtaatgaagggaaaatgtaaatgccttttccagccactttctttttttagtgtttttatttaaaaaaaaaaaaattagacacagtatcttgctttgttgccctggctcatctcaaacacctggcatctagctgtcctcccacctcagcctcccaaagtctggaattacaggcatgagctactgtgcctggccccctttccctttcccttcctctttccttttgtcttgtcttttctcttttctttctttttcttctttcttgaggtggagtctcactctcacccaggctggagtgcagtggggctatctcagctcactgcagcttccacctcccaagctcaagcaatcttcccaccccagcgtcctgagtagcggggaccacaggtgtgtgccaccatgcctagctaatttttttgtatttttgctggagatggggtttcaccatgttgcccagggtggtcttgaactcctgagctcaaagtgctgggattacaggcatgagccaccacacctggccctggcccactttcttatacttaacacatattcatgtaaaaattgtattttgatttgggactagtacatttttccatacttttattatgaattaaacttgtattcttctagaagaaaattgcaaaaaataatagcggcttggaccagaatgattggaatggaggcagagagatgtggttggatttgggatatgattttaagattgattacataggactggatttgataaggagtgtaaaggaattaggagtcaaaggtaactcctggctttttagattgaacaataggtagatgatatggggaagaattgttttagatcatggagctttctctgataaggtgaactttgatcagagaactggttgaaatgagtgagttaatcagtatagatataggtaaagagtggtttgggtcaagggcacactaaataaaaaggccccaaagcaagagtttatacacataagtaaaaatgaaatgtaggcctttggatataggagtttaggttttcagtgtgaagttgggactggagatagagatgatgtccaagttatcagtgtgtagatgttattgaaagtcatggggactatatgaattcaactcagggaatatagatagaaaataagtcagcagttgaaccctaggagactctcagtgttcaaaggtagagaagatgaggaggactagcaaagcagactgaggagaagtgttcagggaagtaggagaaaaagaactaagagtctataactggacgttttaaattatcctagaatattacctgaagagacttgtttcaatgggaaagcatcataatctttgttttcctactttgttagaacatgttcattataaatgtgttgttgtctcttcagtgccatggatcattgtggcctattagtaaaattttgtcaaaagactctttagataaaggtgtcatagtagatagagaaaagacactacaatagaaacacacagttcataacttttcttggctcataaaatgaatttactttcagatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggtatgtaatttacttgatagtcaaaaatggtacatgtctaaaactgtttttggtgtttcttttttggttttgaatactaagacttgattttctttattacggttgctttagggaaagctcccttttgtgtggtccttcatattatgaattatagagttgtgtatttatagtagttacagacgattcagtatcaggccttatgacctgcttaattcacactccaaagtgttgtctgaatgccttgtagggtgacagacttcttattgcaagaggatattgtcttatttttttttccctctctgtgcccctaaatgtcttatttttaaatatgattattgaaatgctgacttcttcacatcccttctaactctaagtttctattatgcttttattttttaattgttttgaagtgttttaaagagcccttgatttactgaagtaatggtttgtaactgtaaatagttggttaaccttttatccctctttgtttttaaggaaacatcagaaccactattttctagccctctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtaagtatgcttggtttcaagcttttacttcatctgtacaatgataaaactacaagataaatattaaggcttttttttaagtaattttaaacatcagactaagcatagcaattgttacattgccaagtttatgttgattcctattaaagaaatcttctggttgtagactggcttatcttactcatgttacttacacccggtagagttcttgaattttttatcacaatgcctagttatttagtctagctgctttaagaaaaataggtacgtatgagtcctttagtagtacatttaaccaaaaagctcattgttttttaaatatagaaacttaatattttaatgtaaaggcactaatatgtaaacgaagttttcccttgttaatactaaagaaatccacattttaaggataatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgatggtgtagttccggtccaaatcagaaggcctgagaaccaggagagctataatttaagttcaggtcagaaagtcagcaggctgaagacccaaaaagagctgatgttttagttcaagtctgaagacaggaaaagcaatgacccagctcagtgcagttagatgcgagttactcagcctttttgttctgttcaggtcttgccagttgagtctactcacattacagagcacaatctgctttaatcagtctgattcaaatgtttgtctcatctgaaaacatttcacagacacccagaataatgtttggtcaaatgtctgtgcaccccatggcccagtcacacctagatttttttcaaatggtagtttcaggggttcaagagcagcaagaatagaatttgcaaggctttttgaggtgtagattcggaactcacacttcacttctgttgggtcctcttggtcgaacaagtcaagcccagctcagattcagtgagtggagaagtacgtccaactctctcttgcagaagctgcaaaatactgtgatcatttttgcaagctcccatatatagtttttgtcatcttcaattatataatatcttttaattcatactacgttttattgacatttgaaggaaaaattagcaattagatttgatctgtcattctccatttttatctacaaaatgactggcatacttcacaatcagatgaagaacctggtcttttaatattctagtctggtttgctttcttacctagctgaagtttctccttcatcctcagttctgcctaatgttatggcccttgccatgccatgtttagagtcttctcttccttaaaacaaatgcctgactccactgcctttcagttactgccttttataccttatatcctttctctttctctttcctctagtttcactctcttcaaattgtttttaaggtaactagaatatgtggtagcatattcttcagtgacctgtccgttggtgaactgtcagttatcaggctgtttcttcacattttggttgaggaaaaagcagattgagtgttggagggcttactttaatacatggttcatgctctactggagagctgacatctgttcccctttgctctagaaaaagaaattaggtagcaaatgtgtgttttataatttctgctgaagactttagcgtgttttctttaaattttctgtagtaagactcatgtagataaaaatgagtgttgtagaaaaaaaggaaatagttcatgaaggcaaagaatcaaaaattttttcattcttttaaaaatgctgattatattaggtcttgaaaaaaaatctgcactttaaaaaggttatacttaaagtaattttgtttttgttttccaggtgtatgtaatgcatactttagcagcttcactttctgcttgtatttatcagtgcctttgtggtagtcataactacaggtaactatctttttatgaaatttaagaatgcttacagtaagcaatgaggtttcatattttgtatgttagtggtttagaactatatataacagtcttttaaataatgcaaaaagcatatggttgaggttttgagtactttttgttcatatttgaaatttttatggcagatgaatctcaaacccttattctgtataacttatttagcagcctattactggtcactgccttatgtcagacattgtgattggcactgagaattttaacgcaaataatatgataaagtctatttcttagggccagtctagttagagacaaacatgtgagttgataaatgatatgtatataatatggcatagtactaaaatggtaactataataagacagtagatagtaaaaggctcagggaccacatgggagggagtaacttggaattgagaaaaattttaccaaataattgatgtataggatatttctctgtatttctctttatgttataaagttttactgaaatttatctaggcttcaaaaaaatagtttgttaccctctggggtctttctatatctatctttagttgtttgaagtactctatttcttcaagtattgtctcatctctcttctatctttcctattaaacagatattgcaacttctgggtcatttcttaatgttctttaactttcccctcctatattccatttctttatctctttttgtttcatttcaggagaaattctagcttcattttccaaacacggattcattattcagcaatgtcctgtcttatttagcaagaatttatattttagaaattctgtttttcattttcgggatctcttgttgaatttagtatttgcttctgtttctataacatttcttgattaaaaaaaattattttgagtatggagtactttactgataagttgggtttctcaggtgaagatcttttgttgagtttgttatttcttacatggtgtcagccttccttgttaatttttggttgtctgtccagtttgtgtttttgaattttctgtgggtagccttacttaccactctggttgtatatttcccaaggtaacttcaacttgatttctttaaccctcatccttcaagaattcactttcttattatttaggctttattttcattaacttctttttatctttcctatctatgatttctataggaatgagggagttttttttgttgttactctgccatcttgaaactggaaagtaaagcaagggaaactacaaaggcatcaaaatgttataaccaatgagatttgccaatcataacacatttacaccaataaatgcgnnnnnnnnnnnnnnnnnnnntttcatagtttatgtcaagctgcaggtttttttgttcattcatctgttagtcttagctttgcatcttttacttggggaagcttatcctgaattctcaaattgtgtgaaatactcctctgtattgccttgatagcgtcatatgcataggtttcatcttttaagagtagtatgataacattatttgtgttttgttccactattaaattttatggggacagagacattgttattccttatatgcctagtacctgctacagtgcctgatgtagggtaggctagccattatacatgaaagtgagcctaaacggacttcattttcaaccagataactatgtttttaagtcaaatatgtaatcttgctacttgtggtacatagcgatttagttttctcatttgtacttattctgtcccttaaaatgtgttttaatttagaaaatgtgtatatttacacttaaaggatactttgtttttatatagcactagactgtacattatattacttagatgtactagcagtataattaataaacaaaaattgatactcttgaaagtagatctgaaacatgaaaatattatataaaatttatcatagatttaaatattgtttttttctcttagttcatttcagacgaatcagtttactggaatggtatatcagacagtactgcttcctcatcgaccttctttgaaaacaggaagcttagatgaagcattaactcccaatacgtcaccagctcaatggccaggtataatttttatgtatagatcagttttttcttagtcttatttataatcttagataagtagaaagacttttagttttgccacatgataatcattgttaaatactgttagaattgataccagttaagtattcaccactcattctgaattacagttacttaacattagtattcccttgatcattatactaatataactcaaatgttttgtaataccgttttttaaatcattttgcttttgacatactagaaaaacccgtctatgaaaatttatctatgacatcttagtcatgaaagattttaatgtttaatattaaagatttttaatgtttctctcaagtaactcatttgtgcttaactataataaccgctactagtctgtgaatctagggaagaaaatacagtattaactcctgatgcaatacattttttcctgaaattagaaaaatatagttaatttttaaaattttaaaaatttatagtcagtgacagctatgtttgtttgtcgttctaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctggtgagtttaaaaaatttttttaggactgaagctttatttatctgagtgatatcattctcaaacgtaattacattttaatttagttatagaaagttctggttagagaccatttgcgaaaagcataaacaaatagtcatacagtgaaaatgcagtattaaagtttctggtgcagtttttaatctttaagatattcctgtaccaataattagaacgatcttatgtaaatttattaaatattttactactgaaactttcatttgttttgaaacacactgtaatattggtttttgttctatcccaaatacggattctttcttctttctttggcaggaaggcactttgctatgcctagcccccaccaggtagtggtattctccatggaatgtgtgggcttttccaaagctctttcagccatcagttctcatagccctcccagtcttgcaggcaagatatgagctttagaaataggcttttatcattcagcttgctttgtgttgttttgaggggttggggtacagtgggacagttttattttgtttggcatttatagaaaattgagaagtttcctttgatcaagccatatttttgatttaaaacaatgattagcagtttagaaaactatctctgctattttattctgcttttaaattctttgttttttatatttctgtcccttagactttaacattttaaagtgtgtaaaaataaaacactgtcagtgctaatcatagaaaatcagactatggcttgaaatgactagaaaaacatttcaaattaggctgctttatgatttgcatattatgattccggccattggagtttttggatttctaagtgttcataataccatgaaaagtaaatattttaaacaattgtatccccgtttaaaaactttctaatgttaaaactgtatttttttcatgtattagcccatgtgtgataatcttagttttccaattatggagggcatgaggagtagctttatttttaatacatagtacttgaaaacttatttcattctatattggtgttgaataaattgaaaatgttaaatgtttttccaaaaaaaaaaaaaaaagccctatgcatacatttgagagaagctcagcaaggttatttatctctttatgagctttcattcacttcttccctgacgtttacactgaacatatgcttgtacatataggtgtatgtgggcttggatatatatgttttgggaggtcaagcagttggtgagggacatgagagaataagaaaagcttgaatttggcttcattatttgggaaaaaaattattgccaaaatctttaccatgattgatgaatattctttgaatgaagctatattaaaaagaatttagaaaagttattaccttgttaaaatatttaaaagttattagtagcaatgttggcatatattatacttttcaaaagcagtttccactaacctgtggccctgcatgactatatagcaaaaaatcatgatggcctagcttctacttcctctccttaattgaaattgtttcttcagttacctagctaggactctcatactttctagtctgggtcctgcctctttcttccatcaagaaaaaacaggcaggaatttctttatgtataatacttaccatgaggcaaattcagtttataactttcagcagagttcaactagctttttctgtaaaaagccaaatatatattttaggttttggagtccatttggtatctcacaactatttagttctgcccttgtagcacaaaggcagccatagaccatttgtaaacagatgagtacagctgtgttctaagaaaacattatttatttgttggattgcaatttgccaacccctgctttacaagtagaagcattttattattggtctatttggaatagaatatttgccttccctgttaaaggaatttcaggttttaagaacaactgaagttaatattttgggagatagagttcactgtgggtctcttaacgtatttgacctaaccacaaattgtacttatggaatagtataagtggcatcagagggataatttgtaatcttccctgccatggcccttagcttcctttagccaatctaggggctaattcagtttttgctgttgtaaaatactgaaaatgtagaatcctaacatgacttctccagaaacctgataccatcctgcctattactcatccacctaccacactttgcttactactttgatggctgttttatctctgtggtccctcccatttgccttaaattaaactcatttacttctcctttttcttcttatgcacatcagatttcatatgcaaatttaccttatttgccaagtttacctttgcttattaaaatattaagtattttgtttttgtaacattccttttctgttttttaaaaagttgtttattgtgctttttgtatagatttttttaaaagactaatttcacatgaaatttgccttggactatatttatacttgagatatctgaattcaattaaggaaaaactttcaaagtctaagggaagtaggatccatagctctgttgagtttaattttaaattaaaaattggcaaattaattttgaccatatttttaatatgttctgagaaaaattcatttgttaagactttgatcttgttgatgtaaaatgttaaaaagggataaattattgctaaggaatgtgcagatatccataaaaaagaaaatgaaaaatacattcttactagccatcaggtctcaatttcatccatttttcctgagcacagatatgtgtaaggaaccatattgaaagtccaggttgatctttgtataaggttggtgcaaaagcaatggcaaaactgcagttacttttgcaccaatcttattaaccactctagttgttggttgtaggcaaaaataccattacataaattattttgggggggccattataagtccgtcataagctgtatcctaccacttatttaaccccaagtaaaaaataaagtgacctaaaattatctgcatctatatgtttaacctcagccaataataaggaatacttaaaacgtattgttcacttagtggtagggctggatatagtcatatccaggttatatggtgctcatctgtccttgagtacccagaaagtattctaaatacaatcatggaagtaactgaaggagtacttaaagaaaacatgaatggtacgatttgtccatttgctaaccagaaaaaaaggaatatattcactgaatgatgaaaactaaaggcctgctggtttcaaagccaagctaatttgaaaaggagcaggagggctggatgtggtggctcacacctgtaatcccagcattttgggaggcctaggtgggcagatcacctgaggtcaggagtttgagaccagcctggccaacaagtgaaacactgtctctacaaaaattagccgggtgtggtggcatgtgcctgtagacccagctactcaggaggctgaggcaggagaatcgcttgaacctgggaggtggaggttgcagtgagctgagattgcgccactgcactccagcctgggcgacagagcgagactccatctcaaaaaagaaaagaaaaggagcaggcagaaagaggaaaggaaagaagcgaagagaaagggaaagaagcgaaggtcctgtggagtacggatccactgaaaactagagagagaaaaatctcagaacagaaaatcaaccaagacaaggaactactagcagcattggctttcaatataaagtaacgttcagaaatctcagtttttttaaggcattattatgttgccctgaaaacttaccgaggcaggacagcaacctgataaattttaggttgtaggtaagcagtcctgtgtgtttggattactgctaatcataatcattgatgtgccaagcagtctaattgcattaagtaatgttcaatatacattgttgaccaagggaataaaacagtgtattttagaaaagttgacttgaatccagttaaaattaatgtgtatttaaaattttttatcttttaaatttggccagtgaaagctgacaaatctagaatatttcattttcctgactactcaaacgtgtcaaagcattgtatattgaagatgaaatacgtgcatattgaaatacattgtatattgaagatgaaatacattgtatattgaagatgaaatacccttaaacatgttttctaaaagtgttccataagtttaggtactgtattatgagaggaatttgaaagccatcatttgttttccttgttctgttataaatttggatttaaattttctttgcaatgatggcctcatgaactagattatatttctttctatatatctattatatacttaatgtattcttgtagtaacataatatttaaagataagcttcataactgaaggaaattatagatttttattagactctagtctggcaggtcaaaattcttaacaaaaatgttaatgtacataaattaacttaatcaaattttttttggtgaattccacattatatattaatgaagagtttgatttttctaattaactaaaactgcagtgcaggtatatgttcatggaactctgaattgttttgttatggtcaattttaaagaagagaaccagctaagcaatagcaattttcaaaaaattactttttctgctaacagttagaaatccatacttttgctttttattctgtattataaataaagcagtgtttttaagaattgttattgtgttttgtgatacttgcatttataagaactgtgaattacctctttatcttaataaattcatagtaatgacttttttatgtctccaagttgaggaatggaaatataaaatgaacattttatttgtggtaagcatgtcatatattttttactatgagattgctaatgatattctagacataaagtttatttctgacttattacgctaaaacagatcagaaaatccactttttgctttttcttataaaacttgtgtaaaaacaaaagttctgtattcagtagtcagtgattatcacatgtcattgctaacattcctttagcaaagtaagcaaaacagcaaaatatcttgaccagaaaagacttgagcatattaaaatataaaacaaaataggtgatttaaaatataattgaatatgccaaacatttaactggtggtttattataaggaacttttaaaagactgctgaacttcaaagtaactaattctgtggaagggaatactttccttttcttttctttgtgaggcagagactcgtaccgtcgcccaggctggagtgcagtggcgtgatctcggctcactgcagcctccgcctcccaggttcaagtgattctcccacctcagcctcccaagtagctgggattacaggcgtgcaccaccacacctggctaatttttgtgttttttggtagagacgggctaggctggtctcaatctcctgaccttcagtgatccgcctgccctggcctcctaaagtgcttggattacaagtgtgagccaccacgcctggccaggagtacatttttgttagacttttcattgaagaccatataatataaattttaatttaaagtttaaaaagtgttctattcattcattttacaaatgagtcaggaaggcaaatttttatacaagagtagagaaagcgtagaagataaaagaaactccaagaaatgtgcatgtatagatttttacatgtaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtggtgtgatcacagctcattttacagccttggcctcttgggctcaagtgatccttccacctcagtgccccaagtagctgggactataggtgcaggccatcattgattagcctagttaattttttaagttttatttttatagagacaaggtctcactatacccaggctggtcttggactcctggactcaagtgatcttcccacctcagcctcccaaattgctgggattacaggtgtgagccaccatgtcctgcttaattcagtatttctgtgtaccttactgagaccaatcatgtgatctctctcttcaacccagttttctaatatttctaagtcctaagtcctgcagcaaaatggcttgaatatattttttccattatagtttttttattatgactaaaaacacatgatataaaatttagcaagtgaaccattttttaagtatatagtttagtagtaagtctatcatgtggtgaaacaaatctctgtaactttttcatccttgcaaatctgaaactatacccattaaacaatttcccccacttcatacaatcccctggtaatcactattgtactctgtttccagggatttgattactttatatacctcatataagtggaattatatagtgttttgtctttttgtgactggcttatttcacctagtgtaatgttcttccatgttgtagcttgcgacagaatttccttcctttttaatgctgaatgttccgttgtgtgtgtatactccattcacattttcaataagtttgttgagtttgggttgaaatcttatatacagaaccgtgttgtggcattcagggtgattgaaaagtaagtactactctagggcagtgacttcaggcttttgaagacattaccttatccataaaacatgcttgaccaaattctcaatatatgtatattgatgtctactactatcgatccagatgttaaacattgacaaaatttagtttcttctccttactttccttcttccccttctttcctctgctttcacctccacctgcccccatctctcctttcttcttgtcccttctcctttccctctacttcttcccctgtcactttctgctcctctacctccttcccttctccttctgccctttccccctatttatcaaaaaataaatctaagtagaagttgtagtattttccttccatattctggtgaatcattttgtacaactaccgtggagactcccttgctctgtggtttggagacaaatcaccactttctattaagatatttattatttcatttttatagatatttatggagccatgttcaagatacggtgtatggtaatgatcctaggaagactttgagggtcagtctttctaaaagctggatagtatcatcttccagactttttttgtttgtttgtttgtttttttgagacagagtctcactttgtcacccaggctggagtgcactggcatgatcctggctcactgcaacctctgcctcccaggttcaggtgattcttgtacctcagcttcccaagcagctgggactacaggtgcacaccacgacacttggctaatttttgtatttttagtagagatgaggttttgccattttggcctggctggtctcaaactcctggtctcacgtggtctgcctgtctcagcctcccaaagtgctgggattacaggcatgatccactgtgcctggccagactttttttttttaatcactaatcttattctttgatgattaagaagtaccttcaattaattgcttctttaatccttttatttttggaatatttgaagtttacttggaaaatcatgttttacatttaattttgaggatttgttttatacttagtgttcacgtacatttgtagttctcaaactttttacctgaagataaaggttaacatatacctcttaggagactgaggacttagactgaattggcttgctgaaagcaagaaataaatttgaaatctgtttgtcttaaacttgcatgacttttatcttttccatatttggggggctcagttagaaggtccagactaatgtgcctcctgaagcttcgtgtatactctggcacactcatgaatagctctgtggatatgggtgccttagattgagaaatagagagtgagacctgctggttactttaagttcagttattttgttgtttgttttgttgttgagacaggttcttgttctgttgcccaggctggagtgcaatggtgtgatctcagctcactgcaacctccacctcctgggctcaagtgatcctcccaagtggctgggactacaggcatgtgccaccatgcccagctaatttttctatttttttgtagagactgggtttcaccatgttgcccaggctggtcttgaactctaagttcagtttttaaagaaatgacatttaaatctacattcagaatattaatttcattgtgctgattttaaatgataaactgaaaagtaaatattaacttaataaccttccccttatattttagttttaatcacagcaatatatgtgtgtggtaacaagtctagcagtacagaagaatttataggaaggaatgttgtcttattcctctgctcctccccttccctatgtgtagcctgttagccatttctccatttctgttttgggttctttggggagttacttttataattcttagaaaaccacagtgcagatattctgagggtgaggaaaggattgttaagggaaggaaggtgtatttgtctgtacagtctactatcttgacatggaagctttgttttaaaaagtacgggaaggggaacatcacacactggggcctgtcgtggggtggggggatgggggagggatagcattaggagatatatctaatgtaaatgacgagttaatgggtgcagcacaccaacatggcacatgtatacttatgtaacaaacctgcacgttgtgcacatgtacgatagaacttaaagtataatttaaaaaaaaaaaagtgcttcctgggaaagcaactgaaacttatttttaaaatttatgtcaggacattattctgtttttcctgtgaatgccttagtttttcttcagccactttgtagcctccctatacctcttaaaattcataaattctatattcaagttgctcttaatttctccctaatactattttctttcttctgttactaataaagtagcggttttcccataatagtagaaccatagggttagtttgcacccaaggaatggcaaacgttcttgatatttgattattagcattttcaaaaacaaccagttgaacacccagcagctatagtttttattggtgcccctaagcttcacgaccaatctgacccagcaggattcaagcataaaattgccttaagtcttcctacaattggaggacaaagaagagggagtaactaccctattgacaagtcacaggtcatttcttgtttactgggtggcatcgctaaggtctttttagttaaagcatctaaagtaatacacattcattactgtgaaactgccgattttttttcctttggtcctgcttcattaaaagtgttgtttttgttgttgttgtttttgagatgaagtcttgctctgttgcccaggctggagtgcagtggtgcgatcttggctcactgcaacctccccctcccaggttcaagcaattctcctgtctcagcctcccgagtagctgggattacaggcacgtgccaccatgcctggctaatttttgtatttttagtaaaggcagggtttcaccatgttggccaggctggatcctgacctcaggtgatctgcccacctctgcctcccaaagtgctgggattataggcgtaagccaccgcacccagccaaaaagtgttttaataagtggttttatacttcctggtgttgagtctgtaaattttaaacatttcctcccagtgtggttaatattttcatgtcacgtgactggattcacagcttgtagtttcaaatgtttctgtctttaaaaactctcttatattttacttttaaaactatttttatctaccagtgggtcagtaaaagaaaaaaagaaaactatttttatgacatactaatcttggcaaaaatctattaatttaacattgtacgtgtttttttttcagagattgtctatacttcttggttcacatgctttttaataacataaaaacaaaaacagccaggtgcagtggcacaagcctgtagtcccagctactcaggcgtctgaggtgtggatatcccttgagtcaagggattaaatccagcctaggcaacataaggagacctccatctcttaaaaaagacaaaacagtaatgttaaagccaaatgataaattgatatatttatcttaaaacttagcattaagtttttgaaaggtaaaaaaatatctctatagttctcacttttcacttgatgagaagttggtaaactaccgtttaagttttagaatgtgtgttaatgtatgcagcagtaatactggaaacttgattgttggttatcaaatgttagtaagaacaaagaaaaaaatttgcacatttaatctcacagttccttttaaaatcatttgaaagattaagtaataatcatgccactttttagtaatctcttagaatactaatattttattcatctttccctttttctgaaataaccaaattactttgttaaactcagcttgactatagcttgttataatgcatgtgcatgatgtgtctgcaagctgagacgcttcaaacaataaaaccaaattgtattacagcacaagtatttgcattcctttggaaggtgagtaaaatctcatcggagccattaaaggagaatattggtgtgccttaatgtggaattctttgcctgtgtattagatcatgcctttgtctgcaaaatccttgattgtctactgatgatttgcattttgtaactcaaggttgattaaagatttgtataatttttttaatgctaatctctttagtattctgaggtaatatactaaaaaaatactatctaattatagagtgttcacaaaataaaacaacaaaattgcattattttcttctttgtaattccattgactggaaaattctgtctctgagccgtttccgaaagtttgaatcagtttaagtagttatggtgcctgaattttgtttatattttctaatgaaaaatatagttttagatataaggccacatcattaccgaagaatctcagaagggagttgttgcttttaattaacactgacatcccatgataatctttaaaaaaaagcaaagtagaaggatgttggaaatttcctatcgtgttcctagttaaattgtggactgatttatgggcggatattacatccttttatttttcacatacaataggtaagtcagcatttagagagtgagggacaaattgaggaaaaagcagaggttgctagacagaaatgatttttgtcttcctctacttattttcttacctgctgtgtactttcataatctcaatcttatttttttgtgtgtgcttatttgtagttaaccttagctcttatgtaaacacaggtgaaataaatgcaatgaaaatagtacttcagtaacattttattttctttttgttagtttcttcactagttgaagaaggagaaaaacagaacaaacgttttaggccgtcaaaaatgtcttgcagagaatctgccccactgaccccttcctcggcaccagtaagccaggagtcactggcggttaaagaaaagttcatcccacctgagctcagtatctgggactatttcatagctaaggtaattaaaatgctatctagatcaatattttcatagtcaaatagaaatgagaatatcagaaataagtgtcatttttggtgcttccaaatgttttcccactttggtttagaaaattttcattagtatcaggctacattccaaaaatatataccctagaatattttgaccatatttcatatagtttttaaggcagttttttggtaaattatgacatttgcattttaaacaatagcttttgcattttattatatttcttataagataaaagagaatttgcgtaacatcttcatgttaatgtacttgatggtgattaaggaatcaaagtgctctggtcatctattatccatatactcttttttatactacagcagtctctcattattctgaaatccataaatttcaattaccagtgttaagtaacattattccctcaacaacatggttcacatttgttaccacagtgtattaaatatgagtaaacttccctgctagcgcttcattctagaaatcacttcgtaaatgtgcactttttgatcagtgaccaatcatgtcagttcttttaaagtctttcagtgattgattatgtagcacctgttactcagttcatacacagcaaagcatgcagttgttttgcttcatctcctgtgataaatccatatgatagtgtacaaaattggatttgatcaaaagagggaaatggccaactaagatgaaagtgcatccataaaaaaagtgatagtactgagagtgaaattcaagttgaacataaatgaagttagagagaaaatagccaactgtgggtatgttgacagtgctgccatttgaaagactctagatgaacagccagaggaatttagtgaaagtgaacttataaatgtagaaagtagttgtgataaaatgatgaagatgttcagagatagtgactttgccaaaaaactttacgttaaagggattcacaacattgaaaatgcaaagaacagtatgttggaagctgataaaatcttagaaatgtgacagtttgtttaaggcacagaagaaatgcttgcttcatatcctgagttacagagatagaaggcaattgctattcaaactactcttgataaaatgttttatttctttgtattcctaatgttttaattacagtatgttaaaattagtttatttaaaaaaactttttctatacatttatagctaatggtaagagtttttagggttttgacaaatatctttaaaggtcacaaaacatttgtaacttttcccattgattattattgctctgtatagtttatgcgtgcgtggtcatttttgtaggcatgcaatactgtgcaaaacaaggactgcctatataagtatctttcactttttgtgtcatcagccacatccctcacattctcaatttccagacgttctcctgcacaaattgacatctaactgtaactgttctctggtgacacaagtctcccaggcctgctgagctatggcttttatttttctcatatcctaaatgtttaagggtagtgaagggagtttgggtctccttgttcctcactgcccttttttgagtcatttattcattcatatattcaacaaatgtttattaagcacttcatttatctaggaatatctttatttcacctccatattttgaaggagagttttgctggatataggattgttggttagcaaggccttctttagctatcttgtttctgaatctttttgttaaatatttagtgtctgcccttccacccaatcaatatcacaacctcaaagtagttgagatgttaccttccctaattgtttgttactgagatctctgttgcttttgataatgcctgtgggcctagaattttaaagacaatcctgtctggcagggcatcagaactcagtcttcacagccttccctgctgaccctggtggaacacctacaccacagagattggggtgggatgggaacagctcctgaccaagttcttactgttttacccagatcagatcccatagatttttaaaaataaatacttctctatgtgttatatgcatgggtcaaccattgtttgttttctacaattttgttcaattttattgttgctttttggagaaaggacttaccaagctctttactcagctgttccagaagttccactctccctgctgtgtttctttgttggtcttccaaggttttccaacctttttttcaaacttcctgcatctccccttccatcctatcctcactcttaattgatgacctcaccttgtaagtcactgagaaaaataaaatcagacaaaactttttcatcatcccaatttaaagttacagatcaattacatttgctcctgtcttatttcctcctgttataatggagaaagtccttctatcagacaccttttctcgagttttactctgaattgcattctttcttttcttctctactctcccctgtgttttcagttctcttcctctctgttgaatccttcacatcaggacagaaatgtgctttagtatctcccattccaaacccctgctttgaccctgaaactttttccagctgctatcccatttctctgttcccactcacattcagcttttcaaaactagacacatttgctttctactgcctttttcccctttcatacttacttatataactttctgacccagttacacccgttaaaactgatcttgttgagattcacgtgatatccatgtcaaatgtagtggaaacttttaaattattttcttatctgtcttcttagcatcattcaacattcttcactactcccatattgaaatgcttttctctccttttctcttgatgacaatctcttgtagctttttttcttaaacttactatttattccttcataatcttctttcttcatccttcctcttctgtttgacacataaatcttggtcttcatgatttgggcattttatatcgatttttcccaaaaccttccctctcatacccagtctttccattttatgaaattgtatattcacccttatagttgctcaggccaaaaacctaagagtcattcatttttcctcaacttctcttgttctccaaatctatcagcagacctgttggttctttctccaaaatatatcttaaatctactacttgtctctagcttcattactaaccacctatgtccaacctgccaactcctgttttagttactgatgtctccatttctacccttgccgtttagcttttctctcataagagagtgatcgtagtgatatacttagcatataaacctcagtacctgtcttctacgtacaacttattggtggcattcccttacattcctttaccatggcctacaagaccctgtctgagccgtcatttgctattctctccaacctttctcccagcatttttttgcttagcagacttgatcaaactactattttcaaaccaaactctttcccaaactctttctgcattatttttcccctgtctaaaatgcttttcttccctcttattatatggcttgttccttcttgtcatttagttctcgtacttttcaaagaggccttccatggtcagcttatctcaattctccttattctccatttcttttctttgtagcacataatacagtttgtatttagttttctgttatttgcctatttttttccagtaacatgtaaaaagtaaatgagggtggtgattgtatctgtcttaaaaattcttaaatccggtagaattcttgccgcacagtggatacttaataaatttttgctgaatggatgaataaataatggaatagtatcaattgatgtcaaaggcataggatggtaagataatagttacttaactctcttataatgaagtatctgcaaatgagatgaattattactattagactgtatgtttgaatgtattaaattagatatgtggctgctaaatttcatgatttctttattttagccttttctaccctcttctcaaagtagagccgaatatgattcagaggagagtctgggaagtgatgatgatgacaatgatgatgatgatgatgttttagcatcagatttccatctccaggaacattctaattcaaattcatataggtatggtatattttattttaaatttctttttaaaaataatggtgtatataaataatatttttgaaaaaattacatgtgaaattaatagcttgttgactttataacacattataacccagatttctttagttgaaattgttaaattcctttccttaacaataatttctctgttgactttataacacattgtaactcagatttctttagttgaaattgttaaattcctttccttaacaataatttatcacatacctttggttgtccattaatggaccatccgtaatttgcatcattcctcacagatcttgctccaagattataccttgcattttgggctctaacataaacaagttctactgtttttgtctggaaaatatattttcagtagaacactagtactataagatgtcaataggtactatcttcaaaaagtactctgtatgtcatacacatgttctaaatgctcacctctagctccaatactgcgttattcttacattcatgaatgatggaatattatctagtctctattgatatgtttacatctaaaacgtgtatgttttactaaaacatggtatgttaatggtgtgataaaaaatgtgaattttccaaaagaagtaaatatatgagggacattgaagtcattctttatttgaaagttaccatgagatttttacttcctggtttattgaggtttttccccctgctgaatgaattttactttttgaatatataaatcatttaaaagtcaaactgcacaactcaacaacaaaaaggtaaataattaaaaaaatgaacaaagggctgggcatggtggcctatgcctgtaatcccagaacattgggaggccgaggtggtcagatcacttgagcgcaggagttcaagaccagcccaggcaacatggcaaaacccgatctatatttctaaaaaaaaaaattttaatgaacaaaaaacttgaatagacatttctccaaagacgatatgaaaatagccaataagcatatgaaaagatgctcaatatcattaatcattagagaaatgcagatcagtttcccaatgagacaacatctcatatgcattaggatggctaccaaaaaaaaaacaaaaacaaaaacaaaaaaaataacagtgctggcaaggatgaggagaaattggaatctttgtgcacttttggtgggaacgtaaaatcgtgcagcaactgtggaaaacggtatactggttccttaaaaagttaaaaatagaattaccatatgatccagcatttccactatggatatatacctgaaaatattgaaaacagggactgaaacaggtatttgtacttcccatgttcttagcagcattatttacagtaactgaggggaagaaacaatcaagtgtgttttaacagatgaattactaaacaaaatgtgctatgtacgttcaacggagtattattcagccttaggaaggaaattctgacacatgctgcaacatggatataatgctaagtgaaataaatcagtcacagaaagggttatagtatgtgatttcacttacatgaggtacctagaatagtgaaatacataaagaataaaaataaaatagtggttttcaagggctggtggtggggggagaatggggaatgaatttagagtttcagctttgcaagatgaaaggaattctggagttggatggtggtggtggttgcacagcaatgtgaatgtacttaatgcccctgaactataaacttaaaaatggccaaaatggtaaattttatgtttttgtattttaccattaaaaaattactaaaaattcaatcctttaagaaataaatatgttccacttgaaataaaagagaacctgacttttttaaaaatcaaactatataaaaatgtgaaatcacaagttttacttaaacttctctttactctatccaatttcttctgcacatcctctacagctaaccacttttattagcttctggtttatccttctgtttgcaaaaataagcaaaagcatctatctaaatttattccccctgctttcttgcagagagggtggcatactacatacagtgttctgctacctgctttttatttattactacataccgaaactgactccatattaacacttagagatccttcttcattcttccttatggttaccctaatattccataggtcaaaaatagttattcaacaagtactctcctcatggacaattttggttatttctacacttctgctattgtagataaagctgacatgactacctctatgcatatattattttgttttcatagaggggtatgttcaggttgattcctgatagtggaatttgttgagtcaaagggtagtatactcttctaaatccctatagaaatagttaacagatccatcgttgctttatttttagttggtccttgatgcggttggcgatggtgcaattggtgctcaacaatttgaagactttttatcccttcgcaggtcatgatcttgcaggtaataaatagctcaacatgagctaatggtgccattgcttttgacttactactctgttgtttttttttttttttttttggtctggactggggggaaaatttagtgatttcctgttacagaagttagatttcttttaactaaaccaaccatctgtaaatgtatccgtcatactgttaggtgcttgaggatggcaacatccaagaaatcaagggcactgaatgtgatgtgattgactgtcttgagactctatttatactctagccaagtgttgagggattttacaatggagagaaaactaagcaaatgcaaaagctagcaattattaacttcaaaggaggaaaagattgtacaggaaagaaaggggcatgataacatactaagtgattctgctatgaactatagttccctatatatgataaggtaaacacaaaaataccaatttaaccaaagatttttataagacactatcataatgatggacagaggagtttattctcattatgccgtagtagtaaatcagtaggtcatttctaaaattgaaaaattaagtattaagcatgttatttagatatagggaggtaagtagtaggaataactaaaagttgaaactgagatcagtactcaagagtatggatgggcagaactgctaagtgctgagttccatggcaagtattatttaattttaactttatgtattgttttcattttctacagatcttaaagagttatatgccatacagaaattagtctgatacaaattaaagcaggggtgtccaatcttttggcttccctgggccacacaggaagaagaataattgccttgggccacacataaaatacattgatactaacaatagatgatgagctaaaaagaaaaatcacaaaaaatttcataatgttttaagaaagtttatgaatttgtgttgggctttattcaaagctgtctgggccgcatgcagcctgtgggccatgggttggacaagtttgatttaaagcgattaattttccccacatacatattttcataatcttcagatacatttttcttgtaatattaaggtcaaaagcagtaatgttgaaatacttacacagatttatggcataccttttgtaatccactgggtttctttgcccacctcaccttgcacatcttccctgccaaagtgtatgttaatatttcatctcagtctttttttttttcctgcatctgctctcccctctctcatttcagtctttcttaaaattgaatatggcattttactgcataagattaatatgagtcaatgttcccattttagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaagtaggttttcttatgaatgctatttgggtttttttgtttgtttgttttttgagatggtgtctcgctctgtcatccgggctggagtgcagtggcacaatctcagctcactgcagcctctgcctcctgggttcaagtgattctcctgcctcagtctcctgagtagctgggattacaggcgcctgccaccacgcctggttaatttttgtatttttagtagagatggggtttcaccatgttggccaggctggtctcaaactcctgacctcaggtgatccacctgcctcggcctcccaaagtgctgggattacaggcgtgagccaccgcacctgccctgaatactgtttttaagataggagttttactttttgtgctgtacattcttgtcataactactcaaccctgccattgtagaataaaagcaaccatagacaacatgtacacaaatatattcagtttttgtccaataaactttatttcttaaaatggtaggtaggctagatttggactgtgagctatagtttattgatgcctgctctagaacgatgcttttcaaaatagctggtcacaaaagtgttaagaggaaagtttatagcactaaacaacaagcagtcaacagattcagcacaattcctgtcaaattaccaacatcattcttaacagaattagaaaaaaattattctaaaatcagatggaaccagtagagagctggaatagccaaagcaatcctcagcaaaaagaacaaggcatcacattacctgacttcaaactgtactacaaagcaacagtaaccaaaacagcatggtactggtacaaaaatagacaaatagaccagtggaacaaaatagagatcccagaaataaactcatatcgtgaggatttgttctacaaattatttcatcactcaggtagtactaagcctggtacccagtagttatttttccttttttggagacaaagtcttgctctattaatcaggctggagtagagtggcacaatcacagctcactgcagcctccacctcctaggcacaaacagtcctcctgtctcaccctcctgaatagctgggatcacaggcacacaccaccatgcccagctaattttttgtattttttgtagagacagggtttcaccttgttactcaggctggtctcaaactcctgtgctcaagcagtccgcctgtcacagccccccaaagtgctgggattttagctgtgagccaccatgcctggcccccagtagttatttttgtgatcctctttctcctccccacttccccctcaagtagaccccactgtctgttgttcccttctttgtgttcatgagttctcaacatttagttcccacttataagtgagaacatacagtgtttggttttctgttcttgtgctagtttgctaaggatagtaacctccagctccatccatgttcccacaaaagatgtgatctcattcttttttatggctacatagtatttcttgtatctgtaccagattttctttatccagtctgtcactgatgagcgtttaggttccatttctttgctattgtgaataatgctgcagcgaacacttgtgtgcatgtgttttttatggtagaatgatttatattaccctaggtatatacccagtaatgggtttgctaggtcaaatgatagttctgtttttagctctttgaggaatcgccatactgctttccacaatgattgaagtaatttacactcccactgacagtgcgtaagtgttcccttttctctgcaaccttcccagcatctgttattttttataaataatctgttatttttaaatgataaccattctgactggtgtgagatggtatctcattgtgcttttgatttgcttttctcaaatgatcagttatattaagcttttttcttaggcttattggcacgtacgtcttcttgtgcaaagtgtctgttcatgtcctttgcccactttttaatggtggtgtttgtttttcttttttaaattggttgaagttcgttatagatgctggatattagacctttatcaggtacatagaaagtattttctcccatttctgtaggttgtctgtttactctgttgatagtttcttttgttttgcagaagctcttaagtttaattagatcctatttgtcaatttttgcttttgttgaaattccttttggggtccttgtcataaaatctttgcctgttccctgtgtccggggtggtattgcctaggttgtttgctaaaatttttgtagcttttggttttacatgtaagtctttaatccatcttgagttgatttttgtgtatgttgcaaggaaggcattcagtttcaatcttctgcatttggctagccggttatcccagcaccatttatagaatagggagtcttttcttgattgcttgtttttgtcagctttgtcaaagatcagatggccagaggcgtgtcaccttacttcccagttctctattctgttccagtggtcaatgtgcctgtttttgtaccaatactgttctgttttggttactgtgtttttgtagcatacatcgaaatcaggtaatgtgattccagttttgttctttttgcttaggattgccttgctattcaggctctttttacgttccatattaattttaaaataggtttctctagttctgtgaagaatgttggtggtggtttgttaggaatagcattgaatctgtaaattgctttgggcaatatggccagtttaatgatattgattcttcttctccatgaacatgggatgttttttccatttgtttgtgtcttatctgatttctttgcacagtgttttgtaattattgtagagatctttcacctcctggttagctgtattcctaggtattttattctttttgtggcagttgtgaatggggctgccttcctgatttggctctcagcttagctgttgttggtgtataggaatgctagtgatttcttgcacactgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatcaaattaacttggcatgtgcagtcctgtatcccagttattcggggagttgagcagaagaatcgcttgaacccaggagtggagttgcagtgagccaagatcgccctgttgcactccagtctgggccaaagattgagattccatctcaaaaatatacatacatatatatatatatatttttttatatatatatatatatatttatatattttattatatatataatttcttaccttcaggttatgcatataagatgtatatgaaacataaatgaatttttaatttagacatatatattcaaatatttcaaaatctgaaaacatatgaaattcaaaatacttctggtcccaagtactttagttaagggatactttacctgtacattatcagacttgagtagttgtgacagagaccatatggtccacaaagcctgaattatgtactaatcctttaaggaaatcctttaaggaaaaggttggccatatgatctgcctccagtcatacagtctgattgcagttaatttattataatttatatggcaccaaggaattgttatcaagttagtcagaaatttctgaagtttatcattaaatttgctgtctctctctgtagatccaaacaccatctggcactgtctgtgaagaggctttggcagtatttggtgaagcaggaagaaattcaggaaacctttatcaaaaatatattcacaaagaaacggtgtctaaatgaggtctgtataagttaaaacctgtttactattttattattgaagtcttttatattatcatgtaaccattaaaatgagttgtattttacagattttttgaaaacacgtatcataaacataggcaattaatgcttagaacagtgtaatttataaaaggggcagtattttcataaatcaatttaattaattcaaatgtatttgggacttttttctcgataaaaatgtttaatattccgcatcttgttttgaattgtcatgatcatcaatttaagagacaagatagaaattttctatgattttcatgtgacagttaaaagaagtctatcttagaagtttaattgtaacttagaagtttaattgtatactgaaaattttttatttatttatttatttattttttctttggagatggagtcttgttctgtcacccaggctggagtgcagtggtgcgatctcagcttactgcaagctccgcacctcccaggttcacaccattctcctgcctcagcctcccgagtagctgggactacaggtgcccgccaccacgcccaactaattttttgtatttttagtagagacggggtttcactgtgttagccaggatggtctcgatctcctgacctggtgatccacccgcctcagcctcccaaagtgctaggattacaggtgtgaaccaccacgcccggcctgaaaaatttttattgtatttatttatcttttttgagatggagtctcactctgtcacacaggttggagtacagtggcaccatttcagctcactgcaacctctgcctcccaggctcaagcgatcctcccacctcagcctccctagcagctgggactgcagatgaacgccaccatgcctggctaattttttgtatttttggtagagactgggtttcaccatattgcccagggtggtcttgaattcctgagcccaggccatctacctgccttggcctcccaaagtgctgagattacaggcttgagccactgcacccagccaactttttaaatatgtacattttcttttctgtggattatgcttaaattaatgaaattttacaaacccaaattaacctgtagtgtaactggttgcttataccttgatattatcataatgggtttttttttttttttgtcatttagtttagtgctagtaataaatatcagtctgatgatatggggaacttgtttctttcattgggtaagttttgttactaaaaagttcaggtgaactgaacagtagatgcagtgatgtagtcaattctttttgtctcctggactggtaacgaagagttcagaactgacatttggtatgtgaaccacattttgagtagcattgaactagtctgaaagcaagctttgtacagtttttgaagttggaggaaacactgaagatatttcagttgaagaaataaattgaatggcttcacaatagacaagtaagcaaaaagcaagattgacatctaacctttctaccttaaaggaaaattacatatatatctcattgtctctcaatttaagcaccaattttaagtggaaactgtatatgctgttatttactatttgcctcattttgtaaatatattcaaatcgaccaagtcaggaaatagtatgtagtgttcttgctgacttagaagacttttgacctgagtaccttggtgtaatattgaaatttagacaaacatgaatgtatttcatttgtttatttgatctttttttaaaaaaattgacatatttgattaatcttagaaaaatcttatttttctactgccgatatatttgggtatttgggaaatgaagtagttctgaaaacaatacaaaaaaactattgagccattagattgtctagttgattcaggaatagactcattaaagaaatagagtagtatagtcaagccagagtacgtaaacatagcaaataataagtataactacacattttaaaatttctgttattctttggagtttcatgatatctcaagaaaattttaaaattatttttattgtaattattttaatcaggagcatgaatatgaatgttggactaacagttttgtgactatcagtaagctgaatattttctctgaattttgtttttttaatgcacaatgactataatagcccttactttgcaatgttttgataaatagatttaacttatttaaaccttgacacaattaatggtagttattaaaagtttgttgttattgctttgttgttttattcttgatagtgatactcttaaaatagtgtctttttgatagagaatatgaaaagaaaaatgttacatagtaaagcatagatttgaatggaattaaatagaatatagagtttgtgtgaaattaatctttaccggaaaggttactagcctatttttagtattaacaaaatcaccttccatctcttatttttctaaaatgatgattatgcttaaatattttagtcaaagtcactgtgattttccagatggttaggagatacatatatgacaggccctgtattttggatggnnnnnnnnnnnnnnnnnnnncatatatgacaggccctgtattttggatggcaggtgatgggagagtattctgagaactgctctttctttatttctttatgtgtttgaaaatgaaattttacagtttcttcatctgaccctaaaatcctggttttctcagatcttttcttttcctgtttggtaaagtttactggtacctgtgttttaaaatagaatgtcctccctttgtatttaaatagaaagtacagacaactgcaattagattaagtcattcttaataaaaaattgggacttgacaactcccatcattgttcccaattcctttttctgtttttttttgttttgttttgtttgagtttctgagaagaactaaaagtcttggaacaactctttctttaacaagtactactattcccttttaagaagtgtatgtgcttcccagcaatttattgactatttctggcttcatcagtggaagagaattagatacatgtagaaattgaaattttctaatcaagagattttcctgaaggttcagatgtggagataagacaaagcagcgagtaagagaataattcgactttgttcatagtactctgacaccagtagctctgattattttaatataaagtattttggtttcaatcgtgctttaatgtcaacatttcgaaattgagtaaaaacttcttagggttagaataaaatttatagtggtagttaatgagttctgagggattaagttttgctcatttcctaaccatgcaccctcacacatgcttcttataaggtgtatgaaattttgagaatagtaactccatataatgttcttttctagtaaatttggtttaaaatatagcattgaaacaatccccagtattttgcatgttacatctcatctttactctttgtcatgtggttattctttcttgatgaagtcattagaggacaacagtgaaaccatcaaaaattctatgatggaggagccaaacatcaataaggtacaaaatatcattcaactgaaattaaaaattgcattctttcacaaaagaacaaagcatttgcattttacttttaaactggtctttgtttccaatggatttaaagtattgttccctcaaattattctccttttattttaacaacttaaatactgcagttgtaaaagtggtttctgttttgttagataagagaatgcaattttaaagggagttgaatgtatcttgttttggctacaaatttttctgagtaaatacaactaaagttcttaatacatgtgattacaatagcaattgtctagtagtattgttttaattctgcaaatatcacttttgaagttaaaattcaaattaggaattaatgatactaaaattaggaattaatgatattaaaattaatgatattaaaaaattcaaattaggaattaatattaattcctaaaaatatagtaaatactgttacatagcatttattttactggtagcaatagcatgtagcaaagtgccttaagaggatacatagtaagtactcatggtacttgagaaccaaagcacaaaagatgagaatctgtataattatgaaaaaactcctaggcgtcctgtgattgcatattcaactatgactatattttattttatttttgagacggagtttcgctcttttgcccaggctggagtgaagtgtcacagtcttggttcagtgcaacctctgccccccaggttcaagcgattctcctgcctcaacctccctagtagctgggattataggcgcccaccaccacacctggctaattctttttgtatttttagtagagatgaggttttgccatgttggccaggctgatgtcaaactcctgacctcaggtgatccacctgccttggcctcccaaagtgctaggattacaggcgtgagccaccgcgcctggccaattcaactacgactttatgaggttaatatttaactcatgtttttcatattctatatttaaaacaatctcagcagtgatttttaagtgaaaaattgctcaaaaaaatttttaaggttactaatttctaccccttattctttccaatgggaatcctttggtaaaataggagaaataattctgtgcaattaattaaaaagcctgatttgatatcaggtgtatattataactaaaacttttgcaaaataagtctgtatgtcattcatactttcaaactatctagtggcctttgggggttttgagggaatataattcaaacttttaatcagttaacaattttccttgcctgggttttgatgattacttattactgtctacacattatcaggaatttttttttttttttttttggaaacagagtttcactcaggtttcccagactggagtgcagtggcgcgatctcagcttactgcaagctccgcctcccgggttcaagcgattctcctgcctcagcctcccgagtagctgggattacacgcatgggccaccacatccagccaatttttgtatttttaatagagacagggtttctccatgttggtccggctggtcttgaactcccaacgtcaggtgatctgcctgccttggcctcccaaagtgctgggattacaggtgtgagacaccgtgcccagccacatatcaggaattcttatacaaacatttttgttttgatgctgtttataaaatgctaataatcataatgttgtatttctatagtcagcttcatgctacgtcaaaatacagtctttttgaggggagggttaacatcattttggccagcatttttccaagcccactgctatatagtttaaaaaaaaaatctttgtaaggtatgcctgacctaaaataactacatatatttaaagtgtacaacttgttcaattttggcatgtatatacactagcgaagccatcaccacaaccaggataatgattatatccatcagtccccagaatttaatccctccatttttttttctctcccacctgtgccctcttccccaggcagctaccaaactttttcctggtgttaaagattcatttgttgttttctggaattttatgtaaatagaatcatataatacatcatttttggtttatagtctgtgtccattgacttagcataattatttcaagattcatctatgttgtgtgttttagtagttcattcttgttattttgatgcttattacattatatggatataccatagtttatttacctgttaatgaacacttgagctgattttattttggacctattccaaataagactgctttgaatattcatgcaaaagtcacattttatggaaaaatgctttcatttctcttgtgtaaatgcctaggagtagaaagactggatcatgtgtaggtatatgttaaacgttttgtgaaactattcaaatattttccaaggtggttgtaccatttatgtatattctcaatggattgtgtacgaaatcccattctattttttttttttttttttaaaaggcagggtctcactgtgtctcccaggctgggtgtagtggtgtgattacggctcactgcagccttgacctcctgggctcaagcagttctcttgcctcagccttctgagcagctgggactacaggcatgcatcaccatgcccagctcaattttattttttgtagagatggggtttctccatgttgctcaggctggtctcaaacttctgggctcaagcagtcttcccacctcagcctcctgaagtgttcggattacaggtgtgacccaccatgcccagccttgcatcacattcttaccaacagttggtgtgtagtctatattttcattttaaccattctagtaggtatgtagtagtagttcattgtggttttaatttgcatcaagcatcttatcacatgcttatttgccatttgtctatctttctgcatgaattgccttcaaatcttatgtttattttgtattaggttgcttgttttcttgattcaattttaacagttatttgtatgttctggataaaagtaatttatcagaaatgtgatttgcaaatattttctcttactctatggcttgtcttttcattctgtttacaaggtgttttcattttatttatttattttttaagcaaagtcttgctctgttgcctatgctggagtgcagtggtatgatcttggctcactgcaatctccacctcctgggtacaagcgattctcatacctcaggtgtgcactaacacacccggctaatttttatatttttagtagatgagtagactgggtttcaccatgttacccaggctggtctcaaactcctgggctcaagtgatctgcccacctcggcctcctaaagtgctgggattaggagcgtgaaccaccgcagccggccacaagttcttttgaagtgcagaagttcttaattttgatgatgtctaatgtattagttctggttattcattttcttttgggtgttgtatttaagaaatctttgcctaacctaagatcacaaaaactttctcctgttctaagtgtttttgagtttcagtattacatttaggtctaatccatttcaagttaatttgtttacatggtgtgaagtatagacctcagttctttgttactgttgttgtttttgcatctgtatgtcaattgttacagcattatttcttgaaaagattatcttttctttcactaaactacctctttcaccttttcaaaaatcagttgacacagatgagtaggtctaattctggagtctgttttgggccattgatccatctttatggtaatagctcactgtctttatcactataaccttataataaatcatgaagtcatgtattgtaagtcattcaaatatattattcttctaagttcttttttcttttttctttcgtttttttttttttttttttgccttatcactctgacttagaacttccagtccaatgttgaatagaagtgatcaccagcagacattattatcttgtttctgatcttggggaaagcagtcttttattattaagtataatgttttctttaagtttgttgtagatgccctttataagtttgaggacgtttctttgcattcctactttgttaagagttttcataaggaaaggatgttggattttatcaaatgattttttttttttttttgcctactattgaaatgatcatccttttttcttttttagtatgataggttaaggatttttttaaaaaatgttaaaccaatctagcattcccagcataagctatacttggtcgtgatgtgttatcctttttatatatagttacatttgataaaattttaagaatttttacatctatgttcatgagggatattggtttgtagttttcttacaatgttgtttgtgttggtctcagattagtgctagactcttagaatgaattgacgaaggttctgtcctctttaattttggggaataatttttatagaattagtgttatttctgaagtgtttggtagaatcctgaagttttttaaatgacaaatttaatttctttaacagatgtagggcaattcaggtttatctatttcttaagtcagttttggtagtacatgtctttcaagaagtgtacatttcatttatgttgtcaaacttactggcataaagttatcatgttgccctattaaaatatgtgtagaatccatggtgatgctgcctctccttcttctgctatgactttgaaaaccaaattatgtcttctttagtatttatattccctaatatttggggtattgacaccattttatgttcacctgattgcttcctattttctttcagttatgccttcggcattctttagatatcattttacttcatatttgtgtcattagagtggcaatgaagtgttccaagtacacaaccttatattgtaggttttagtaaatgaaaatcactactgactacccagggtctcagtcactttttccatggatctgctgtatgacctttcacttcttccactcttggagcctcatttactgacatgtaaaattagggctgataattttaaacctgttgcttctctaattgaaatattccgtaggatcctggtgttaatctattgtaactatctctttctcctccagcttctaagggcagctctgtggaacccaagcaatgttcagatcagtttctgcataattcctttttgtggtaaaatataaataacataaaagttaccattttaaccatttgtaaagcagcccagtggccataagtacatttacactgctctgcaaccaacacaccatccatctccagaactttttcatcctctccaaactgaaactttgtgcccgctaaacaacagctccccattcctctggcgcccactccaggcaaccaccattctgctttttgtatctatgaattttactatccctaggtacctcatgtaaatggaattgtataatagttatccttttgtgactagtttatttcaccaagcataatgtctttgaggttcatccatattttagcatgtgtcagaatttcctttctttttaaggctgaatagtattctaatgtatgttcatacattttgtttatccattcgtcagttagtggacatttgagttgtgtctgtcttggttattgtgaataatggtgctatgaacattgatatacaaatatctgaatctctgctttcagttttttggggtatatacagaagtggaattgctagatcatatagcaattctgtgtttagtttttgatctgcataatctctttaaatctcttttagcgttaatatttggattcttttttcttcacatgtccagcccaatcaaagcatgaaatctttacagagtgtgacttgaaactttaggagatcttttaagaccatattcattgtgattttttttttaactataatgttatgttgtgaggcctttaacaaataaaattacattcatagcacatgcaagttctgtctctatttttagctgactgtatcatgttcctagttccttcccttcccagcttagatttcatgatccatcatggaatcaatcagtcacttgcaaacatccttatccctgttcttcctacttgccttgaaaattcccaaaccttcttaaacccaactttttgtcctattctgtgcctgcactcaagcagctgaacatgtttggaggaaaagcacaaactctggagcttgcctcacttacatttattagcacaaatccaaaattaatataaaactacctgcagtcataataattgctctgggtaccgagctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatacaaaacttagcccggtgtggtggcaggtgcctgtaatcccagctacttgggagtctggagcaggagaattgcttaaacctgggaggcagaggttgcagtgagctgagactgtgggccactgccctccagcctgggcgacaagagcatccatctcaaaaaaaaaaaaaaaaaaaaaaaaaaaaagcaggataatatgaaataatgtcctatattaggcaacatttcaactctttaattgcctcctcttttctgcttattttagtaagtgtcgattttatatagtattcttttctaagtccaaagatgtatacactttgtctggagtaagcagaaggtcaaatatatgtccctcatctaaagtacttagaatggtggtttatttagctactaaaatgattactcacttgggcaagttacattgcctttcagaatttcaggtttctctataaatcaaaggttaactacagccatctggccaaatctcacctgcttctatatagtccatgagctgagaatttttaaagggtttggaaaaaatgcaacagtgaccctttgtggtctgcaaaacctaaaatattgactatctgaccttttaaattttaaaaaataatatgaaagaattataatgctaggaaacttggtaaatacattttgctttaataattagaatgtgttgatcctttaaagttaattaactgtatctcgggaggatagccacttaatgaagttgtatgttgtatcagctgtttttttatgtgtaaaaaagcaagtttgaagaaatttaaatttcccatgtcaaattttgttttagggataattagcatatacaataatacctttagaattgaaatatctactttcttaaaataatttatgcaagtactaattgatagattggcatatattattagttctattactaaaatcagtgcatttttgtgttttgtttccttttatttagatagaagcagatttgggatatcctggaggtaaagcaagaattattcataaggaatctgatatcattactgcgtttgctgttaataaggtaagtacatagacattcttcttttgtttattaagtatttatagttggataatatcttctgttttatcagtttatccagtatttctttcccaaagctgcttccagttccttaaattgcaatctggatacttttttaattttataaaatgatattatttgataatgtgattttgttattatatgattttggagatacagctgatacataatgttttattactatgcagagagaagtaccaaatatatagacaatcgctttagaatttatacaatgtactatagtagttaacccacagaaaaagttttttatgttccttatgaatatgtcaaatgtggttctgggtatttggtaagatttaagcttatatgtgactcaaattctccctctttgatttatacctccgatagctgcccaacgtgtgtattttcttagtatttcttaaatttctacttaacatcctccttagatgtctatacactcctcacagaagaggtggccttaggtactatagtccaagattgaaatctgtcttattaatcattttccccttctgtctcccctaattgccttactgtatggttcctaatgacttctagttattcttttgttttccttccattaacttaaaggatatgtgtatcttctttttatgtattcatagaagatacctaaaggagatattgtatacatatatataagatgttcatatgttcctaattttaaaataattgttaaatgttatgtagatacataccctgtaatatgtatatgtaatatgtaatacagagaagtgtgatatacggggaaattacccatttagtaatcctttcaccagttggttttctgtctttctgtgctatgtctgtcttctctgaattcttctggacagtatctttgttgttctgtgtgcttcacttaatttccttcttagacaccgttgagcaatgactggctaaagggctgattccagatttgcctgcttcagacagttctgttatcaaagaaacagttctgtttgaaacaggcaaatctggagtcagccccttagccagttgtaatatctgtataacatgatattatatatacatgtcaaatacaaaattattggccaggtgtggttgctcacacctgtcatcccaacactttgggaggccaaggcagtaggatcactagaggccaggagtttgataccagcctgggcaacattgtgagaccctgtctctacaaaaaaaaattatctatacctgcattacctgctctttcttgaagaaaatatgatttaaaatagtctgtgctataaaagaaactagttgttttcttcttgagggtttatatataagtactggtaatgaatagctattcacatatataaagtctacaagttactgtctatgaatatgcctgtttaatttttatttccccagatttgctatttttatttattttattttattttattttactttattttattttattttattttgagacggagtctcgctctgttgcccaggctggagtgcagtggcgcgatcttggcttactgcaacctctgcctcccgggttcaagcgattctcctgcctcagcctcccaagtagctgggactacaggtgtgcaccactacacccagctaatttttgtatttttagtagagacggcgtttcaccatgttggttggccaggatggtctcgatctctttacctcgtgatccgcctgcctcggcctcccaaagtgctgggattacaggcgtgagccactgcacccagctgatatgctatttttaatatccttactaaatttgcagctgagaaataatacctcttgctttaagttgcatttttttaaatgccattgagattttttttgccatttgtttagttgggaactacctgtgtcaaaaactatgaagggtctcagattttaccttaaattaaaactaacagttagctttctgtttctgttgccacagaaacagttctgtttgaggcaggcagtggattgtttaaacagtccatttaattgatccattaaacattttagtggatgctgttagaagacatacgactcttggatcagagacaaaggacagtttatgtcttaacagcaaaagcaataaccagaaaatcagcactttacactggttgcctgagccacaatttccagagaatgacgggaagagggccagatgatacctaccttacctacacacatagtaggttatattacaggagaggatctctgagtttaggggacccaaatcttttataatcgatagtaagcatacttgccctttgctctggagggagagacgatagttatacaaacatcctggcaattatactgcagaaaaaagggcagacatgactcacttataaaacatgcagaatttgggatacccatggagaataaccacccaataatctagctatatcattttttcatttatttctaaggtctcagttttttcttaatagtttgtgttaaaatctaacataacagtaatggtaatcctattttctctttgctgtcaatatcttcctgttttctgtttcaaagatacacatttaattaattaattaatttatttatttatttatttattgagacagggtatcatgcctggtgcccagtgctgtggtgcaatgtcagctcactgcagcctcgacctcctgggctcaagcaatcgtttcacctcattctcccaagtagctgggactgcaggtgcatgccaccatgcccaactaatttttgtattttttgtagagacagtgttttgccatgttgcccaggctactatcgaactcctgagctcaagctgtctgcctgcttcagcctcctaaagtgctaggattatagacgtgagccactgcccccagccaagatgtacatttttgattcataggcatttaaaatttcatgtcatttaaccttagcaacttttcatttgtgatctttttctggcatacttctcccactatatttctgcccctacaccttttttctgtgaccctttcccacttctttttttttttttgcctaagattgaaaagctttaggagaaagtttgttttatttaaataattaataattatgtttttagtttggagttccttattgccctcacctttctgtaccctacaggttcctatctttttcagcatcttcctccacatttctgaattgtgcataccttagagcgatcatagcattctagcagtctagaaaaacagtactgggagaggaaataaaatgctgcatgtattgccatttatactggctttctattggatgtacttttcatagaacataaacgtatctccaaactgaagcttattatttcactaaaagtaagaatgctgtatatcctgtactttagttatcactgctagaggttatttcaaaactaccattttcaaaagcagctcatatactatctcttttgcctattgcttttaaaattaccatttgacttatttttcaggcaaatagaaactgcatagcaatcgcttccagtcatgatgttcaagaactggatgtttctggaattctggccacacaggtctacacttgggtagatgatgatatagaagtggaaaccaaagggtaccttcatagtttgtttctatttagtaatgttgcaatatgagtgactatatttactgaattaaaactttcaaaagattctttaaagcaatgtatagattgtaagcagagtagaagctgatgtgctaaatgaggggtggcaagagctttaaataagggaactgagagaagagtaagtgaagggaacagaaattgttgaggtatgaggtcattgtgtgtgagttacaaataagagctgaagaaaattaattttaaagggaactataaattcaaattttagacctttcaagtgtaaaaaagaaagaaatgatgagttgtttttattctggttgacattcctttatagatcagaagatttcttggttatacatgctcgtgatgatttaacagctgttcaaggtacaactccatatacacatagcaatcctggcactccaatcaacatgccatggcttggtagtacacagactggcagaggagcatctgtggtatgtaaagttaaaaataaatttaagttatatgtaacttttatttttccctctaggttaatggataaaggatgatttaaaacatttttcttaattcctaaagttttagtaagtcttacatgttggaaattgtaaattttgataatgaagactagtatgttttcatttgaaagggtaataataaattgttttaaaaatatactttgcttgaaaaccaaagagctatattttaattaagaattatttgaaacatggttcagatcaggcttcagcaaggtgttccccatagatcaaatattacccatgacctgtttttatatagctaatatgctaagaatggtgtatacattttagtgaaatggtttatacattgttttttcaatagttgaaaaaacaaacatagtattttttggcacatgaaaattacatgaaactggatttcagtgtttttttacaaataaagttttataggaacacagccagtcatttgtttccattttgtctgtggatgccttcacactacagtggcagaattgagtatctgcaacagaaagtaaatgcccataaagccaaaacacttgctatccagtcctttataaaaaaaggtttgctaaccccttgtctaggtatcttttaatggatatcaattaataactatatccatattaagtatcacttttttaaatgccaggacaaatattctttttttttttttaacaaaaacaatatataatttcttaagttaagcaaaaagcaatataataatgaactgaaacataatttttctgtagtgttggaggatcttttttagccctgattacctagagatgtgattcatatttgtacttccaagcctttattattacgtaggttataggaactaatgaacggatttgaagaagcaaagaaaggtggtagggtttttcagaatttcataagtactgtagaatgctttccttggccaaaaaaaaaattatttttcattaattagtatgagcaattgttcaagtaaaatctgagttatctttaataataccttgtaatattttgtacctaatggagttcctttatagttgctgtaaccttataatttgcagtatctgttgtagttgttatttactcgtatttaaacattcttcagatgaagcttgagatccaaaaaggtcaagtggatcaacttatgtcactttgttaaatgtatggtagagcttgttttaaagccctctgttctccttagttcagtgatttcaagtagcagtgttttaaggattaaaatgaacttgaaaagcaatctagtaattattcaaatgaaatgacttgctcagtggtggttaaataatttttccagctgacagatatgttacaattcattggtaaaacttactgatattatattcttttaaaggagaactcaaagggaatatatgccaaagaagtgcataggactaataggcacttttttgaattccaacctcagagattacaatatagttcttcctgtaacatctttcttgttggtctcttcctacttctattctttacacagcagcagccagttactcttttctaaaacatcattcaggttgtcactcgctttctaaaaaatttcagatttcccaatacagcttttaaataacaagtcattaatagggccctacaaaatttaaccttctgccatctcatctccctttattctacatctgattctctttgctgtaattacactggcttctttctgtctcttgaacttattaagctcatggttatgtcaggagcccttgactttccttctgcttaaaatgctctatccctctgttgtaccattcacatctcaactcaaatccccccacatttccctggcttccctaattaaggcatttgcccctacccactctacccccagtcaccttatattttatcatctttattatcccttgcgcttaccagttattgaaattattcattacttagttgtgtttttttttttttttttgagatggagtctcgctctattgcccagtctgcagtgcagtggtgcaatattggctcactgcaacctccaccccacaggttcaagcaattctcctgcctcagcctccctagtagctgggattacaggcatgcactaccatgcccggctaatttttgtatttttagtagagatggggttttgccatgttggtcaggctggtcttgaactcctggcctcaagtgatgcacccagcttggcctcccaaaatgctgggatgacaggcatgagccaccgtgccctgccttaagttgtcttttttatatgccctggaatctaagctcttcgagagcttggattctgcctgccttgcagattgatgatttctaactagaatggtattggacgtatagtaggtgttcagaaaaatgtgtttatactccaaagcattgtaatacagaaatctaccataggcataacactaaggattgaattttcttcctacctaaatcttaggacatctttttatttcggataactgtgatttgttaacatgagggttcggattgcctcactctaccctcaacaaaaagacaccagtagaataaggttgttcttttttacatggatcttctaaaataatgattttacatattttacatatgctttcagaaacttttttaaacctgtgtttgtatattttttttacgtatggttctcctgtgaatattaaaaaaagaagacaaaagcaagaataggaaccttcaggcatttctttaattaagaagaacatggaatttaaatatgaagtttactaaacagaagtcatatgcagcaggtttttattttttctagagaactgataaaatattttctttatcctttcattttatcaaatgataaaaactaatagcaaaaaaatatcattatgaccagcttctgctattttggagtataactgcatcaatatatgtgtttcagttttatttatccctcttcttttctctggcctagtctctgttctccctaccaactccccaccttctccacaactttaggctaattgaaccatttaaaatccaaaagaataacaataacaaaacctacctgagactgatgctacaaatttaagataacatatatttgtagttatgatgctatataaattggaaatgttctataaatttttcctttaattttatgtgtttgttttactcttatttgacaggctagttaaattattcaaagcataactttaaaatgagtaaatacatagttccaaactgtttttaaatttatttaattttctcttcttttattttcacatgctcctgtcttttaaacttacactattcaggattattactgaataataaatgtaatgggatcagaaaagaattgacaagaaaggagggaagactaaattcttgaaaggaatttatctttagatcctagtcagtaatgcccaaaatatatgtgcaaatataagagctgcactattaaatttctgttatcatgtttagtatttttagcacccataatgatagttatgaactcatgtaaaaataaataaatgaatgttatttgaatttcctgtcacaatttaaatgtttaatcctttttattatgcctataaaataatttttctattttaccagatgattaagaaagccattaataatgttagaagaatgacttctcatccaactcttcccttactgtaagttgaataataattagcaattgtcctttcttattcttaaatctatttttggtaattttattataagaaatgtgtgggaacctttttgttttaattgaaagcatttatttgactttttttctagcgaatatttgccagtaaataaaatcttgatttcaaaactgggtaaaaatagaaaaagatatttccctaaaagagaaagctgatttaatgaagtaaattttttgacattttgactaccaatcaaaatttgcgactaccaatacacaaaatttgtgtatttctaagttaacacattttatctttgaacatttctggatttctttgatcatgctaaattatagtgaataattattttaataatagaaccactgccaacctttattacataagccacaaccatacctcaattatttattacctcatcatactcagtttgtattttattactttttttcagttggtcttttatgagacacattaatagtaaacataggaaattattattagtttttatattctaaggcagaatatatgtgttttcagttaatcttcctaggaatcttaaaagtttctcttccttcaaccaagaacttaattaatggggaatttattggaggtattgattctggtgggttggaatcaatactcatactggtgtgtgagtattccaagttttttaatatttttttttaagttatgcccttcgtcaaattgtcctactacatagtaacaagaataatgcatgttaattaatgggtattcatgtcccccagtttaatagcctattaaaaactttagaaacttttctcttgggagatattctgataaaatgcagttaacaaaatcagtattcttttctgcttcatttatgataaatgctcaaataatctattatcaaagttgtgtacgctgtacgaaacaaggctcaagagaaccgtatatgtaaaatgaagagaataacatctgttacttatgctagaggtataacataatataaaaaatttgtctgttttcactacatcaaatttattcatcgctagaagtgtgtattttttacccacaagtttaatgtcaggtgagaactaaaaagcagtcatgaagcctatagtgtaaggagtcaaaatgtgttttatatataaaatttaaataatattattctacatcaggaaatacttgatattgcttaaaactaccctattctatgcagtctggttggaagttttctgagatactgaagggacttcatttttctctcagtcccataccatgtgtcctggcaggtgtaaatatcctataccttaatcccataaacttaaagaggccacgctcaaagcttcaaaggtaattgatggacctattgtcagaggtgttaggtagcatcaattactgctgtcttgagagataaatactttctctgtttagagaactgccaaaactagcagataagacacctgaaaaattaaaagctaattactggattttttttccagtatatcttttcatgtcacaaacaagtcccacaggtagtaatttagtttgataacaaacacttttcgtgttgtgaaaatgttatgagacaggatttttaaaaatattagtctgaagttcagatacctcaagatagctgttttctttccttggaatagatcttttgaaaaattcttaaagaactttttagaagttagcctagtacattttataattttctgagtagaaaacacactgtttctctatgctgtcatgtacagttctgataccagatgtgttggcttttgtccactccaagccattctccacctctccaagtactggctgggtgccttataatttggtttaattatgacacagtctacctggagttagaatcatatcctacaggttaagggctcagtcccacaaaactgctccttacttcagacaccactcgcaggttatcagttttcacctacacatctggcatactggctataaatcagagtgcccacagctccctccttgggtttgattaatttgttacactgattcacagaactcagggaaaatgctttacttacatttatcagtttattataaaagaaacagatgaaaagtacatagaatgaggtctgtaagactcctaagcagaggagcttctctccccttggagttagggtgcactacaaacctggcacatggatgtgttcaccagccaagaagctcatcagatctccttgttcaagagtttttatagaacttaatctccagctccctttcccacccttttctggaggttggcgagtggaactgaaagtttcaatgctttaggctatctgtgggaccccatctaagacactgcattagcataaattcaggtgctcttccatgggttttagtagctgtatgccaggatccagggacaaagaccaaatatgtattttatgtcacactgggtcattttttttcccttctaaaatgtttaatgtgttttccctgtttaattttttccccttctaaaatgtttaatgtgttttccctttttaataagtatttgttgaaatcatacacttgataggttctatataagcctagctgagtaaaagtgaagtctgctctgctggaacattaataaggaatctcagataagatttttaaaaacctcttgaggctcagaagtcaagccaaggacttgccatctgatttcacctgcagtcctatagatttgggttgattgctcttttcttgaggtcctcagaaaatcctggggttcctttgtctgccaggaagtgatagtctttactcttctgtaaggcaaccatgtaagggactatatatgtacagtaccaggccagtttttctgttttttggttttttttcaaggtatcttatttgctctgtcagcctttggttccttaaagctgtctgggtgatatctgattctgtgcatagtctccaatatgatatatgagtcaaagccttggtaatacgaccgatgtttccaattatgtcctgctataagaaggacaggttctttttgcttttactcctggcaagctgtaaagaacagattcttactgaacttatgcaaataactatattgccatgaaaataagaatactcactaatagcttccaaattctggagggatcaggtagagagaaaaagtaattgttttatctttgttcacgaaggcatactttgccaaatttccataaactactgaatagcttaagagaaaagaaaaaagttttcttaaatctggaaaacaaaataaagacctagcaatgtttcaaaaccataattattaaaaaaccatagattttcttcaataagttattcagcctctcatacttaattcttgttcgacttgatcttggttagcagtttaatgaatttataagttttttcccttagagttctggaagttcttacactgtccaatgataggatctaaatgttatcagaaaccagtacctttcagagtcttttctatgaatctccttgaagacagagcactttaggattatagttacttgcagacactttcagtgaagatcaggagaaacaataaccatctgtcagtgacaaaagacttaacatggccatgactaaagatcaattcattatcataatgcacaattgacaagtaaatttgattgcttctgtggcatacaatattttaacaaaataactgaaagtatggctgataacattatacaaggacacatcagatttttagaaccttcatgcaatttctggaatacttatctaatagtatatacccatacaaatataatataagaaggtatcaccgttatttgacaatgcttcccatgcaatttaacatatcaattaagcctaattattttaacattcttctttttagagggagtgagaacaaattttttttgagatattgcaagggccctttggaaactcgcaaagttagagtgaggtcaaaagtacttcatttataatgtatttttgggaaatttgtcaaaaatatcaaacagtttaaaacacttgattatagtaaggttactgtggaaaaatatttaaccagagtgataattaaaagacatcaaaggcaaatacagaaagttatgttgttgtagaaaaatccttagctattttaatgttgtagaaaaaaaaccttagatattttaatattgaaatatagctaatttaataataatgttaatattaacattaggtcttaggtaatcaaagacctaaaaagacatgaagcacaggaaattatcttgataaaacaaaatctcggctgggcgcggtgactcatgtctgtaatcccacctcttagggaggcagaggtgtggggatagcttgagcccaggagttcaagacctgcctgggcaatatagggagaccccattctccacaataaaggaaaaaaaaaaaagacaaaaaaacaaaatctcgattttgtagtcagattgcttaaaaggtaaaaataataatattaacattaggtctaggtaatcaaagacctaaaaagacatgaagcacaggaaattatcttgataaaacaaaatctcgattttgtggtcagattgcttaaaaggtaaaggaaaacctttcataatctcttgtcaagagaaaaccaatactccagtaaaactttgcaccaatgtacttctgatattaaggctcatcattcttttaataacatatataaatacacacatattagccagcttggccacacataaaattatttttccaaattcctcttacacaaaccctgtatagcattctcgtatccatgcatattttgttctgtactcttcctctttcccaatatggaacagtctgctttaggacaaaaattattctttttcccataagaaaaacatccttcatacctcatagcttcacattccaaaaacatcttactttcctgacatacaaaattatttatctattttcagtagttttaattacatatattgattagaattcttaactgttagtaatgttagtttctagtgaaaactaggtaataagcagttgtgcactgtcagtcacaccagcattctatagagtagcaaatctatatctttcataatttacagaagcatgttctttttcatagtatagtttttcagtgtgtcacaggacacctttactaacagacccaaatatctttattcttctgcaataagaagccaaaagtagataagcttatgtttagcaattaatgttttagtattttatgtaatttggaagtgatctagatattcaattaatatccatcatttaatttaacttaatgaaatactaagggtataagttgtcaaagggatttggaaaactgttttgaagtagacataacaccagacaaggccagccatcaagttagtcattatttattttttgctgacaaattttgtaacaaagataacatgagtgtatttgactagtaagcctaagtaaaataaaagttgtatatcacattatatttagtgctggtaactcttaaggatatgcctgctttaattaaaccaacaaacttaaatttgctttcatttaccaaagattatcccacatcagatgaacttgaaaaacatttgggtctgtttctatctttctaaaagtttaaggaatacttaatttatataagtgcttattttaagtgcgttagatataattattaaaaattaattttgacaataccatctggtgatagaaaaatattacatatatttaacatatataaagtcatacacaaacatacaggcagaagcagattctatagttttccttctaaattttggcgatctgccagatacaaaatatcaaactcagtcgtttataaaaaggatatctgggccgggcacagtggctcacgcctgtaatcccagcactttgggaggccaaggcgggcagatcacaaggtaaggagattgataccaacctggctaacatggtaaaaccccacctctactaaaaatacaaaaaattagctgggcgtggtggcacacgcctgtagtcccatctactcaggaggctgaggcaggagaatcacttgaacccaggaggtggaggttacagtgagccgagatcacacgattgcactccagcctgggcaacagaacaagactccgtctcaaaataaataaataaataaataaataggatatctggatccaaattgtgtttctgaaaatgggacaagattacccacccagattgctaaaactttactattatttgttgaagacttttaagatttctcatttgtcttttgtaaagactcttttagagagacaatttacagttcatttagtcttctagtagcctctgcataccaatcaaaaaatgcctcccactgtttgtgaagcattagagattcccttttatttagtgcttcctgtagatggacaattttgtgtaaattaaaaacttccctgttgtggccaccataattctaaattgtctttggtaaatatactcatttctctaggaaagcacaggttctgggtccataatgtttatgcataaaattagctggagttccagttggaggagtttttgaattccttaaattcagatgaacccatgatttcttgtccttccaaaatcttatctacctgaggcctctgactggacccaatccagtcaggttcagtctgacttctagacctgatctgaatgaaaaatgcttaaaggataaaagttgcaggtttcaggtcaagcggtaaccttcaaatgcacagtgagaaacagtaggcacaaggggcctaccaggaggtaactgtgcctggttacttgttgctcctggaggtcatcatcaggggatctccttcatgttcctctgctgagaactcttaaaacataggtacattaaaaatttaatgagtttattttagctttcagctcaaattcatgaactgggcaacaccagaccagaagccattaaggcttcaccgaggtggcatgaggggaaaacttttataaggtgttcaaggaagcacaacaaagacagtatttgattggttaagtggaaagtcctcagttagaagttagttgggggtttctaattgataagcatctagttagaagttagttggtggtttctgattgattaagcttaagcttcattttactgtttacattgaattgagttttgatttgctcgtataggcatgcaaggccctggagctgtcttagcctaatagcctcccaattaatttcttttttttaagatttttttaagagacagggtctcattatgttgcccaggcaggagttttatggctacttacagcacaatcaaggcacactacagctttgaactcctgggctcaagtgattcttctgcctcagtctcctgagtagctagtactataggtgtgtgccaccaaacccagctcttaattttttaacgttataaataataatagaaaagttgagcgattttagtgcaaccaccccaatttatttttctgattaagctatgcaagcgcattgggggaaagggagtagagccagtcaaatacctagtctcaaaaaactctacctcctaccgctgcccaatggtaaaagctttcaaaccaattgaagttcatttattttaaatatttgataaggaatgagggaaacttgactgatatgtgactagcaagtgctagatgttttatataaatgtattttttttactacctccataccacattaatattgataatgatactctataaattgagtgttatatgttaggcatatttctgggtgccttatatatgtgatctcattttctactcacaactgtccagtgacttatatatcattagtccctttttacaggaaggaaatggtctcagagagattaagtaaatttcctagtataacacaaataataaatggcaaagcgaagaatcaatagtcatttatcttattcatatttctcagtaaaacaagtccggtgcagtggcacgtgcctataaatcccagcctcttagaggctgaagtggaaggatcacttgaggccaagagttaaagaccagccttggcaacactgcaagaccctgtctctaaaaaaaaaaaaaattaactacaaaattacaaaaaaaacagataacatatatttgagatattaggccaatcaggataacttttagaactgatttttttctttagcatgacatttaaaaccttctttaatctgatttttttcaaagaaaaatgtgtatacatttacacattaatagtataataaggattgattctaacctaagaatttcttataatgagtaatatataatttattataaaaaataaaaggctgttaagacatcattgagataactttaaagggaaataaaatttatggagctatgatttaaatgctcctatcgtatttgaggatgtgttcttagtcaaatgaaagtgtattgtataactatttttatgatgaatagtattcaactgaaatttcatacaaaggtaaatttatataagttgatttagatgtttctttcataaagattttcacataggataaagaaataacttttcccaaagattcttgaaataaatctgcaatttttgccctcttgtaatgcagatctgacaggagctcaagatggaagtgtcagaatgtttgaatggggccattctcaacaaataacctgttttcgatctggtggcaattcaagagttacaagaatgagatttaactatcagggaaataaggtattatataaaaatgtaaatggtaaaaaatttattgtgttggaggtttataaattccactagtttgggtttctgaaaagaacagctccgtgggtagtagtaaagtattgatctatatagatgcttttaaattcttctcaaagaacacttaacttcacttgttcttcctagaagtatgttatataggtgtccattaaaactcagttaagtgattcttaatgaccaaacgattataagttcaccttatattacacactttttattattaaatgctcctactctctttatccctcggaacctactcagtgtgtgatccagcagcaagtaacatctagagcttattataaatgcatattattgttccttctccagatgtgctgaatcaccatctgcattttaacccgatattgttgtgatttttacaaatattaaagttttttaagaggtactgctccagaacaacatcagcaaactacatcctagccacctgctttataaataaagttttgttggaccacagttacccccattcattatttttctttggctacttcctactacagcagcatagttcaggaggacaaagaccttatagctggcaaaataaaatatttattatgtggccacctaagaaaaagtttgccagacctgctctagagcatcctttactgtcttcacttctcataatcctttgttcaaactgcccccctccccacttttatgttagacagcaatcttttattgaacagtactgctccttgtgaagcagggctagttcagaggcagtgcacccacagccagcccaaactgcctctttttgctcctaatatgttattagccctttacaaaataattaaagagtaaatcagtcttctttttgtcttcagggccatgctgcaccaaaaattactctcacagactctaactgatggttcaccttgccttttctttcccctcagcctccctcacacattaaattctcctcacacattccttttatcattgtgtgatgcaaccttttttgtctaccatgtttatcacatggctctattttcatttcacaaaagtagttttatgtagttgtgaaacaaaattttgagagcttgtttcttaatactaattagcaacattcttagctccttagtgggaaattaagggaacttagtacagatgcctgtataattctattgtacttttagttgtattctctatcaatgtgctttttgtgcatttcaacttgggttgtcagttttatattgctcctaactaatctctatacctgaacccttatctctctaatgcatcttgccaacagtattatataacaaaaaacatagctacatgattacaatataggtgagatcacattattatttttttcaagaacccttcaaggctcctcatgtcaacttctttaacaagtatttaagaccttctataatgtgactatttttcagctttaacactcactacagccttctgcataggctattttaaggcacaaaaaactgcttgtctttgcctgcacaagtatctttgaccggcagtcaacttactattcattcaccttagccttgacgaagtctaatagcacagcccctaagcatgctatctcttctagtagggaagcctcttaaggtaaatggaagagataactcacactgtatcacagtaattctgatgaattggatattcaattatgaatagaaatacagtgccaaaagccagtgaatatttcagaaaaactaagtgtctggaaaggggtattaagcagaataaataataaataacctatgaggactaattcctcagagattcaagaatatattacatttatacaacaagaacatgctagcattaaacaaggacagtaggaaaacagaaaagagttattggaaattaaaaatacgattcccaaaaatgtggtcagtgggggaactacttattagaaaagctgaacagcagaatggaaatagttgaaaatcaggtttgttgctgggaagcacaaattaagaaactatcccataatgatgataatttaggaaatatttcagaagaaaaaaatggaggaaaaacaatattcaaaggaataatagatacttccccaaagcaaagaatagaatattggaagagaaagggcctaccaagtattgagaagcaaaacgtacctgcacacatcctgtttgtgtaacttttggtttttagagttaaagagagaatcctataaggttctaaaaaggagtgagaatgaaaaaggttatttacaacccacatcccaccctgccactaaatgtcgttggcctgtcacaaatagataggagaacaatatccacagaattctgatggacaaggaatgggaactgagtcgatgtgcatccaaactatcattcaaatttgctagcaaaataaacatatttttaggtatacagagacttaacacattccatgtgtataccctttctgaagaacatacctagatctactccagaaaatgtaagataaactagaaaaaggaatagacctgggaaaatattattaacaaatataaaaacagtaggttaatattcataatattagtcatatcagttaaattttttaaaagacaaatagtagagaaatagataaaacatcttaacagtttaccaagaaactttgcctggccagtagccttctaccttcactaataattgaagaagtgcaaataaattgagacttattcttgtctgcataaaattaacaagtattttagattttaaaaataccccatgttaactaaagtgtaagaaaaatggctgtatcaatttatattaccacataggatttaattttggcatagtctattaattttaagtgatgctctttaacaaaactttcccatttctagatgtctatcctacataattatgcaaaggtatatgtatatataggaatgttcaaagcagccctttttatattacagaaaattgaaaacggtatggggaaagttttaaattgtaataccactgtacagtgtaatactacacacagcacaagaatgatctaaatttatgtgtaattacctgggaaagatagctataataaataaaaaatgtaattgtgtagtggtattattatgatcccaattttttaaatgctatattgtgaatttttgaatactcatagaaacaaatctgaaaggaagcacatcaaattgttaatagatgttagatctagaggcagaggagggtgggagtacaaagcagacatttattttatatactttataataagctgcgttatttttataatcaaagggaaaaaatttagctgtcttactcatccttcaagatctgtatcaagaatacctcccttagtggattattttgacatcttaccagtcagacttgccctgagctcccatagcggaattattttactttgataatccttatatcattttactttgtactcttgttcatgtgttttccttattgtttgtttctgaaaatccttattttatctttctggaaatgaacagttttctttcttatatatgataaagttctgtcacatagcataatctgttaatccagtatcctgtttttgtaatacttacagagaatatatagactatgctagaggctactgtaataaaatgggtgtctgatgtttgttctctttatgttcaccctgggatttttaaagtagtagctgaatgtttttctgaaatagatccatgtataggtgaagtgaaaaatcacatgacatacagtcaaatgtttacgagtcaaaatatgggtgtcacactgagggtaaggataaatatatgcttttatatttatattaaatacttttaaatattttctttctctaagtttggaatagttgatgctgatggatatttaagtttgtatcaaacaaactggaaatgttgtccagttactggaagcatgcctaagccatacctggtaagccaagaatttctacctttaaataaaatttgaattttcattttaaataaaccaagaatacgtatttgagacaagaaatatagaactaataaataaaatatagtcctgtgttctcagtcactttgctgtaagattctgtccttgtgttatgtgaaaattactctgtgaagcataaaattccttagtctctgataatttgggaagttgacatgtatagaagcaacatgatacccccagatacctatacatcttgtggattactagagcccttttctaacctcactaaactggttattatattatgcctaaatagaatgattaccagaccaatgcgtctggttatttttctgcaattatctcttatgaacaaacaaagtgaaaaggacatcctatagctggtactgttattttcttgttcatctcttttaatttaggattatgcaggcttttatgaactttctgtggcttcatagaatactgaatttatatttcatatcttcagtgaagctctttataggactaagcaattcctatcagaaaaaaagttaagaatataggttaagattctggtaatttgcccaaggttaattgctagaatacagtactgatctaagtaaaagcaagcaagcatgggaggattgattagggtaccttgaaagaatattaactgtttctcatatttttattaagcttaaagatttagatgtataagtttgttctctaagggactgttttttttaacttttaaaaaaatgaattggtttaaattatgaataactggcttttggagattaagaggattttgtctgttttaaggacacatcatctagcccagctccagtagtgttccaggggaaatggggagttggctcaaaggaataatctttggtgtggtgattttgggatacttaaaaaaaatcattttttattaaagagaaatatgtaaaacataattttgaagcttttataaatgaagaaacctcataattaagtgtactgtttggtagaatattgaaaaatgctatatgttttctaattttgatgactattagtaatttttttcatgtacttgaatttttaaaagcttaaatatttttgaaaaatatatgtcaattatttaacaaaagtctggtatcatctaaaattctagtttctatcttctgaaacagaaattttcactatgctaggagaaggtctttaagtttaacctcatgttttcctttgaacttttggttgaacaaaagcaaagagattcataacgggtcatgatatatgcagcctacttaaatagttcaggaaaagtgtgtgtatgcgtgggtgtctacaaatatgaaagagaagtagaggcaaaacaaatgtgccaaaatgttaaaaagttgctgcatctgggtaaaaggtatatgaaagttctctgtattacttttacaatttttctaaagttcaaaggaaaaaaacgatacagaggatttaagaaagccagaaactacatgatcacttttcgaagaatacatttacctggttatgacatttttagtgagaggagtaacacgtattgtttgtaaccattccagacttggcagtgtcataacaaaacagccaatgattttgtcttcgttagttcctcctctctgatagctacagctggtctttcaactgacaataggtaagagatgatagctaaaattgaagtatgagaaagtatagctgaacttttttttattgtttctgtccttgtgtttgactaaagtttacttatggctttagatacagtatttttattctaaaaactattatttattggccatgttattccagccccacccccaaaagctgtggttgtaagaaagtgtcatctcctgccccagtatctgtctgcctcttttgatttctgttatataactgagttctgagatcaaggcccactgagtttgcttagcttatatatttatctgtaaggccacactttgcactagaaacaggattgtaagactatagattcttcagctcgtcttccgtagatatttcttacgtatgttggtccccccacacagtagaaacaagttttctttgtgcttaagaaaattcagcatctctcctgttaatgtatgtcagtccaactgttagagattcagtgaatacaaaaagaagtttccatattcagacttcatatattattatttgtaaacgcatgttaatctaaagttattcaaatttttaagctataatagtagctttaaattttctgtaaaaattgtgggtcgggcacagtggctcatgcttgtaatcccagcactttgggaggccgaggtgggcggatcacttgaggccaggagtttgagtccagcctgggcaacatggtgaaaccctatctctactaaaaatacaaaaaattagccaggcgtggtggcaggtgcctgtaatcccagctactctgggggctgaggcaggagaatcgcttgaacctgggaggcagaggttgcagtgagccaagatcacaccattgcactccagcctaggcaacaagagtgtaaaactccatctcaaaaaaaaaaaaaaacaaaaaattgtagccagagcatgttggctcatgcctgtaatcccagtgccttggcaggctgaggcaggaggatcatttcagcccaggaatttgagaccagcctgggcaacatagggagactccatctctacaaaaaaaaatttaaaaaattagccagacatggtggcacacatctgtagtcccagctactcgggacattgaggtgggaagattgcttgagcccagaaggtcgaggctgcagtgagccaagattccaccactgcattcttttttttatataaaaattagtttcatataaatttgttggttacttgtatttgttgcttttataaatttaagaaccttctgtgacagcaaggtttaaaggtcacacagttatatatgacatattttttattgttagcttttgtgtcactcagaagtaatctttttttttttttccagaaacgtatgtttgtgggatactcttgtagcacctgccaatagtttagtccatggtaagttttcaaagcattttataaattttgaaagtcaggaaattcataagctaaatattatttataagtggatttgttactgatgacacatatatttattaacccatgagatttcttttgcccaggatggcaggatttgaaagcaaaaagatgcaatatacgtaattaactcttcactataccttgatgggggacagtgagacatcgataatataaaaatcatttgtctttactttgaatctgatagccacaggttatcgttgtaaacatgatgtaaactcaatattatgtcccctcttaccactcctattcaacattgcactggaattcctagctaatgcagtaacacaataataggaaataaaatgtatataaatggaagggaagaaataaaactgtctttattcacagaaaacataattttctataaaatatcccaaagaatctacaaaataaattcacaagtatagcaaggtcccaggatacaaggtcaatatacagttgacccttgaacaacataaggattgggatgctgacccctgcacagatgaaaatcataattttttattccccccagaatttaactactaatagcctagtgtttactggataccttattattaatatagtcaattaacacatattttgtatatgtgttttataggaagctagaaaaaagaaaatgttatgaaaatcatgagtacatacagtagtgtactgtatttattgatattgtaaagtttatgtcatctgtttacaagatgaattttctgtctgaggccgggcgcagtggctcatgcctgtaatcccagcactttgggaggccaaggcgggtggatcacgaggtcaggagatctagacaatcctggctaacacggtgaaaccccatctctacttaaaataccaaaaaaaaattagccaggcgttgtggtggatgcctgtagtcctagctacttgggaggctgaggcaggagaatggtgtgaacccgggaggcggagcttgcagtgagctgagatggagccactgctctccagcctgggcgacagagcaagactccgtctcaaaaaaaaaaaaaaaaaaaagatgaattatctgtctgaaatggcaggcaactacagctgcagacctcaatttgtggtgcatatcaagcaattcaacttttttcttgtaatgtcttgactttggtctgctttttgggagcacttccagcattactagtggcatgttgtatggttcccatggtgttattcaaggtttacactgttgcactaaatacaatgaaaaattcacaagtgccacaggagatcacttttcactgcaatatacagtttactggagagaagacctgctcacatggagatgatgagcatcacacagcattttaagtatatactcgcaacacttgagctaactgcaatagcaacaggaggtggctactaaattataacagtagtacagtatgtactataattaattttatgtacttatgatttcatactgtatttttgtttacatttctcgactgtcgatggcaccacttacaatctgtatttgtgtgcgtatgtttcaataaatttaactttttgtaatttgtgtatattttatggtagtaaatgataaaatagactagtatctacatatgttttatgcattcatggcatactttttcttaattttttggatatttcttggctatgtgggttgtctgcaagttttttcaaattatctcaaatctttaaaaaatgttccaatatatctattgaataaaccacatctaagtggacccacacatttcaaaccagtgttgttgaagggtcagctgtactaaattcagttgctttttgatgcatcaacaatgaacaattgcaatttgaaatttaaagaatattaccatttacaatagcacccaaaacaatgaaatactgagacataaatctaacaaaatatgtacagggtgtgtatgcacaaaactataaaaatgatttaaatcaaagaagatctaaataaatgagtgatactccacattcacagattagaagacacaatattcttaagatgtcagttcgtcttgattttatagattcaacacaatcctaatcaaaattccagcatgctactttgcagatatcaacaaactgattctgaagtttatatgggaaagcaaaggaatagccaaccaaatactagagaaaaacacacttgtgggactcacattatactatctgatttcaacacttataagctacagtaatcaagacattgtggtattagcttaagaatatacatatagatcatagaacagaatggggagcccactaatagactcacatatatagtagacttatgtttaatatgtcacagaggcaattcagtggagaaacgatagtcttttcaacaaataatgccagaacaatttaatgtcaacatataaaaaattgaacccagatacagacctcacctttcataaaaattaactcaaaatggaccataaacctgcatgtaatatgcaaaataatagaacttctggaatgaactaattggatagaagtcagaatagtgattgcttttgttggggaggagaattgaccatgaaggggcatgaaggaacgttctgggatgatgaaaatattctgtaccttgatcttagtgatggttacacagatgtattcatttgtcagtgctcatcaaggtatatacttaaaaagtgtgcattttcctctgggaagttatatctcaaagtgctggtcaaagttccttctctgtaattaattttatttcaagtcttacaataataactaagtgtttagtttatgccatggactatacatgatctgcatatattaaatcctcaggcaaccctattaggtaggtgataatctcttttacaaatgatgaaactgagacttaggtaagtaattcagcagaagtacacatttaatcccacacagaaaccaggattgaaacccaggcaatctaactccagaatcctcactgttcattatgcaatattctccttgagctatatgcagatttttttccctaaaatttgttaggctggactcttttttaaagaaaaatagtatcatatttttatatttctcatactgctgtgtcttcaaattcatgaatcttttattttacaaggcttaatctgctgttaatcccatccagttccttttttatcttgagccttgctgtttttaatctgttaaattttgatttaagcctttcatgcctctaattaacttaaaattataatggacttttaatttccttacctactaattctgtcatctctattatttctgggttagtttcaattgatggatttttcttctccttatgggttatattttctgctttatcacattcctgttaatttattattagatggcaagcattgtgaattttacttcattaagtgcctattatttttgtattctgtaaatgttcttgagctttgctcagggacaacttacttggaaacagttgaatctgggggaccttggttaaacaggaccaaagcagcatttggtctagggctgattttcctccgctactgagtcaaatgcttctgagtactccaccgaggctggtacggaaccagttcaaccagggttcctctcctggtgccatggtcaggaaactctaagtagtaagctagggcagttttatgactcacccagtttgtttcccatctctcagagatcattcttcattaccttatatccagtgtctgaaatcattggtttttatatttcatttgattttttaattgtttcaggcaggattgcaaatctggtctattatttcactttagccaaaagccagaagtctatttcttttattgttaagtgtttttgttttttttttaatttactttcagcatttacctgccatgacagtggagccacagttttagcatatgctccaaaacatcagctactaatatcaggtggcagaaaaggttttacatatgtatttgacctttgtcaacgacaacagaggcagcttttccagagccatgattctcctgttaaagccgttgctgttgatccaactgaagagtactttgttacaggatctgccgaaggcaatataaaggtaaacacagttgatgccacaacatctacaaaatgaaatcttcagaaaccttagctctttaatcgtattgatgacatcaatctatttaaataatagttatattaattcctttgtagtcagcagtgctaattgctatttaatctttcaatgaatggaatatttaacttgaaaattttctatttttcagttgtttgaaaatatgtttaattcatactaaaacaccaaattttccatgaatataaacataattcagatattagaatttgtcttgactccatgttcagagttacataatttactgaatttaatttccaggggctgagaaatgtattgatattttcttttatcccacattgctcgccagtttttcatatatattattatctagtccctcagtgcctaattcaagaattctggataaaccttgcctttagcagtccttttcagagtccattgtgttgaaaacttaagacaggttttttcaaatgttaagcagcttgttaaaaatgttaaacagcttattaaatatgcaaattgctgggtctcactccagaaatactcagttgataagtaagtccaagactcagggatctgcattttaataacacacctagtaattttaatggagggtcttttggccctgtttggtaattggtaaatcagtttagactaatccctatgttattttaatggtcagcaaccctagactaggggggtttagtttcatcgaatttattaatttaagcacttacacttatttagtagaatcagatgggttttttaaaaccagcaaattgttttcataattctcaaccaggaaaagactagaattatggaatttttaaaagcctttttcttaaaatcaaatatatatataccaacagaattattttccttcagtttgaaactactttcttatttggactgactctctagtttagaatatgccatagttaagtcggttctttttttttttttttttgagacggagtcttactctgtcgccaggctggagcacagtggcacgatctcggctcactgcaacctccacctcccgggttcaagcgatttccctgcttcagcttccagagtagctgggactacaggcgtgcgccactacaccctgctaattttttgtgttttagtagagatgggggtttcgccatgttggccaggatggtctcgatctcctgaccttgtgatccgcctgcctgcctctgcctcccaaagtgctgggattacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttttttagggggtatactattgttttaatatcgttgccaatttagctgacttaaaatatgtgacattttaaaatcaagaatttccatatttgtatttggttaatgtaaggaggatggaataactttcccgaataccctgttcttttctaccgtctttttaagttgataggtaagcagcattcaaggaaggtgggaataaaaattgttgaaatgtttaaatataaaatgatatacatatatgtaaaatttcattatccacattaatggagtggatacatcaaaatacattttttaattgtgtgtttcctaagaatgtggctttgtgatcatataaggattcacaacattaacaaatcttattttctgatatctaggatttttcttaactaaaaccatggaccagtcatctccatcctcctttcttgctctttgcccttgccctcccttctttgaaaaaaaaaatattttttagaagaattgcagaaatttctcacattggtcccaacaatggaaacacaatacaaagacacattcaaagaaaagtctatacaaccttagggtggaagtgatctttttaacaagattggaaacacagacatattttacttaataaaaaatttaaatgtcatatggcagggaccacagtcaaagttaaaacaacaagtagactagaagaaatatttgtatagtaataggaaacatgtcagtgtccctgtatacaaagagaagtttaagttattggagaagtggtcacactgtgaataagcaattcacagaacaggacattgaaaaagtcaacaaatataaagtgtgttcatcttcattataagggttaatggattgttttttaaaaagtattactgtaatactagtttttatcagattggtttaaggttaaatagtgacaatatccattttggtgaagatgcaaggaaattggcagaaacattgctggcaaagttatctgggtgtgaattaaaatcaaatacacataactttcagtgaacaaccttctgagaaattataaaaataaaagcttccatgcataaaaatgtaaggacacagatgtttattgaaacatattctagaggccagatgtgttggctcacacctgtaatctcagcactttaggaggctgaagcaagcacaggtcacttgaggtcaggagtttgtggccagcctggccaacatggtgaaacccatctctactaaaaatacaaaaattagtggagtatggggttgtgtgcctgtagtcccagctactcaggaggctgaggcaggagaaccacttgaacccaggaggtggaggttgcagtgagccgagatcatgccactgcactccagcctgggtgacagagcaaaagtctgtctcaaaaaataaaaatgaaaaaaaaaaaaaaaaaaaaactggaaatctaaatgttaattagcaagtaaatggttgaataaattatggtacatacatgtgatattatagaatattctctcaccactaaaaagaatgttagatatgtatatgttggcctgagaagaggctgatgaggaaaaaaaattacagagcaaaagatacaatatcctaattgtttagactttttaaaatatatatgaacaaagaaatgcatgtggaaaaaatacacaaaacttttagcattgggaaaaggaagaaggctgtaatattttcccaaactcctttaaacctcactcagtaaagtaataccaaagatagttttgttgaatgtgtgtacgtgggaaaaacagctttatttttaaaccaagtagtacttcatgactttgggagctgctctgttgaataaagtgatctggtgtcaggaacactcctctttgaattgttgagatatttttggtgaaatttatttaagctgaatgttaaaatgttaccctttggagcaggagtccccagcccatgggtgacaactggtaccgggttgcacagcaggaggtgagtgttgggcaaagcttcatgtgtatttatagctgctccccattgcttgcattaccacctgagctccgcctcctgtcagatcagtggaggcattcgattctcataggagcaggaaccctactgtgaactgcgcatgcaagggatctaggttgtgtgctcattatgagagtgatgcctgatgatctgtcactgtctcccatcacccccagatgggaccatccagttgtaggaaaacaagctcaagactcccactgattttatgtcatggtgagttgtataattatttcatcatatattacaatgtaataataaactgcacaatacgtgtaatgcgcttgaatcatcctgaaaccatctggctccatggaataactgtcttcccacgaaaccagtccctggtgccaaaagggttggggattgctgcattggagtacctggaaaaagttgatcatagattatttgaatgtgcctgttagtattctagaaatgtgtgtagatttcagtccagttattttcaaagctgaatctgtttttgagcttttcaagatgttttttctttctgcttggctgtcattgcacatatatggtccattactcaaggaactaacactgagagtgtcacattgtttcacaggggtccttggaacaaaaacacttttaagttcttccactgcaaatacagatgactaatagaaacaattggtgtgacaacacatttcactccacagtggaaaaaatgctttattcatggacaatcaattttctatgcaatgtacaggtatgacctgtgtaacagaactcagccagtatggtgtatccctggacatacgttaaataagttttaaaaatcctttggaatctactcttagcatcatttctgaaattgcagcatatttgttttctgaagccatacctttttttttttttttcagtttattctgaacacaagcaaagataattccttaaaataggatctggttgtctgtatttgggttgtttcattctgtgttttgcagaaaatgcatcagattactatggccattcagacatgaagataactaagcaagctacaatacttgcagtgtatgttaagatctcatagggctttttcctaatgagaagttttatgacgggggggaatgccccatctggagtttacattaaagaaaacttcatgtgtagatgaagttacatggatgtagccctacaaatgaggcatatcttctgataatgcagttccacaagaaacagcaaatgaagcgagggctagacttcaccccaacacatccccctaataagttatataagcattcaccatggccctgtacctcatagtcagaagcccaagattcttatacagtaatgacagtcatctaaatttcaactgtttcacaaatccctttaaagaacaaaaagaacaaatcactcagataccatacctaagcatattagatggcagagaagacagcaacctttaaattacatataatttaggaaataaatatctgagtctcccagaccccacactgtagcagaaaatgattggaaaaggggtacatagaagagtgcaggattctactggtactgacacaatatgaactggagtttagaaggagagggtctcattctgaatggtgaaatagaacaaataactggctactgaaaaatagagttggaaattgtatgtgattaggtgtgaatattttgggaaattagttctgaaataggccatcttcagaggaactgatgtcctttggaggcttattggtgaagggagagaaggaagtaaatgaaggtaagtgtcgtttaacaagatatcaaagaatccaaaaatatcctccataaaggtgtgtgatttttttaaaggaaatcgtgatttattttacaaataaagcactgtgctcctgaatgaaaaaaacagcccccctacacttgtccataagattgtttactattgtaacgtgaatagtttataccacatgtgaaaaaaaaatccacacaaatttactctcaaaacgtttctttgaacatacaaaaacacgctaggccaggtgcagtggccagttcctgtaatcccagcactggaaggcccaggcaagaggattgcttgagcctaagagttcaagaccagcctgggcaacataggaagacccccatctctacaaataatttaaaaattagccgggcatggtagcacattcttgtggtcccagctacttgaggcaggaggattgtctgagctggggaggttgaggctgcagtgagtagtgatcataccactacttcagtctgggtccaaagtgagaccatgtctcaaaaaaagcaggggaggaggggtggctcatgtctgtaatcccagcactttgagaggtcaaagtgggaggattgcttgagtccaggagttcaagaccagtctgggaaacatggtgaaaccccttctacaaaagaaaaaaaaaatagaaaaattagtcatgcatggtgtcacgttcctgtagtcccagctactcaggaggctgagatgaaaggattacctgagcctgaggagaccaaggctgcagtgagccatgattgtgccactgcactccagcctgggtgatagagtgagacagtctcaaacataaaaatataaaccaccctcaataatttcatgaaacagaggaaagcagtaattcaaaatagtctaacttactaattgatcgacagggtctcactcttgcccaggctgcatttacaggacctgcatttactcaggaatgaaaacagcaaaattatctcataaatcaaggctaaattagagatggcccaagggagaagagatatgactgaaagcacacatgtaacagagagaatagaaattaaatgagccaaaaaatgaagtaaaaaattgttgtagagaaaataatagatatagaacacagaaaaatatgcaatgtttatgggaaggcagaactctgggtgcagagccaggagttgcaagcccagagagcagagctttgaatcacagggttattctcaggccttgaagctgaatggaattttccctgctgttctttgaaattgcttgggacaatgtcagcaccccatcaaaaattaccagacaggaacagaagctgaaaaatgtgactcatacgagagaaatatcagtcaatagaaacagaaaacatgggccgggtgcagtggctcacgcctgtaatcccagcactttgggaggccaaggcgggtggatcacaaggtcaggagatcgagaccatcctggctaacacggtgaaaccccgtctctactaaaaaatacaaaaaaattagctgggcacagtggcaggcgcctgtagtcccagctactcgggaggctgaggcaggagaatggcaggaacctgggaggcagagtttgcagtgagcagagatcacgccactgcactccagcctgggagacagagcaagactccgtctcaaaaaaaaaaaaaaaaaaaagcagaaaacatggcagactagaagttctggcacttgtctctctcacaatgacaaccaaaacgatgaaaactacaatttaatctgggcatggtggctcatgtctgtaatcccactactttgggaagatgaagtgaaaggatcccttgaagccaggagtttgagaccagcctaggcaacatagcaagactccatctctacaaaaaattacttaaaaattagctggatgtgggtggtgcattcctgtagtcctagctactagggaggctgagataggagtattgcccaggagtttgaggtgtatcacagtgagctatgattgcaccactgtactccagcctggacaacagtgagatcctgtctcaaaagaaaacacaacattttaaaaacaacaaacaaaaataaaacggagagttccaaagtgtctcagaggagtaacataaatctggatgggaacagaaacagatggccacctagaaaacagaagaaaacattgggcctctaccaccccattccccaactaggattagctgaaaaccaggaggaacttctcctttcaataaggaggtaggaatgaggatggtagcaactcccatcaatactttggacaccaaaaaacaaaacaaaacaaaacaaaaacggataggaggcaggactaaatcacagctcccactcatacagagcattgggtggagacacattgtgaactcttgctccaagaactactgcaggaatataccaggaaagatgagcgaatccacagaccctttgaaggaagtggattgctcctgcaggacccaggagatagcccaaatactgtgagtgcccaaactgtgaaagtgggaaagaaggatcatctgcccctgaacacataccctcactggggaacctgaaggttcaggtcataggagaaggatttgacttaccaggagctgagacaatttagaaagccaagcaaattacatgggtagaggaagcagtgggaaaagccctgtgggctctctgggtccccacgaaagccatttctgacttttctctcagggatccttggggaggtacgccagaggaacagggaaaagaccacagggagaaagaaacctccagctgaactttgtaacaattccaactaaacacaaagtctcctggccagaactctggggatggtgtgaatccagtgtgcagaccgataggcggggaggagtgaaagccctgcttgcttcctcagccaggaggctggtagcctggggcaagttctcagccctgcttgcccactgcctggaaaccaactaggtgctgttggttggggggcatggtgagagtgagatcagccttttcaattacatgggagctgggtgaggcctgtaactgccagctttcccacacttccctgacaacctgcatgacacagcagagacagccataatcctcctgggaacataactccattgacctgggagccacacccccatccccaacagccaccacagcaagccccgcccaaggagagtctgaactcagacacgcctaaccctgcccttacctgatggtccttccctacccaacctggtagctaaagacaaaggtcatattctcttgggagttccagggccctgcccactggctgatcctcctccatactaccacagctgatgctcttttgatagatagcaccacctcctggtaagaggtcaaccagcagaaaactagtgcattaaacaactacaactaaagacactcagagtccatttcactcatctgccacctctacaaaagcaggtactggtatccatggctgacagacctgaagatgattcacatcacaggactctgtgcagacaccccccagtagcagcccagagcctggcagccctgctgagtggctagatccagaagagaaataacaattactacaatttggctctcaggaagccacatccctaggaaaagggggagagtactacatcaagggagcacctcatgggacaaaagaacctgaatggcagccttgagccccagattttccctctgacatagcctacccaaatgagaaggaaacagaaaaacaattgtaatgtgacaaattaagtttcgtcaacaccccccaaaaatcacactagctcaccagcaatggatccaaaccaagacgaaatccctgaattgccagaaaaagaattcagaaggtcaattattaagctaatcaaggagtcaccagagaaatgtgaagtccaacttaaggaaataaaaaaaatgacacaagatatgaggggaaaaatcagtatgtataattgtgtcaattaaaaacaataaaagcataaaagaaaaaagactcagaaatgacacataatggaattaatagaaaagggctgtaaaacagctattgtaagtatgcacaagatctgaggaaaaacattaatgtaatgaaagcagatggtagaactatgttgaacttttagagatgaaaaatacaatatctgaagtaattcactggatgggcttaattctaaaacacttttgaagagaagatcagagaatttaaagacatggcaagtgaagctattcaagagaaagcaaacataataaaaaaaaattagaaaaaatacaagagagcaaggaacactgattaattaatgatgctataataccaagtggtatgatacatctacttagagtcccaggagaatgaaaataagaggaagaaaaaatactttaaaaaatagctttaaaattttccaaacttgatgaaaactataaacctgaagatacaggaaactcaaaaacccatagttgagacaaggtctggctctattgcccaggctggagtgcagtggcatgatctcagctcactgcagcctccatctcccaggctcaagtgatcctcccacctcagcctcctgagtagctggcactacaggcacacaccaccacgcctggctattttttttttttttttttgtatttttagtagaaatgggttctcgccagttgcccaggttgatctcgaactcttgagctcaagcgatctgcccacctcagcctcccaaagtgctgagattacaggtgtgagccaccgtgcctggcctccataactggattaacacacatacataccgccatgatacctcataatggcattgctgaaaatcagtgataatgaggaaatgataaatgtagccagagaaagcaatatattaggcaacgaaaaacaatataaaccagtcttttctcagaaattatgcaagtcagaagacaatggaacaatacctttaaagtgctgaggaaacaacaaagacaaacaaaaaatctatacccagcaaaaatatccttcaaacatgagggcaaaacaaagcccttttagacaaaagaaactagtgaatttgtaatttgttgccaatgcatctgaactacaagaaatacaaaaggatgttttttaaagattcaatgctattcctgtcaaactaccaatgacattcttcacaaaactagaaaaaaactattttaaaattcatgtagaaccaaaaaagagcccaaatagccatggaaatcctaatcaaaaagaagaaaactggaggcatcacattacctgacttcaaactatatcacagggctacagtaaccagaacaggggaaaggaaaggacttcccatcaataaatggtgctgggataactggctagctatatgcagaagattgaagctggaccccttccttacaccatatacaaaaattaactcaagatggattaaagacttacatgtaaaaatcaaaactataaaaaccctggaagacaacctaggcaataccatcctggatataggaatgggcaaagattttatgacaaagacaccaagaagcaattgcaacaaaagcaagtattaacaacagtgatctaattaaacttaagagcttctgcacagcaaaagaaactatccacagagcaaacagacaacctatagaatgggagaaaatatttgcaaactaggcatctgacaaaggtctaatatccaggatctataaggaacttcaacagatttacaagagaaagacaaacaaaaccccattaaaaagtgagcaaaggacatgaacagacactttgcaaaagaagacatacatgaagccaacaagcatatgagaaaagctcaaaatcactgatcatttgagaaatgcaaatcaaaaccacaatgggatactattatcattttttgactttttaataaaatcaaaaaacaacatgctggcaatgttgcagagaaaagggaacactcagacactgttggtggaagtgtaaattagttcaaccattgtggaaagcagtgtggcgattcctcagtgagctaaaaatgaactatcatttgaccaagcagtcctattactgggtatatacccagagaaatgtaaatcattctaccataaagacacatgcacatgtattcacagcatgtgaattattcacgcagcagcattattcacaatagcaaagacatggaaccaacctacatgcccatcaatgacagaatggataaagaaaatgtggtatacatacgccatggaatatcatgcagtcataaaaaagaatga

SEQ ID NO: 503 - DNA, 7718 bp, Homo sapiens
  misc_feature (1)...(7718): n = A,T,C or G
aaactgatgatggtgttgatgatctgaaaataaatcccgaaaagaaggaattaggctgtgataaaatggtaccaaactcaagttttacatcattatcgtcagctgccattgatcatcagattgaagtacttctgtctgaatggagtaaaaatgcagatatgctatttagtattcatcccatggatggttctttgctagtttggcatgtggattggctggatgaataccagcctggtatgtttcgtcaagtacaggtgtcctttgtttccagaattccagtagctttccccacaggtgatgcaaactctctctgtaaaagcataatgatgtatgcctgtaccaagaatgttgacttggctattcagcaggggaaacaaaaaccttctggcctcacccgttccacatcaatgcttatttcttctggtcacaataaatcatctaatagtttaaaattaagtatttttacgcctaatgttatgatgatatcaaaacatgctgatggttctctgaatcagtggctggtcagttttgccgaggaatctgctttttctactgttctcagtatttcccacaaatccagatattgtggtcatcgttttcatcttaatgatttagcttgccactcagtattaccattattgctgacaacatcacaccataatgcattaaggacaccagatgttgataacccagagcaaccttttgatgctctaaatattgaagaatgctctttgacacaacaaaataaaagcactgttgacgtggcatttcaggatcccagtgcagtttacagtgagcttattctgtggagggttgacccagttgggccattgtctttttctggaggagtttctgagcttgcccggattaattctcttcatgtttctgccttttccaatgtggcatggctgcccactcttatacccagttattgtctgggtgcatactgcaactctcctagtgcatgctttgtagccagtgatggacaatatctgagattatatgaagcagttattgatgctaagaaacttttatctgagctttctaaccctgaaatttctaaatatgttggtgaagtctttaacatcgtcagtcaacaatcaacagccaggccaggatgcattattgcattagatcccattaccaaacttcatggcagaaaaacccaactgcttcatgtttttgaagaagacttcattttgaataaccttgagaagaaaagccttggcaaagacagcattttatctaatgcaggcagctcacctaatggattttctgagaagttctacctaattgtaatagaatgcactcaagacaaccgttcactgttacacatgtggaatttacatctaaagtcaattcctgtctcattagatgaaaaagtagatacaaaattatccgaagcggtttggcagccagaagaacattattcttcttctccagagaagatcctatctcctttttcacaaaagtatcaggcttgcagagcaaatctccagagtaccagcaggttgactctgttttcagaaatggtttatagccaagaattgcatttaccagaaggagttgagataataagtattaagccatcagcaggacatctgagttcatcttctatatatcctgcatgcagtgctccttatttattggcaacttcatgttcagatgagaaagtaagattctggagatgcagagtaacagatggagaatctgccacgtcaaagaatggaaaaattgatcttgcatacatttgggaagaatggccattacttattgaagatggacttcagagcaatagtagtataactgtacctggtaggcctgtagaagttagctgtgcacatacaaatcgtttagcagtagcttataagcagcctgcatctaatagtagatcttcccaggactttgtgatgcatgtaagtatttttgaatgtgagtcaacaggaggttcatgttgggtccttgagcagacaattcatttagatgagttaagcacagtattggattctggcattagtgttgatagcaatttagtggcctataataaacaagacatgtatttatctagtaaagagaatatcacatcaaacacaaagcatttagttcacttagattggatgtctagagaagacggttctcatatcctgactgtaggaattggatcaaaactttttatgtatggacccctggctggcaaggtacaagaccaaactggtaaggaaaccctggcatttcctctctgggagagtaccaaagttgtgcccctttctaaatttgtactattacgaagtgtggacctagtttcttctgtagatggctccccaccttttcctgtttctttatcgtgggtccgggatggcatccttgtggtaggaatggactgtgaaatgcatgtgtattgccaatggcaaccatcttctaaacaagaacctgttataacagattcgtacagtgggagcactccatctataacaagtttaataaaacagagtaactccagttctgggttacatcctccaaagaaaactctgactcgatccatgaccagtcttgcacagaaaatctgtggaaagaaaactgcattcgatccttcagtggatatggaagattcaggtctttttgaagcagctcatgtactttccccgactctacctcagtatcatcccttgcagcttttggaactcatggatcttggtaaagttcggagagccaaggccatcttgtcccatcttgttaagtgcattgctggggaagttgtggctctgaatgaagctgaatctaatcatgaacgccgccttaggtctctcacaatcagtgctagtggaagcactaccagagacccccaggcattcaacaaggctgaaaatacagattacacagaaatagattctgttcctccacttcctttatatgccttacttgcagcagatgatgatagctgttactcatctttggagaaatctagtaatgagagtacgttaagtaaatcaaaccaattatctaaagaaagttatgatgagctttttcagactcaacttctaatgactgatactcatatgttagagacagatgaagaaaatacaaagcctagagttattgacctttcacagtacagtccgacttactttggacctgagcatgctcaggttctttctggccacttacttcattctagtttaccaggactcagccggatggagcagatgtctttgatggccttagcagatacaattgcaactacaagcactgatattggagaaagccgagacagaagccaaggtggagaaactcttgatgaatgtgggttaaaatttcttttggctgttcgactccatacctttcttacaacttcccttccagcctatcgagctcaactccttcaccaaggcctgtctacaagtcattttgcttgggcatttcactcagtagcagaagaagaactgctgaacatgttgccagccatgcagaaagatgatcccacttggtctgaactaagagctatgggtgtggggtggtgggtccggaatacccgcatcttacgcaaatgcatagaaaaagtagctaaagcagccttttatagaaagaatgatcctttagatgctgccattttttaccttgcaatgaaaaagaaagctgtgatttggggattatatagttacctcccactgggtccctcccacagcacttgggaattcaagatgagatttgggtggggacacagccaaaccatatcagnnaatgctttttctttgctaggcaaacaaagatttgaacattctgcagcattttttcttttagctggttgcctcagagatgcaattgaggtatgtcttgagaaattgaatgacattcagttggctcttgtaatagcaagactctatgagtctgaatttgatacatctgcagcatataaatctattttacgtaaaaaagttttgggaatcgattctcctgtcagtgaactgtgttcattgaacataaatatgcatcatgatccttttcttcggagcatggcatattggattttggaagattatagtggtgctctggaaacattaataaagcaacctatcagagagaatgatgatcaagttttatcagccagtaatcctacagtttttaatttctacaattatctaagaacacatcctcttttgctgagacgtcattttggatcatctgatacattttccacacatatgagcctaacaggaaaaagtggactggcaggaacaattaatttaagtgaaagacgtttattttttaccactgccagtgctcatttaaaagctggctgcccaatgttggctttggaagtattatcaaagatgcctaaagtcatcaagaaaacaagacctttttatagggcttctagttttctggatactagtaaagactgttctccttcttctccattaaagttggatgcaagggaagataagtcttctgctgttgattggtcacagtcactgataaatggttttggatcttcttcagagggttcctcagagaagcaatcaaactccactctttcttttgactggagccaaccaagtgttgtgtttcaggatgactctttagagttaaaatgggacagtgataatgatgaagaaaatgaggatgtccctatttcaatgaaagaactaaaacctttacagagaaaaacagataaaaagttggatgacataagttctaactacacagaatctttcagcacactagatgaaaatgaccttttaaatccatcagaagatataattgcagttcagttaaaatttagagcatgtttaaagattctcacagtagaacttcgtactttatctactggctatgaaatagatggtggaaaattgcgttaccaactataccactggcttgaaaaagaggtgatagctcttcagaggacttgtgacttttgctcagatgctgaagaactacagtctgcatttggcagaaatgaagatgaatttggattaaatgaggatgctgaagatttgcctcaccaaacaaaagtgaaacaactgagagaaaattttcaggaaaaaagacagtggctcttgaagtatcagtcacttttgagaatgtttcttagttactgcatacttcatggatcccatggtgggggtcttgcatctgtaagaatggaattgattttgcttttgcaagaatctcagcaggaaacatcagaaccactattttctagccctctgtcagagcaaacctcagtgcctctcctctttgcttgtacagccaatgccaaaacagtagttgccaatccattattgcaccttagtaatctgacacatgatattctccatgccataataaactttgattcaccaccccaccctgatatccaaagcaataaagtgtatgtaatgcatactttagcagcttcactttctgcttgtatttatcagtgcctttgtggtagtcataactacagttcatttcagacgaatcagtttactggaatggtatatcagacagtactgcttcctcatcgaccttctttgaaaacaggaagcttagatgaagcattaactcccaatacgtcaccagctcaatggccaggaataacttgtctaattcgacttttgaattcttctggcgaggaagcccagtcagggcttacagtcttgctctgtgagattctcacagcagtgtatcttagtctcttcatccatggcctggccacacattcaagtaatgagctatttcggattgtggcccatcctctaaatgagaaaatgtggtctgctgtgtttggtggaggtgcacatgttcctagcaaagaacagacacattcaaaaactttacctgtttcttcactagttgaagaaggagaaaaacagaacaaacgttttaggccgtcaaaaatgtcttgcagagaatctgccccactgaccccttcctcggcaccagtaagccaggagtcactggcggttaaagaaaagttcatcccacctgagctcagtatctgggactatttcatagctaagccttttctaccctcttctcaaagtagagccgaatatgattcagaggagagtctgggaagtgatgatgatgacaatgatgatgatgatgatgttttagcatcagatttccatctccaggaacattctaattcaaattcatatagttggtccttgatgcggttggcgatggtgcaattggtgctcaacaatttgaagactttttatcccttcgcaggtcatgatcttgcagagcttccagttagttcacctctttgtcatgcggttctaaaaactcttcaatgttgggaacaagttcttctccgacgacttgaaatccatggtgggccacctcaaaattatatcgcaagtcataccgccgaagagagtttgtctgcaggtcctgcaattcttcgccacaaagctttactggaacctacaaacactcctttcaaatccaaacaccatctggcactgtctgtgaagaggctttggcagtatttggtgaagcaggaagaaattcaggaaacctttatcaaaaatatattcacaaagaaacggtgtctaaatgagatagaagcagatttgggatatcctggaggtaaagcaagaattattcataaggaatctgatatcattactgcgtttgctgttaataaggcaaatagaaactgcatagcaatcgcttccagtcatgatgttcaagaactggatgtttctggaattctggccacacaggtctacacttgggtagatgatgatatagaagtggaaaccaaaggatcagaagatttcttggttatacatgctcgtgatgatttaacagctgttcaaggtacaactccatatacacatagcaatcctggcactccaatcaacatgccatggcttggtagtacacagactggcagaggagcatctgtgatgattaagaaagccattaataatgttagaagaatgacttctcatccaactcttcccttactatctgacaggagctcaagatggaagtgtcagaatgtttgaatggggccattctcaacaaataacctgttttcgatctggtggcaattcaagagttacaagaatgagatttaactatcagggaaataagtttggaatagttgatgctgatggatatttaagtttgtatcaaacaaactggaaatgttgtccagttactggaagcatgcctaagccatacctgacttggcagtgtcataacaaaacagccaatgattttgtcttcgttagttcctcctctctgatagctacagctggtctttcaactgacaatagaaacgtatgtttgtgggatactcttgtagcacctgccaatagtttagtccatgcatttacctgccatgacagtggagccacagttttagcatatgctccaaaacatcagctactaatatcaggtggcagaaaaggttttacatatgtatttgacctttgtcaacgacaacagaggcagcttttccagagccatgattctcctgttaaagccgttgctgttgatccaactgaagagtactttgttacaggatctgccgaaggcaatataaagttccaatgagataaaatatttactattatgcttattagaacaaaaggtgtttaaggatgaactaaatattttaattgagcatttatatggataatcatacattatgtaagcccatatgtatttacatccagagtcataatattttaaataaacaatcatgcagaaacttt

SEQ ID NO: 504 - protein, 2333 aa, Homo sapiens
  VARIANT (1)...(2333): Xaa = Any Amino Acid
TDDGVDDLKINPEKKELGCDKMVPNSSFTSLSSAAIDHQIEVLLSEWSKNADMLFSIHPMDGSLLVWHVDWLDEYQPGMFRQVQVSFVSRIPVAFPTGDANSLCKSIMMYACTKNVDLAIQQGKQKPSGLTRSTSMLISSGHNKSSNSLKLSIFTPNVMMISKHADGSLNQWLVSFAEESAFSTVLSISHKSRYCGHRFHLNDLACHSVLPLLLTTSHHNALRTPDVDNPEQPFDALNIEECSLTQQNKSTVDVAFQDPSAVYSELILWRVDPVGPLSFSGGVSELARINSLHVSAFSNVAWLPTLIPSYCLGAYCNSPSACFVASDGQYLRLYEAVIDAKKLLSELSNPEISKYVGEVFNIVSQQSTARPGCIIALDPITKLHGRKTQLLHVFEEDFILNNLEKKSLGKDSILSNAGSSPNGFSEKFYLIVIECTQDNRSLLHMWNLHLKSIPVSLDEKVDTKLSEAVWQPEEHYSSSPEKILSPFSQKYQACRANLQSTSRLTLFSEMVYSQELHLPEGVEIISIKPSAGHLSSSSIYPACSAPYLLATSCSDEKVRFWRCRVTDGESATSKNGKIDLAYIWEEWPLLIEDGLQSNSSITVPGRPVEVSCAHTNRLAVAYKQPASNSRSSQDFVMHVSIFECESTGGSCWVLEQTIHLDELSTVLDSGISVDSNLVAYNKQDMYLSSKENITSNTKHLVHLDWMSREDGSHILTVGIGSKLFMYGPLAGKVQDQTGKETLAFPLWESTKVVPLSKFVLLRSVDLVSSVDGSPPFPVSLSWVRDGILVVGMDCEMHVYCQWQPSSKQEPVITDSYSGSTPSITSLIKQSNSSSGLHPPKKTLTRSMTSLAQKICGKKTAFDPSVDMEDSGLFEAAHVLSPTLPQYHPLQLLELMDLGKVRRAKAILSHLVKCIAGEVVALNEAESNHERRLRSLTISASGSTTRDPQAFNKAENTDYTEIDSVPPLPLYALLAADDDSCYSSLEKSSNESTLSKSNQLSKESYDELFQTQLLMTDTHMLETDEENTKPRVIDLSQYSPTYFGPEHAQVLSGHLLHSSLPGLSRMEQMSLMALADTIATTSTDIGESRDRSQGGETLDECGLKFLLAVRLHTFLTTSLPAYRAQLLHQGLSTSHFAWAFHSVAEEELLNMLPAMQKDDPTWSELRAMGVGWWVRNTRILRKCIEKVAKAAFYRKNDPLDAAIFYLAMKKKAVIWGLYSYLPLGPSHSTWEFKMRFGWGHSQTISXNAFSLLGKQRFEHSAAFFLLAGCLRDAIEVCLEKLNDIQLALVIARLYESEFDTSAAYKSILRKKVLGIDSPVSELCSLNINMHHDPFLRSMAYWILEDYSGALETLIKQPIRENDDQVLSASNPTVFNFYNYLRTHPLLLRRHFGSSDTFSTHMSLTGKSGLAGTINLSERRLFFTTASAHLKAGCPMLALEVLSKMPKVIKKTRPFYRASSFLDTSKDCSPSSPLKLDAREDKSSAVDWSQSLINGFGSSSEGSSEKQSNSTLSFDWSQPSVVFQDDSLELKWDSDNDEENEDVPISMKELKPLQRKTDKKLDDISSNYTESFSTLDENDLLNPSEDIIAVQLKFRACLKILTVELRTLSTGYEIDGGKLRYQLYHWLEKEVIALQRTCDFCSDAEELQSAFGRNEDEFGLNEDAEDLPHQTKVKQLRENFQEKRQWLLKYQSLLRMFLSYCILHGSHGGGLASVRMELILLLQESQQETSEPLFSSPLSEQTSVPLLFACTANAKTVVANPLLHLSNLTHDILHAIINFDSPPHPDIQSNKVYVMHTLAASLSACIYQCLCGSHNYSSFQTNQFTGMVYQTVLLPHRPSLKTGSLDEALTPNTSPAQWPGITCLIRLLNSSGEEAQSGLTVLLCEILTAVYLSLFIHGLATHSSNELFRIVAHPLNEKMWSAVFGGGAHVPSKEQTHSKTLPVSSLVEEGEKQNKRFRPSKMSCRESAPLTPSSAPVSQESLAVKEKFIPPELSIWDYFIAKPFLPSSQSRAEYDSEESLGSDDDDNDDDDDVLASDFHLQEHSNSNSYSWSLMRLAMVQLVLNNLKTFYPFAGHDLAELPVSSPLCHAVLKTLQCWEQVLLRRLEIHGGPPQNYIASHTAEESLSAGPAILRHKALLEPTNTPFKSKHHLALSVKRLWQYLVKQEEIQETFIKNIFTKKRCLNEIEADLGYPGGKARIIHKESDIITAFAVNKANRNCIAIASSHDVQELDVSGILATQVYTWVDDDIEVETKGSEDFLVIHARDDLTAVQGTTPYTHSNPGTPINMPWLGSTQTGRGASVMIKKAINNVRRMTSHPTLPLLSDRSSRWKCQNV

SEQ ID NO: 505 - DNA, 20956 bp, Mus musculus
  misc_feature (1)...(20956): n = A,T,C or G
cagccctgtgaatagcagtgtaggagcaagaagtaaggtaagcagttctctgccacaaggcatggccagcgctcttccccagacaccagaccaatgtgtcagtcattttcctcaaactaagctattcaccctctgagaaagggcctgggcttttcctcgtgtctctcacagagcagctgatcagtgcacagctgtgaggaggaaatgacttagattggtgggtgatgggttgggaagagagagggggcggtaattaatgtgtgctaatgtgcagggcccccaaaaccctgaccagtcccctaaaactgacacaagttcccacagatgcctcaaacaagattctccagagctacagaaagaacaaactcaggctgtcaccactgaacagctctcagttgacctctcaggagggtgagaaagacagtcactgggccttagtctagacagcattcccctgggcagctcacaaccctggcactccagctccagggcacccagtgccctcctctggatctgcagcacatactctctcacacacactttctctgtgtgtgtgtctgtctctctctccctccctctgtgtgtgtatgtctgtctgtatctctccttgatccccactgccttgatccccataactttgtggtaagttttgaaatggaaaaaggagtttgtggattaaatccttagctttcgtttctgattttcaggatcccttgagtatgctagggtcacagcagactcctaaccacacttgttgcttggctttcttgtttgcttgatggacttgccagcctgagtgctaagtggaaatcccccttgctcttctctagcctccctttagaggcagcctgaccagcagagatctgactctgtccaagtttagcccagggccaagtagtcagctgggggagcaggagacccgcaccattactcccagcatcctaccgtcctggcatcctcccttgtggttgtgatcctctccaggttcatgtccagccaccccacacattcttcttgtgcctgtcattctcctaccccttcctaaggatgactcaggacacagggaagccattttgccatttgtcagtggaacagcctgtcctttctggtggcatgtctggtcacacctatgtgttctttactagacccaattgatgcgttatctaagctacaaacactgaatttactgatacgaggattttgtttaatggtgtgtagctctggctggcctggactcactctatagactaggttggccttgaactctggagctctgcttttctctgcctccaaaatgctgtgattaaagctatgcatctccatgcctgacctcccttctgcagagttttcagtccttgccgtaagatcaaggggggtaaggaaggactagagagagacagagagagggagagggaggaaaggaaggggaagaaggagaaagagaaggaggaggagagaaagaagaggaggaggatgaagaggaggaggaggaggaggaaaagaagggcagaaaagttagaagggtgcatttttctgagatctcaccatcagctagctgacctaatactgatcccataatacaggcttacacccgagcctcttcaatgaggaaaagtagaaaggccagtgtgctgttcacctcagaagttcttcccccacaccagccccccccccccccccgtggtgccatccttcagggaagccatatttagcactgcacttccaaggagcagccttgtgcctgctccagtgtcccagtgctggctgcagtgtgcagaacagaccacaaggctctgagagtggcagggtcaactctgtgctgcctaaccgtcgcctccaagtaatgctaccatgctggacagtcactaacctgcttatctcactatttaaacaaaaaaccaaaaaacaaaaaaccgtgcttctgcaagttcctgttgatctttgcttcagatgtaacatgaaactgtcggctattctgtttcctcagagccccttggagttctgtgactgtacagtagtagcttcagctctgatatcctcatgtgtgaggcagaattagtaacatccagtccttagctgctgggggctgaggatacggcttggtggcacagaacttggctggcatgcataaggcctggcaccaccaaaaaaagcctagctcccttcagtagggctacaagtgccacaggccttccatagcccagctaaccactggggactggccttctagtccacatttcagccctttcctgagtgtgcagagcaggttcagctggttgtcagatggccaggaacattctctgggctgagctgaactggatttgggagataggagagttcagtagaagtactcgttagatggaggcagtagtgcagggggcttccacagagacccactctgagttgaaaaccttaagtcttcaggttccctcttgctgagatgagaaggcttaaaccaatggcaaaagtgtcaacgcccaaccctgctcaaaactccacttttagtccaggcagacaagtaagcaggggtcccccctcccaagatacctacttcctctttgtatacttgctctttcagcaccttaccctcagaaagcccggaagtcaagaggataaagaagggattcactatccatacaacagcaacagaatgtcagccaaatcctaggctaaggtcatagctcagtggtagagatcttgcctgacacataaaaatcaggaccaaaatgcagtgcacccctgcctttgcacagctgtgagatgtgtgaggctttacatctctaactgatgtgagagctgggatcagcccagctggtagggcgcttgcctagatgcttacccaagggcttcataaaactacacagacatggtgccacacatcgatctccccaatacttggtagacaaaagcagaggacatgagacatgcaaagtgatcattggctacaaaccaagcatagtggcacacggtatccctgtgcccaagaggtagaatcagagttcatagtcgtccttgccagcatccagtcggaagccagccagctacatgagaccctgtatttggggaggtggggggaggtgaaagggaaaaaatgtttttacatgtgaaatttgaatgaccgcatgtatagataacattttattggcacacagccaccatctctattgattgtctcagtaatgcttggctcgggatcatataaagcagaggtggtgcctctctgctctgagacgacatggactccctctccttccacttgtgctagagaggctgagagcggtgtctagtcctaccgttgctgctgctccgtaggacagggtggcggggttcaggctaagggctcgtactaacggtgtagaaagaagaacccaggatgggatcaagagccttccgcgaccagttctaccaccaccaccaccacccctgggatggtgacagggcttttagccaagacccttcatgttctcagattcctctacacttcttagggctggccctgagctacattcagtgactgtctccctcctgtctctacagaatttgccttctgccaggtggatgcctccattgctctgaccctggccttagctgttctgtgtgacttgctccagcagtgggaccagctggagccaggactgcctattctactgggatggctactggaagagggtgatgacctcgagggccacgtgcagagcccacatcaggtaatcccagttacttagggagctgggggcagacagagtgtcctagccctgaggtggagccctgagggcctaggaagtttctagatagtaaaaagtgtgtctctagctgctcccatgcagaggagagactgacgaggagaaacctcccaggtgaggctcacaggactgtggaggtccagaccagttaggaaggttcagacaagttaggaagggcactttgaaaaatgcaccttgaatattgagaataaaatcatgaaaaaatgcttatcagttgatcttagcatttcccaaggattagggtccttctagaaaatgtggcagggagtgtgtgtgtgtgccggcttcctgcctcttcctgaaaactgaagaccagcataggcaacctgtgttttccactgggaaaccagcagtctgtccccacatatgaccactagctagctccatatcctgagcagaccaagagtcagtgtataccaacccttcaaaacccagtctgtataagaaacaggaagatgatataacaaagtgttttagatgaaatgaccctaaacccccatagcattctagaaattttgtctcttttgtgctgctatcacacatgtcccagtaactctctgctctgctgtccagacttcctttgtgcctcctctgaattttctcggcacaccttaaaacctaagatttttctcagtacaccttaaaacctaagacccacttccgcaccaccagttccccaagtatcttggcttggagctaattcacatctttatcaaaggtcgtggtccggctgggagagaggtattgagtgaaagtagaaggtgaccttcagagcggcaagtgctgtggcacgggcgctgacagccccagtgggccctgtcaggaatagacacagctcccacatctagtgctgtgcctggctccacaggactcctcggagacttactctggctgtttgtcacttgatgtagggggaagaagagcatatctttgaaaaatcagaagtcaacttctgggctgagacgctgaccttcgtgaaatccctgtgtaggcaactcttccatctcctctgtcaatctggctggcagtcccctcactcccagaagctctgtcacttgcaaaggatagcatcagagcagagtcacctcatctctcagctcttcagagaacttccactctcagctgagtttttgaagacagtggaatacacgaggctgcgcattcaggaggaaaggactttggctgtcctgaggctgttggcctgcctggaaggaaaggagggtctcagagccgaagactgccctagggaatggagacaagtaatggccccaagaacagaagcagcatgctgaagaaaggtggctgggcctcagctcaggtctgcaagacacatacatggtggacaccaattgaaactcttttcctcaggtgcctccccacttctgggagtctaggcttctgtcccttcctactgaggaccttgtctgcagcacactcattcaaggcaacccaattagttgcagctacctaggaagtgaagctgctgtctgcaggtttactgtctccaggtgcaagccacctgcaggcctgaactagtcagttctatcccaaagccagcgcccatttccccatacactgactgcattgaattcagtcttagcttacatgtctctctctctctccctctctctctctctctctctctctcacacacacacacacacacagagctctttctctctctctcacacacacacacacacacagtgctcttttgtttggttgtgtttagcaaatacctatttggacatatgtataaacttttattccattttagtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaataaacaaataaatattttaaaaaaaaaaaaaaaaagagtccccactgtcttacccagaaatgcctgcgaaggctaggaacccttgtcacccatcactggcctcagctattggacagagcctggggaaagggaagcctgagcaaatgcttaattcattcggtgccgccactgtacaccgtcctgtgattggtggagacagcagagtgccaagaaacacatttacccactttaggtgattccatatagaaaccggaagggtttgtcacttcaggcccagcccagctggcatcctcgaacaccagcaggtggcgctcttgcacacattatgctgctggtctagcgcttttagcctactcttttaaaactttttaaaactattatcagcacctgtacatgataggagggcacccatgccccagcatggatgtctgaggaagttgagggacaactttatagagccagctctctcctcccacctctgcatgggcttcagagatcgactcaggctcaggcttgcagagcatgcacgtttatccactgagccgcatcatgtggcccagcttaccatgctacgtgtgcttccagagtacgtgacacccgcagacacttgccttcaattcacagcgtggatgtgttgctgtagtgtgatccacattcccagttatccacaaagaccatgccagccatagaaggaacttgtagggcctatagctatgttcagatacttctcagtgagtagtcacttagaatcatgaggaaaagggagagaggcattctatatgctagctcctcctgcagagacgctgacatttcacatgtaattggtctcagaagaaaaccatcctgcaccacagaaacacggctgtgctggagtagagacctgtacgcagggagagggaagtcaggagctgtgtccttcctggccatgaagaggaacagaaatcccctgggtggtcttagaaacactcagcaccctggggtctgtgtggccctgtagtaattacctagttaggcagtgcaacccactgctgatgaaaaattgaaaacctaacattgtttagtttgttttgggctttgcttttagttttctgagtcaggcttgctatttacactaggctggcctcaaacttgtgttaatcctcctgcctttgcctcctgagtgccaggattccaggcatacaccactatacccagcattacactactttaagatctagttggtgagaggggctggtggtgacaaccttgggagattaattctgaacaggacccaaccttccctctccccttccatctaaaatgaaataaaagcagttacatgacaataaaaccatctcacattggcaggcatgctgtcccaaagcatgtttcagagcaggcttatgttatctccaagtccatcctaccaagtctgccattagctgggacttaccccagacttggatcttggctggctgtggccaatctgggaggacaggagggatggatggctccacaggtgggcttgtatctgcaatcctgctagcagtagctaggggaacgactgctgcatgctttcctgagagaaaccaggaaaaccttagtcacagcctcatgcttacatttggggtcctttcagccacagaacccagcagtaataggggcaagagcaacgtgggtgggaagagtgaagcagccatcttccctaagtcactacacttgagggtcctaagatctgggtggccccttgctcagaccacagccaaaagccagtttgctttaatatataagatggtgagggctttgttcctttataggggtatggtctcactctcacactaagctgtgcaaggctagcctaaaactcaccacagtttgtgattagtgctaggactataggcatgaaccaccgtacccaacccactcagcactacgtccaagacactacagtcttctggcagccattggctctacctacaggggcagcatgcactgcagtgtggccaaatgcacctggactcaggagcctttgagtgacagatctacctccttagcttcaaggttaactgatacagcccaagtgcacactggactgggtcaaccagacaggaagagcaacatgggaaggatgtagttggtcaagcagccttctctggcaactactgggccttccacccagggcaacccggactgccagctgggtgaattcatgggcccaactccagcttttggcagccagtatgaagtgtagggataaagggttctggacctgaccagatgggcctcacggggtgggggtgggggtcgctaggtgtgtggaggtgtgtgtgtgtgagacccctctcaaaaagagccaggggccttctgggactgctttttccatggaaagctggtaggagttgcactaaaggcaaccgaatgaggacctctttcccccaacctgggtggtggttcagcaatcaccgcctcgcctccggcagctcacacaaagcttagattcaatgccgcgcctcccacagcagaaggaggaaggttgcaggattcgacaggccaaggctgtacaggcgggaagccttggctaggagctgcacccacatccccgagaggaggccaggccaaccagcaggcacaaaggtgaaggaagtgacttcctctatgtccacactgctcctccgacttccctctagtcccctggaataggctttcccgccccggacaccccgcgccactcggcgcctttggcccaggctcaaggtcttgtgatgtgattagcaaagccagcgccttgtcctcagacactcggctctgccccacaggccgcagcgctcaagtcctgtttactgagcctgggcggggagaggggcggagaaacgcgccaatgctcctccaggctggccgctcccgcccccacccctactgcgtctccacgtgcagccgggccggagctgccacctacgggacaggccgcgacccccgttcctagtcccaagcaacttggccaagcgcaccattgctgttttgctgttcccgcgcgcggagcaaaaactaggatgggagataaaagctgcgccagtcggcccagccggatcgggcgaggaaaggcacgtcccgggtagccccgtcctgggcagatagaacgtgtacgtgctttccaacgttatactcgtagaggcggaggagagcgaggtattcccgccgccgccacccagcaggacccaagggggccgcacgccccacgccgctcgggacgcccaggctgcccgcccctcccctcccctctcctcccctcccccgaaggggaaaaattggcggcgaccaatgagaagccgagaaggagcctgacgtccgcgggctggcgggcggcgttgcctggagaccccggccggtcagcgttcagtcccctcccccggtgcgctttgccccgccgccgcgccgctccggggctgtataaagggcgcacgctctcaggtctccgagttccaccagtccgcgagctgccgacggctcgggcggggggcgggccggggcgccgagctgcgctctcgcttctcctctgccccccactccgcgccacggcctcccgccgccgcttcctcggccgcacaagcacaactttccgtccctccttggccctcgcccgttattcatcttggttcgagtctcgccgtaccgagggcacctcccaacctccacgcttgcaatttcgaccattacaggacccagaaaaatgtcgaccacacttctgtcacccttctacgatatcgacttcttgtgcaaggtaagcaggcagccggaaaggatggcggacggcctggaaccctttggagttccgagacttgccgccgggccgggccgaggcgggagggacccttccaagttgactttgcgggtggagggaagtcctggagttagcaggactgtgtgcttgcgactgtgggcgtggagagagcgagtagcggctggagcagccgtgctcctcccgaaccgaccgcggccacgctgccgggacttcccggacagcgtttgcgccgcccaccccgtggccacgggcccaggatcacatggctagacccggagcggccggggtgggcgtcctccactctctccggcctgcgttttgcgagtgtagcggtggaggctgaatcggatcccaccagaaaccccaacaagtgggcagttgggactagggcgttcactctgcagttagccccgactctcttccccatccgattttcatcccgctcccgctcccctccctttggcagacggagaaatccctggcaaacctcaatctgaacaacatgctggacaagaaggcggtagggacgcccgtggctgctgcccccagctcgagcttcactccgggcttcctgcgacgccactccgccagcaacctccacgcgcttgcccaccctgtgcccagtccgggcagctgctcgccgaagttcccgggcgcccctaacggcggcggcagcagctgtggccccgcaggcggaggcggtctggcctcctacggccagctcaaggagccttcggggggcagcggcacggcgctggtcaccaaggagagcaaatttcgggaccgctcgttcagcgagaacggggagcgcagccagcacctcctgcacctgcagcagcagcagaaggggggcagcggctcccagatcaactccacgcgctacaagacggagctgtgccggcccttcgaggagagcggcacgtgcaagtacggcgagaagtgccagttcgcgcacggcttccacgagctgcgcagcctcacccggcaccccaagtacaagacagagctgtgccgcaccttccacaccatcggcttctgcccctacggcccgcgctgccacttcatccacaacgcggacgagcggcggcccgcgccgtcggggggcggcggcgcctccggggacctgcgagcgtttggcgcacgcgacgcgctacacctaggcttcgcccgcgagccgcggcccaagctgcatcacagcctcagtttctccggcttcccgtcgggccaccaccagccgccggggggcctggagtcgccgctgctgctcgacagccccacatcgcgcacgccgccgccgccctcctcctcggcctcgtcctgttcctcctcggcttcttcctgctcttccgcctcggcggcctccacgccctcgggcgccccgacgtgctgcgccacggcggcggcggccgcgctgctactacggccccgggggcgcggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgctttcggcccggagttgagcagcctcatcacgccgctcgccatccagacccacaacttcgccgccgcggccgccgccgcctactaccgcaaccagcagcagggcctgaccggtcccgcgccacccccggcacagccccccgcggcccccgcgccgccctccccgcccttcggcttccagctgccgcgccgtctgtccgagtcgcccgtgttcgacgcgccccccagccccccggactcgctctcggaccgcgacagctacctgagcggctcgctgagctccggcagcctcagcggctccgagtcccccagcctggaccctggccgtcgcctacccatcttcagccgcctctccatctccgacgactgaggcaagggggcgcccgcgaggggttgggaaaggcacagcgggggccaccggttggggagggcgacactgcggcagacttggaggcccctccgagcacttggactcgaactctgccggaaggggccccgcccctaccctttcggttctctcgttttttttgttttttattattatttttattattattattattgtaaagattcgttcttgttgataaaagccaacgaactttttcgtatggatgaacaaaatattcacaacagggcggttgtgatgcggaaagaacaaaagataccaaacacttaggtctcagatgagtttgaaactctagttttagaagaaaaaaatcagcccagcaccagcagctaccaaccaccattccatctcttctttcactcgaaagccttagaaacagtccagatgtgagaactcttggaaggggttccaagaccagtgtgagccagccggctgccacctccctaaactataagcttctagaactcaaaataatgccaggaacatgccttgattcgagtcgctcgctctcagcctcctttgtggtggttgtttaccttgtttttgttttttagacaaagttctgtatgtctgggggtggggaagcccttgcattccaaagtttgataacgggctcattgccaccacgtagtgtgggtgtttagcttagaaccatttcctctgctctctggaagctatgggcagagctcagttcatagttgttgggaaataagtgcttcatttttagttgttctgagttgatccgcaccactgcaccacaactcaatatgaaaaactatttaacttatttattatcttgtgaaaagtatacattgaggatgttgtccatactgtatttatcgagtatgatgaaagcaatagatatatattcttttattatgttaaattataattgccattattaatcggcaaaatgtggagtgtgttcttttcacagtaatatatgccttttgtaacttcacttggttattttattgtaaatgagtaagaaaaatcttaatttaagagattgtatgtaatatttatttcattaatttctttccttgtttacgtaaatttcgaaagatcgcatgaagaaaccatgcaatcttgatgctgtggaagtggtttgaggaacattttgaggttttcttagaatgtataatggttgtagcccatccaactttaaagagagaaaggtgagactgcagtcaggctcacgtgtggcttgcttctctacatccagctttataaaccaccagctctactgtgacattgattatagagacatgtagcaataatgggggaaatggtctcagtgccttcatagggcccgaacttgccttaaatcttcctcaaccagataagtatttcattcgtgcttgagaatttgaatgtcgggacgggttcacctgcacaaaaagaaaagattttttaccactttttttttactatagctatgaagtgaagaggccacatcttatcgctgaaatgttggtggtacatgaatatgccttgttcaatgacagtccaaaaacttgtactattatttttcaatgtaaagaggcagggaatgtctccggctttcctggatggcagataaatgagcagttgtttagtttgtatgtaggtacagttggagcaccgcgtgtgcactctggactactttgacagaagtaggtttttgaatgtaacaagattaagtcaacttgagttgtaatatattttggggaatcagttcactacaaattgtgactgtaaacattgtactgtaaatgttttgtagtttcccccaataaaattttttggaaaaaaactctttgagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcatccacttgtacctgtgtttgttttcaactgaaagtaattatttggctgtcaagggcatttgttagctgttccctttggtaataagatgcatccctgtgttggctgactggttgatggcagggcctggcgggagaccgcgaggggtgtggccggcctgtgagtcacccagtgatcacgtggatgctctggctgctgaaggtccgatttttccccagtatgcctgacctgggcttgtagcctggacagggaggtctgggccaggcgttggtagctgggctcgggttttgcttggactttgggaggctgggggcatgtccttcagagagggagggaggaagatgaagccggttaaacttctatctgggtgatgtttgtttacacagacaacttcctctgggaataagcacattcaggctatttatgcaaaaggaagaggccagaaagcaacttcatccgggcttctaccgaaggcaggcaagccgccctcagtttgcctgcctccaaagcttaggaagtaaaatcgtttgtgcttttggggtttttttgttgtttttaccctgctcgttttaaaacaatcttttaaactcagaagagttaggttttcctaccccacccccatacacagttcagacaccttttccaaagtaggcaagagtttgggttctatcaaccaatccttgcccggctctggttggttgcccctgccttggccagggtctcctgtgactcacagctggggggtggagtgggggccctgtctgagggatgcgccaagctgggcagctgtttccagttaaggaagatggagctggtgctcactggagcagactttttttttttttttttttttttttttttgcgggggtgggggtggggtgcttgctttcgaagttgtcccagatgtttggccttgggggggttggagggagccggaggccaagaaggcctggggctgggtgaagcccctgcagctccgtggcctccaggccataaagaatgcagcccgcggaggaaatggccccacagtggagctatttaggcccggctttcatttcaaagaccttgtttccacttcattctcaaattatttttctaaacaagtacttttgatcagctggaatgttggacttctctttggggtaagccacattcattttttaaaactgctctgaaagcccagagctggggctctggagttctgtgttttggctcgcattgtggggagcttggaaaggtaggtggtcattcattcacaggttttctcacccacacatcagtggggacgttggatcactgtgcctcggcagtgcccagaatcaaccgtgtttacttgaatacccttaggacagtgtctttgtaaatctgggacctagaagtaaaacttggaggactagccaccacaggctacagagtggagctaaaagcagggaggccggaggcttaatctagatgggactcatcctgagccgttgtgggtccagaccggagtgaatccaagaagcccccacactgcctgctgggagactggggtgggtatacaccaccgtagaaatcattccggaagggtgccacatacaagtgcaggtcttctgcgccttctgtctgaatctcctgctatccatgggaaaagcagcaggcacaattgagaaactgggaggagatggaggattgagcgagcctggaagggccttgatgcaggaaagacatgctgggcaggctcttggaactgccaggtctgctcctaagagtctcaggaaaaccctggggtggagagcctgctggagaacactaaacctagggaggaaagccacctgcagatgccaccgctgtcctccagcttagttcgcggtgacaaacgaaggcggaaatgactcgcccccagtggtttctttaaaaccggaagttgggtctctgcagccctttcaggctgaccagctgttggactgaggccaggcaagctcctacccattgttcctttgcctgcttgttgagtctttgtaacagcagatcctcctgcctcagcctccagctgagccgggactacaggtgtgccgcgcatgcccagctccaatctcattccgctgtttactatcaccacggaggctgcaatgagcatcagacacccagggccggcagctcgtgatctgagctgctagcaagccaaaggaggaggaaagagaagaaaagaggaagttgaggcacagcaggaagacagccagaagagccagaaagtgcaagaatgtttgtgggtgtgcttggcagggcatctctgaaggaaggtgtgtgtgggtgccatgtggcaagtggatttgtatctataagttctgggtgtccctatggttgtccaggtgtttatgggtgttgagctgtgcacagtgttcagggatctgtgtctacgatgtgtgtaatggatgcaggaagggttggcggggatgtttctggaaatcctgtagggggttatgaatatgcagagtgtaagggtctcccggcgaggatgagtgtgggtgtgtcttgtgatgtccagactgcctgtggaggggtgtgtggatctgtgtgtgacaaatctgagtgtgatttgggtttgtgctgtgtatgtagggtttcagagtctgggggtgggggtgggagggaggagtgtctgtgggtgtttctggtagggtattggtgtgatgtgggggctgggtgtgtgcaggtgtgtgaatgtgagtgcatgtgtgtgtgtgtgttgctctagtgggtgtgccctgtggtgtgagtgaatgtgggtttgggcgtgtctgtatgtgtccgcagctgtaggagcaggcatgcgggccttcagtggctgaggaggaatgttcacgttgggttagcagtggtgtgggggtgtgtcttcaccagtgaggagcagggggaggggggaccaacacccacaaaggaaaagcagcctccttatcaagcctctttcaagttaaaaactgctttcaaaacccggaaataactgccaggctgccatccgcttcctgctgggtgggaggtgaccgcagtctccaagcctgcagggaccccagagccaccttcattgctgggcacacctgccaaggctaagcttcatgggcccttgctgtcttcagggacatttttagcaacaattcattctctggggggctgagggaggggccttttatttccatctgggcagaaatagctctgccagatagtcttcacccagagaggtcgccccccaaaatagagaaaagatgtaaggacccaggacggatggggaaggaaactcctgagatcgttgaaaccaagtttaaaatatttctctaaaaataagctttgttttctctgtggacctgtctggcacaagggtcctcccttcagtcagggtgcttcgctgacctgggaagccaggcggaattttattttaaaaagcaagtgtttcccagctgcggccttggaaagttctctgttttccatttattaaaactcctagtttccggctaattaaaattattttcaaataaaactctgtagcccagcaatatttgatgaaacacagaattctcagtgaccctccgcaggaggctgggccagctgtggccagcctgtgtctcctctactgggctcagggcctattttatccagaagaggaatgggcctggaccataaattccagcagccatagcaggccccataagcagctcagaatactttactctcttgttggctgctgtgctgtgctgtgctggtgctgaaccccagggcctggtgcagtgcttaccaccaagtcacatccccagcactgaagattcagggtaactgggaagctgctgccctcccccaagccactatcaataccactaacaccatgggcagagggtccacttcgagagagacacataggctgcatcagttttaatcccaaccctcgggaggcagagacagtcaggtctcttgtcaattcgaggccagccaggtctgtatacctgggcatattcagggcatagtgagaccctgtctcaaaacaaggcagggggaggaggcaggtgaattgctactcactcctccctcgtctccacgacctagagacccttgagacttcagaatgagtgaggtagatcagtatctcagaacttgacacataaagtacctagcagaaatccacagccacctgttatattaatggttgagagagacagctgtggggtacacacactgagggtgaggcagagcttgcagggactcacctgctggcagatcccctgttgggcacccagcagagaggcagggcctgtcctttgtcccacagatagttcaccgtgtctggtaaagagtaagtctaagtcgatagctgctgcctttagggagtgtacaaatgagggtgtctcctgggagcatcagcacctcgtacctttctgtagttgaaaaagtatccattgtatggatatccggccgtctgtttaacagtcacaagatggtggacacatggcggctgtttcatggtactgctgggggcaaacaggtcctggtttgttggtaatgtatggtttcaaccccgtggggcataccatgtttgatcaaccccagaggctcacacgtgctagggcttagctctaccctatggctgagccacgcccccacgctcacatacttgaggtaatatggtagattggtttgtttgtttgtttgtttgtttgggctgttggatggtactgacgtctaaggcatgcaagcattccaccgtcatgctacatcccttagccaaatcaggtattttatgaattgttttattgaggctggttctctcgactagcctggaactcactccagctggtcttgagagatagtggtgggatgatcaggaattcaagggcatctttagttgtatagcaagttcaaggccagattgggttccaagagaccgtgccttgaaaaatcaagagaaaaaccaggtgtacctactgtaatccttccactcaggaagctaaggcaggaggaaggacgcaagttcaagcttgatctcgcctacaaactgagtcccaggacaaacaagactcagtctaaggaaggaggagggaaggaggcactgttagtgtggtcccttgcacttgacctctggaaggcggaggcaggaccaccatcagatatttaaggccatccttagctacatagtgcatttgaggctagccttgggtacatgagacctgtcttggggggggggaaacacctcaaatatctattgatgagttccaatttcagagaatctaaccctgtcttggaacccccatggacacttgagacacacatggtgcacatatatacatgcaggcaaaacactcatacacataatataaaataataactgtagtaatagtaattttgttttttaattatggcatgctaaacctggcatggtggaacacaactttaatcccagcacttgggaagcagaagcaggcagagttctgagtttaaggctagccaggtctatagagggagttccagaccaaccaggggctacaaagtgagacttttttgtttgtttgtttttgttttttgttttgttttctcgagacagggtttctccgtatacctctggctgtcctggaactcactttgtagatcaggctggcctcgaactcagaaatccacctgcctctgcctccctggtgctgggattaaaggcgtgtgctaccaccgcccagctgtgccccaaatttttatgtgcagtcacttaaatgtgtacttcttttatttttttcaagttacatttttacacacactcacacacaagcactttcttgcacacatgaccatgcatgtgtgtcagaggcttgacaccacggacctccctgtgctgagcgtccttaaattaactatggctaaattgtggggtgtgctggtgcccacctgtaatcccaggcagaggcaggagattagcagcaggtcagtggcagcccagctgcctgaaatccaacccctacctaatctacataagacctgcctcagagcaccacggagactcaaggtggaggctgggacgtaggtcagaggcttcctggcatgcctgaggccctgaattcaaaggctgcactgcaaacaggaagaaataaaataagcgcaaacagtaatctgtcaccctggccctggacaactgtcttttgtcacagcatgccctgggacacagccacaaagcctttgctgattctcctgctgtgcaggagccaagagcgtctacaccaccacttcctcagcccagagaccgtgctgtccggggaaggggccagcctgagttgtacccggcagcccacgtgtgtgactctcgtagctttctcgagcttttctacgtggcttctttgttcccaaaataagaactctgagacctaggtttttgagttttggggtttgtttgttttagatttttacatttattattatatataagtacactgtagctgtcttcagacgtgccagaagagggcatcaggtctcattatgggtggttgtgagctaccatgtggttgctgggatttgaactcaggaccttcagaagagcagtcagtgctcttacccgttgagccatctcaccagccctttataaatctttttttgtttgtttgtttttgtttttggtttttggttttgtttttttcgagacagggtttctctgtatagccctggctgtcctggaactcgctttgtagaccgagctggtctcgaacttagaaatccacctgcctctgcctcccgagtgctgggattaaaagtgtgtgccaccacgccggacgagacctaggtatttatgactaaatgactaggccatacacttttggccactttctgactagcttgaaactcctataactcatttattctagtgtgtgtctgccacatggctagttacctctcctcctctcctgttcccgacttcctcagggtctgggctgaatttccctcccttgactctttcccggatgtcccacctcctatctcctgccccatctaatacgccatcagctttttattggcaagtgatgcttccacacggtatatgagacattctctccagacacccatctacgcttgcaccctccaaggtccctggcgctctccttcgtttttttacctccagaccttctcatcctgtgtgtcaaaaccccaccccctttctgttcctactgcctctgcagggcaggactccctgtgctggcccgggctgaggcagaaccaggacccagtgttcttcaggagcaggatataggaaggagaagctgatccctggca

SEQ ID NO: 506 - DNA, 956 bp, Mus musculus
acctcaatctgaacaacatgctggacaagaaggcggtagggacgcccgtggctgctgcccccagctcgagcttcactccgggcttcctgcgacgccactccgccagcaacctccacgcgcttgcccaccctgtgcccagtccgggcagctgctcgccgaagttcccgggcgcccctaacggcggcggcagcagctgtggccccgcaggcggaggcggtctggcctcctacggccagctcaaggagccttcggggggcagcggcacggcgctggtcaccaaggagagcaaatttcgggaccgctcgttcagcgagaacggggagcgcagccagcacctcctgcacctgcagcagcagcagaaggggggcagcggctcccagatcaactccacgcgctacaagacggagctgtgccggcccttcgaggagagcggcacgtgcaagtacggcgagaagtgccagttcgcgcacggcttccacgagctgcgcagcctcacccggcaccccaagtacaagacagagctgtgccgcaccttccacaccatcggcttctgcccctacggcccgcgctgccacttcatccacaacgcggacgagcggcggcccgcgccgtcggggggcggcggcgcctccggggacctgcgagcgtttggcgcacgcgacgcgctacacctaggcttcgcccgcgagccgcggcccaagctgcatcacagcctcagtttctccggcttcccgtcgggccaccaccagccgccggggggcctggagtcgccgctgctgctcgacagccccacatcgcgcacgccgccgccgccctcctcctcggcctcgtcctgttcctcctcggcttcttcctgctcttccgcctcggcggcctccacgccctcgggcgccccgacgtgctgcgccacggcggcggcggccgcgctgctactacggccccgggggcgcggagga

SEQ ID NO: 507 - protein, 318 aa, Mus musculus
LNLNNMLDKKAVGTPVAAAPSSSFTPGFLRRHSASNLHALAHPVPSPGSCSPKFPGAPNGGGSSCGPAGGGGLASYGQLKEPSGGSGTALVTKESKFRDRSFSENGERSQHLLHLQQQQKGGSGSQINSTRYKTELCRPFEESGTCKYGEKCQFAHGFHELRSLTRHPKYKTELCRTFHTIGFCPYGPRCHFIHNADERRPAPSGGGGASGDLRAFGARDALHLGFAREPRPKLHHSLSFSGFPSGHHQPPGGLESPLLLDSPTSRTPPPPSSSASSCSSSASSCSSASAASTPSGAPTCCATAAAAALLLRPRGRGG

SEQ ID NO: 508 - DNA, 22147 bp, Homo sapiens
  misc_feature (1)...(22147): n = A,T,C or G
gggcaaggtagtaagagaccgaatttggcaggttgcagctggtccctcaagcaggagatctaaatccaactcatccttccccccgcatccccaaaacatctcagcattccttcctcttctgtccttgccttgcaggcttggagtctgggtagttaagagttctatctagacccacttctggccacatcacaccagctcttcccttttgcctgtcatcccgccactctcctgccccttcctaaccatgattcatggcaaaatggtgcaagatgggccaggcgtggtggctcacgcctgtaatcccagcactttgggaggccgaggcaggtggatcacaaggtcaggagatcgagaccatcatggctaacacggtgaaaccccgtctctattaaaaattcaaaaaaaatttagccgggcgtggtggcgggtgcctgtaatcccagctactcgggaggctgaggcaggagaatggcatgaacccgggagacggagcttgcagtgagccgagatcccgccactgcactccagcctgggcgacagagcgagactctgtctcaaaaaaaaaaaatggtgcaggatagaggctacctgtcctgtcaggtggggctagtgcagcagcctagccttccttggtggcatctctggtcacccccataggttctttatggactcaacaggaatgtcacttgagctgcagatactgattttgctgatggatgatgaaatttttttcttccctgttgggctttcagtccttgccttaaggagaccataaaaaaagtggtgggaggccaggtacagtggctcatgggtgtaatcccagcactttgggaagccgagggggcagatcacttgaggtcaggagttcgagatcagcctgactaacatggagaaaccccgtctctactaaaaatacaaaattagccgggtgtggtggcgcatgcctgtaatcccagctacttgggaggctgaggcaggagaatctcttaaacctgggaagcggaggtcgcggtgagccgagatggtgccactgcactccagcctgggcaacaagagcgaaactctgtctcaagacaaaacaacaacaacaaaaaagtgataagctgggcacagtggttcatgcctgtaatcccagcgcattggaaggctgaggcgggtgaatcacttgaggtcaggagttcaagactagcctggccaacatggtgaaaccccatctctactaaaaatacaaaaattagccagccatggtggcaggagcctgtaatcccagttactcaggaggccgaggcaggagaatcgcttgaacccgggaggtggaggttgcagtgagctgagatcacgccactgcacacaagcctgggcaatacagcaagactcagtctgagaaaaaaaaaaagagtgataaacccactgggtgcagcggctcatacctgtaatcccagcactttggaaggctgaggtgggtagatcacttgaggtcaggagtttgagaccagccgggccaacatggtgaaacccagtctctacaaaaaatacaaaaattagctgggcaaaaacaaaattatctgggtgtggtggcacatgcctatagtcccagctacttgggggctaaggcaggagaattgcttgaacccaggaggcggaggttgcagtgagccaagatcacgccactgtactccagcctgggcaacagactctgtctcaatcaatcaataaaagttgaagggaaaaaagaaagaaaaaggccacttaattatcccttctctatacagattctcagccaattgagaactgcagaaaggagttaggtagaggtaaaaatggagattgtattgtaggtagaggcccagtcaacacatggctcagacccacagccaaaatgcaccttcaccccctccccttttctgtttcctggtttaaatctgggttctaggctgcagagcaagcagcatggggaacggggacactaaagggcaagtgtcctgggggacttatctggagctctcaagatggtgagatcagtactttcacctgcttacatgcaactaggtgctgctgtgtgacctctgaatagtcctggccctactgcagggtcactacccctgctgaccccaccatcaaaacctctggattgttgatgctgggtctccaaatctgcgctttgcatgcaccatgaaacttgttgccaactgtaatttcttgatgtgtgcaagtgggttacataatacccaacccataggatgctagaaggactggggagacagcatttgatcagggcctggcactcactaggccctcagtggggccatcccagtaagcctggttcaacacccacgggaactaagcctgctgttgcagattctcggtcgtctgcctgtgtgccgagtaagtctttcgggggccagatggtcagggtaagtctgtgtgctcaagttagagatgtggatttgggagtgatcagggctcaatagaaatgcatcattgaaagacaggcctttcaatgtcagttggtgcaagatgggcctacagaggtccattgtgcagtgggctttcagtcccgtgtttcagacaccctccaggtttgggatgggaggggcagagttgttaggggaagtgacaacacccctgagcctccctccaaacccatatttaggattgtctaaggccaaatgttgaaataagcaatggtttccccaaggccccctgcttcctctttctgcacccttctattctttcagtgcccttcctccaagcacccaggaaaacaagggtccaaaaacaaaaaactccgagacagagggcagcaaaataggagccaaatgcagcctaccacctgctttttacagcccatgagctatcaatggtttttacatttttaattggttgggaaaaaataatattttgtgacacattaaattcaaatttcagtgtccataaataaagttttattggaacacagccacaaccatttgtttacagattgtccatggctgctttcagccgaggtgaggaggtataggcttgcaaagtctaaaatattgactctctggccctttaaggaaaagcttgccgatgccctgctctaggatgtgtcttgtgcccaagagatctgctttccaaggaaagggcaaaccagtcaaatccaggcagatgtgcagaggagacactggacagggaagccttcctgatccttctggtgacactggaggagcagaggggagataactctctaatcctgcagatggaactgcttctgtccacactgagttagggggcatggaaacagtgggttcaggcctatgactcattctaacagtataaatagcaggattcagaaggtgattaatcgtctccagtgagcccaccctaccagcttccctgccaggctggtggcagcgattttacctgaggcctttattgttcccagggtcctgcaggctgccctggggtcggccctgagcagtatattcattgctcacctttctcctgtctttgcagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtgatcccggggtgtcaggggagtaggaggcagggttggagtgtcctaaacccgctagatgcagcacctacagcctcagctgggcttttgcatgcttagacacagagcaggaaccactaggaaagtcacccactgggtgctgccgaggacacggggacactcttaggctgacttctggggtgctgatggtcagcctccagcttagccaggggagagaactcggaaagaagcccctggccgggcacagcggctcatgcttgtaatcccagcactttgggaggccaaggcaggcggatcatgaggtcaggagatcgagaccatcctggctaacacggtgaaaccccgtctctactaaaaatacaaaaaattagccgggcatggtggtgggtgcctgtagtcccagctactcgggaggctgaggcaggagaatggcgtgaacctgggaggcggaggttgcagtgagccgagattgcaccactgcactccagcctgggcaacagagcaagactccatctcaaaaaaaaaagaaaagaaaagaaaagaaaaaaagaagcccctggatgcggagagttttattatggagactgcttgttagtcagtattggagttagcctggggcttcccaaagttaggtctgagggtgaagcattttcagagaattaggatctttgctgggaacttcctgcttgaagaaaactattattagccccctccagggtgggtgcagtcacagatagggaaactgaggacaaagacaagcagcaaaagcatcctgagaactgaaattgatcgccaccagcatctgactcagctggccttcttggcatccccagcaggccaagggttcaaaacgcattgtccctctttatgagaaatttggagacatggtaagtgtctgacaaaaggaccttgagaatcacagtgttatagaaacaggacacagcctagtgtcctgtgtttggagattccttcctctctggcctgctgcagagatgacctttcctccctcctctccaatttccagctgcaccttaaactctagagcccactcccttgttgaagtccccttttcagcatccatcccccaaagtatcttgactttgaaccacaaacacatctttatccaaggtcatgttaagtctggggaaaaaattcctctctggtggagaaatacagtgagtgaaaatagaaggtgaccttcaaggctgcaagtggtgtgtgtacatggatgttgacaggcaagagtgcaccctctgtcaggtgggggaagggaaacccctcttgcatctggcagggtactgcttggtctggactggggcttgtcaccattccctgtaagactgactttcggctttttcatctgatttaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttgaagaaaatctgggggactgggatgggggtatgtgtggatttttcctccactaaatctgcaggaaacatgttgaacataaattcaaaaattttatcccattcatgcctcccctacttctgtgagtccagtcgtctgtcactccttacagagaaacttttcttcagttcactcattcagggcagcctattttattgctgctactgtaggaagtgaggcgactccgttgcagatttactctgtccccaggtgcaggccacctgcaggcctgaatgagcctttttcatcccccagggcctctaatgccctgccatagccgccctgcattctctgtgaaatgactacagagagttggattttagcacatacacatgatccctcccctctccccttttctggctttatgtaggggctggattagttggcaaacagcccatttggtcagatttgtgaattttgttccattttagcaaagcagaaatatgttccaaatgttggatcctgggagaattcaggatcaactttgcacaaataatttatttttattgtctgcatgtgttaagtcctgcagtgacctacacattccatcctaattattcaaagagccattgagcatttcccctaccccccaaaaagtatgctaatgctaggaaacctgattttgccacccagtgaaagtatatccgtcctcttagctgtgaggaggaacctggggaaaggagagtcagagaaaatgacttattctgtgcctacattgtttacctatcgcttggtggcagtaacaagtgtctcacttaaaatgccattaaacacatttatcagctgggcgcggtgtttcacacctgtaatcccagcatgttgggaggctgaggcgggtggatcacaaggtcaggagttcaagaccagcctggtcaagatggtgaaacccccgtctctacaaaaaatgcaaaaaaaattagctgggcgtggtggtgggcgcctgtaatcccagccactcgggaggctgaggcagagaattgcttgaacccgggaagcggaggttgcagtgagccgagatcgcaccactgcactccagcctgggcgacagagtgagactcgtctcaaacactcaaacacacacacacacacacactctcactctctctctctctctctcacatcctttgcagtgattttaatctagaaaccttaatgattttcttccttttcaagcccagcccagccctcttcctcacacatccagcaggtggcgctcttgcaaacgttttgctgctggtccagtttttcactggctcaccatttttcatttataatttcagaataagtgttacccactaatagttatcttgagaatcatagctttggaagggtagtagcttcatccgcattcatttttcatcctactgatctgaaaaaaacatttcatagtatgtaaatttgctccagattttagggtctgtaaaaaaaaaaaagtactcaggtaaatgatcacttagagtaatttcattgatgtttcacagagtctgaaggggcgggttagaggagagtgagtttacaatcatttcctactgcagaaaagctcatatttcaaatgtaattcatcgctcttcgagagaaaaccatctaacactaaaaatgcagctgtaagccaggcatgatggtgcacacttgtaatcccagctactcaggaggctgaggtgggaggatcgcccaggagttcatgcctgtgaaaggccactgcactccagcctgagtaacacagcaagaccccatcactaaaagaaaggaatttaagaacaaaaaagcagccatactggaagtataggaaaggggctttgtaggaagaggcaggaaagaagttaactcagtgtccaaagttttgtcctaaagagaacaggaaattccctgggtggttttgcaaccactcggccccaaatgtggtttttgtgatcctgaattaattacctagttaggaaactgtgtagcccacacctgatggaaagctgccaacctaacactttttgttctaagacctagctggtgagaagtgagggacttggtaaaataaatgtggtgataaccacagaaaaataataatgaaactggcccaacaaagcccagctcattggaaatggccagcacttctttttttctccatttaaaatgaaataaaagcagctacattagacattttatactagcaggtactctgtacacaagcatgtcccgtaacatgtccacatgttatctccagaatcctaatctgcaaagtgggtgttctcacagctgttgactgggactcaccccagatttggacgttgtttcaaacagatgtttccactggttctgtatctgaaatcttgttactaacctaataggagtgcctagggaagtggctgtttcacagtttggtgagatgtttggggtcatctcaccaaagaacaaaccagaccacagttgcccaggtatgtcaaggggtcagtgtagggtaggtgctaaaagtgaaactggtccctctgaggtcacctgctcttggctgtgagtcctagggtccaggacttgggtgcccccacagctctgcactcatgattctgtggctctctgtccatctggccacagttcagaagccaggctttctccacccttacgcttttgtcaatttggtttaatacataaagatggtttagttcttgcttgtcttttaaacaccttcacagatatcatttgcaccttgccaaaggtgagagatgaataaagcaagaatattatcttcgtttaacaaggaaacccaagtaccaaagagatgatgtgatttgcctaagaccacatgatttctctggggcaggacctgaactccagcccagcattcctgatccttaccctggactctggctccctgggccatgaggggagtacagtagtgggaaatgcaggatacactccagggactcgaatccctgagtggcaggcctagttctttccccagcgggtccggggccttcgagcttcaggcccaagctttttgtggcaacctgtatgaacgcggagggagaagtgccctagaccagactccagatcgttcctagtggggctgtcagcggctttagcctcactgggcgctagatgggagtgtcccctccgtacccggacgaaggcggggcgcccgctggcaaagcgcattttccagcgcaagctgttggggtgcggggctggcgagtgagggaaaacagagggtggcgcgcccaccatcagcgtctgtgcagccccacctgcgccgcgggttggtctcagccggatcctgcagccctcatcgagcaaaggctgggcgcggcgcccccactgccggggagggaagaggctgggaggacgcaacaggcccaggctgtgccgggcggggagcctcggcaggcagctgcacccccagccccagagggctggggaaggccggcccgaccagcagacggaaaggtggcgctaagtcgccttcaagcccgcacggctctcccggcctttcctcctgtcctcagagtcagctcccccgcccgggacgtcccgcgccactccgcgcctttggccctggctcaaggtcttgtgatgtgattagcaaagccagcgccttgtcctcagacactcagccctgcccggcaggccccggcgctcaagccctgtttactgagcctgggcggggagggggcggagaaacgagcccgggctccaccggcaagactgccgcggcggccgcccgcgtggccacccccacccccaccgcgactccacgtgcagtcgggctggagccgccaccgactggacgcaggccccgagcccccgcctcctggccggggcaccctttgcaaacccgccgggccgcggggatggttgcgatattctggcattttgcaattcccgcgcccagtacaaaaccgaaggtgggagcttaaagctccacaggtccgcctcggagaacagggcagggaaagacacgtccagggctgcagaatcccggccacgctaaacgtaccggggctctccgaccgcgcagccccggaggagaacagccgtgccttcccgccgccacccggcggcatccactggggccgagagctacacgccacaccggccgcccgggccgccggccccgcccggaggcctgcagcaccctcccccggaggtaaaaaaattggcggcggccaatgggaggccgggaaggcgcctgacgtccgcgagcgggcgggcggcgttgcctggagaccccggcgggggccgagttctgtcccctcccccggcgcgcccgccccgccgcagccgcactcccgggctctatatagggcgcgcgctcggaggccgccgagttccagcagtccgcgagctgccgtcggctccgcggggggggcgggccgggcaccccggggcgcggaggagcgctcctcgcttctctccttcccccctgccgcactccgccggaccctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaacatgtcgaccacacttctgtccgccttctacgatgtcgacttcttgtgcaaggtaggccagggagcgggcccggccggcagcagccgttgtagttcttggactttgcctctgtccccaggttctgggggacgcccctcccgccctgcctttcaggtcgggaaagtcccggggtttgcaaaagagtgtccgagcgccctggaggcggggagggcggcaaggagggcgccggtgtcgcggttgagtttctccactgccgaccgcggccacgctgcccggggcttcccggacaggcttcgcgccgcccacctcggcagccggggcggaggatcacgtgtcgaaacccagcgcggcccacggtgggcgtcctctcctctcccgctccgtccagcaagatcttgctggttttgcgcgtgtataggtggagggtggaggccgagtcgggatccgccaagagtgggggaaaaaaaggaaaagaatcaggctgggagttcctctgcggctcgccccgagtctgtcttccccttccgtttttcatcccttccccgctcccctccctttggcagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcgccggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatgggccctaggcagactgcaagcccgaccgagcacttggactcgaactctgtgccgggaggggcccccacccctcctttttcggtttcctcttgtctttttttttttatttttattacgaagtttcattctttttgagcaaaaaagtcgaactttttctgttgaacaaaatattcacaacagggcagttgtgatacgaatagaacaaaaaaaaaaaaaaaacacttaaactttgttaggactccgatgagtttgggacttcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccaccttgctaaacctataagctttttaaaatccaatatattctgccaagaatatgccttgatagttagccctcagcccataggtgttttttgttttttaacagaattatatatgtctgggggtgaaaaaacccttgcattccaaaggtccatactggttacttggtttcattgccaccacttagtggatgttcagtttagaaccattttgtctgctccctctggaagccttgcgcagagcttactttgtaattgttggagaataactgctgaatttttagctgttttgagttgattcgcaccactgcaccacaactcaatatgaaaactatttaacttatttattatcttgtgaaaagtatacaatgaaaattttgttcatactgtatttatcaagtatgatgaaaagcaatagatatatattcttttattatgttaaattatgattgccattattaatcggcaaaatgtggagtgtatgttcttttcacagtaatatatgccttttgtaacttcacttggttattttattgtaaatgagtacaaaattcttaatttaagagattgtatgtaatatttatttcattaatttctttccttgtttacgtaaattttgaaagattgcatgatttcttgacagaaatcgatcttgatgctgtggaagtagtttgaggaacatcctatgagttttcttagaatgtataaaggttgtagcccatccaacttcaaagaaaaaaatgaccacatactttgcaatcaggctgaaatgtggcatgcttttctaattccaactttataaactagcaaaaaagtgtttgcttattccaccagttctactgtgacatactcgagtataaagacatgtagcaataacggggagtggggggggagtctcacagtgcctttggaagggcccgaacttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacagaaaattccaaaacttgtactatttttttttccatgtagaaaggcaggaatgtctcctaagctttcctggacagcagatgaatgagcggtagctttagtttgtacgtaggtacagttggagcactatatgtactctctggactactttggacagaagtaggtttttgaatgtaacaagataagtcaacttgagttgtaatatattttggggaatcagctcactacaaattgtgactgtaaacattgtactgtaaatgttttgtagttttcccccaataaaatttttgggaaaaaaaggtattaacatgtaagagctttctttttaaacaggaatgtcttagctttctagcttcccagctaaccatgtctgccattccccaggtcttggcatggtgggggaggacttggagagctggcagagccagagttcagaagagcctgcgtcctctcagcccgtatatattttataagcaagttcttctaatgaaagaaagtaattatttggactgtcaagggcattagttagctagttgttccctttggtaataagatgcatcccagagttagctggctgggagcagagcctggccgggaggcctgaaggggtgtggcctgcctgtgagtcactgagtggatcatgtggctgcggtagcagctgagggtccgattttttgctgggaaacacaactgcttgggtggggaaggggaggaggatctttctgcagccggtggcctgccaggcctgagtgctgagctggaggtggagagtgaggccaggctttttctgggtcggagaactggagttctgcctggattttggaaagcttggtatgtccttgtggacagggtggaggggaagattaaagaggttaaacttatatctgggtgatgtttgcttatgcggacaacttcctctgggaatgaacacatacaagttatttatgcaaaaaagatttcttgtctgtgctttagaggactgtaagtgaccagaaagcaaattcaacccaggtctctagaaaaaggaaggaaaaaaagacattgatttgcctgctgatttcgcaaacggttgaacaaaatcttactatagtgactctggctgtttctaactttaaaacaatcactttaggaacttaaatcgggttcataaatcaattcatgtttcttctcctccaccgccgtcccccatgcacacagttcagacactttttccaaggtaggtaagagatttagcaatagtttgctttctcatatacaacagctgggctccatcaacaatcctcgcatccccgctccctcccgggccctgccttagccggggtctctggtgactcacagctgagcatggaggggagggggcggtctggtggatacgccaggcctcgggcagctgtttcacgttaacgatgattgcactggtgttaactggagcgttttggtgcttgttgcttgctgccaaaggggatgggaaacagtttcaaggttctcccagatgccagcccctgactgaaggcctcagcagcaggggagaggaagcccgaggccaaggagggctcaggaggggtgaagactgcaggctccctggcccctacaccataaagaatgtgcagtggggaggaaaagtctaaaatgtgctatttaggttaagctgcatttcaaaggccttgtttccacttcattcctaaacttatttttctaaacaagtacttttgatcagctggaatgttgggggtaagccacattcatttttaaaaactggtttgtttgaaaagcccaactgttaggatctgaagttttgtatcgcagacccagtggagcgtggaaagctacggggggatcattcagaaatttcctcttgccccagatcagtggagggtactgtcattgtcttcctgcagcgcctggaaattaacagcaaaaaaacctctaccgttgcttgatcacccttagaaaagttttcttgtaaattaaggaaatagaagtaaagattgcaagtaatgacaaaccaaaattcccatcccggactgttgactctaagactgagttgcacttagaaactacaggagaaaattcctccgtagtcagttgtgaaaatgagcccagaatgtgatggtgtttagaatgtcttcatcgtggcgtttccactggatgtctgaagactaaggtattttttaagcagcccaattagtgtgtgccaccttctaacttatttcagagaaaggatgtgtgcatgtacacattttccacccctcatgctgtctgaatctactgctgggtgtgtaaaagaaaaaaaaaaagcacacacaaaaaaactattcagaaggccaaagctctgcaccagccccagggaatagatggaggattgtgagccctgcagtggctcaggaccccggatgacagagccaggcctggtgggcccgacgcaggaaaaacaagcaggcctagctcttggccgccagcctggcccggcactagaatgctcggtgctaaaacctgcctgggggcgctcagaaaaacgccagggtggccatgtgcagggaggaagcccgctagagagcactgaacctcggaaaggaaccgtccccaaacacccgctctccttcagttttgcttgtggtgacaagtgagggcggatgtgactctcaccaagttttcttgagaccggaagttgggtctcggcaccgtcctcggccttggaagttcgtgggagccggcacagcccttagaggctagccgggcttaccttccatcaggggcccattgtcgtgaactctaattgtgtttattttttcttgtccacactcctgggggatatgcagagctgtggccgtccagggcaattccagttctgtgccgctgctggcacggctgagggagggaggaggacagcgggggctgtggcggggcggggcctggcagctggacaggcctccccaggaggagccctgcagggaggaggcgggagggagcggggcagcaggaagccacagcacctccagggcccaacctctcctgatgggttttgctagaccttgaaagagtgtgtgtgtgtgtgttgtgtgtgttgtgtgtgtgtgtgcgcgcgcgcatgcatgccgtgcacgtgtgtggaggcctgaggggtgcgcctgtatgggaagtgtattagtacgtgtttctgcgtccttttctgtctgtgggtgtgcagaggtttgtggtgttgctccgtctgcaggtgttcaggggtctgcatgtgtgatgtcgccctaggggagtactggtgtgtggatctgtgtgcttctgcatgtggaggctatgtggggggagggtctgtgggtatggctgtgtttggatgtgagtgtgtctgtgtgtaagtgtgtgtggatgtgtgtgagtgctggtgtgggtttgggtgtatctgttgctatgtaggtatgtggatctttggggtgtgcctgggtgtgggtgtgtctgttgtgatgtgggggttggtgtgtacgcaggggcgtgtgtgttggtatacatgggtgtgtctgtgtgtaagtatgtgtggatgtgtgtgagggctggtgggggtttgggtatgtctgttgctgtgtaggtaggtatgtgggtccttggggtatgtctgagtctgggtgtgtgtgtgtgtgtgtgtgtgtgtgtgtgtgatctatgggagtgggtttgggtgtgcctgtgtgtagctgctgctgtgtgtgggtaggtgtgtggctctgtggggggtgagcagctgtaagtgttgctgtgtatttgggtctggatgtgtctgctgcggtgtgcatgtgggtgtgtctgtatgtgggtgttaccaacacctacggaggaaaagcagacctttttagcatggctctttcaagtttaaaaactgctttcaaaacccggaaatgaccgccaggctggcatccgcttcctgcagggcagcaggccgggcagggctgggtgggagggtggtcagtgggcccctgccttgcagggaccccagactcacctctgttgctgggcacacctgccaaggacaggccttggtgccgctggctgtctgcagggacatttttagaaagaattcactctgtgggaagggggaggggcccttttattttcatctgggcagaaatagctcctgtcagatagcagctcttgtgccctctggggcgagaggcagctctgaaatagaaggaaagatattaaggactcgagacagacaagaaaactcctgagctcgctgaaaccaagtttaaaatatttctctaaaaataagctttgtttttcttgtggattcctccggccctcgtgtcagggtgcttagctggtctgggacgccaggcggaatttttaaaaaaccaagtgtttcccagctgtggccttggaaagttctctgttttccatttattaaactcctagtttccggctaattaaaattattttcaaataaaactccatggcccagcaatatttgatgaaacacagaattcccggtgacccctctgcagggggccaggcggctgtggggccgcctgtgtcccctccagtgcgctcagtgttggttttatggggagagggaacccgggcctttgaaatgcagaccgagggccttgtcttactaaatcccacctccgctcccgtggtgactgcttgctggtgtggtgactgcttgcaggcgggcagtctgagtcctgcaccacttgagaaggggctgcggggtaattggaaacctgctgtttgtttcccctgcaccactaataacctgagcagaggggggtgcacgtcaggggagaggaacttggctgaggcatgtggccacatgatcttctgctacctggtggtttctccctggcctggcagctgtggagtcttcagctcccaccacgccaatgtgccaggactttattgagcacctataagatgcccagactgacatctagtcccagagttgggtgggacttaactgacatccagggccacatgttatgcagatggaagtcggtgaggctgcagggtggaggcagattttgctgagggccagagctggtgggattcagacttacagacagatccccctccatggtcccccgcattcagcccacacagcagtggggcaggatactgggtctgttggcccagccctgccctttcattcatcccacagagacttctccattgtctagtaaatgcctgcactgggctaagagaggggagctgacaggtgttattcctgccttcagggagtctgcataatgatttcaaggttcattcatgttgtagcagaaatcaacttcattccttttttatgactgaataatattccagtggatgggactttgggttgtttccactttttagctactgttgaatgttgaataatcctgctatgcacaagtgtagaagtccgtgtgtgaacataaactttcttttttttttttttttttttttttggagatggaatctatctatcacccagactggagtgcagtggtgcaatctcggctcactgcaacctccgcctcccgagttcaagtgatcctcctgcttcagcctcctgagtagctgggattacaggtaagcaccaccacgcccggttaatttttgtgtttttagtagagacagggtttctccatgttggccaggctggtcttgaactcctgacctcaggtgatccacccaccttggcctcccaaagtgctgggattacaggcatgaaccactgcgcccagcccatcttagttttttcaaaaagtataatcacaagctgaaatccaggctataaaggggaagaacatggtactaagggagcatctgtcagggaaattgaacacacatagggcccagaaggcgcctgaagaagcaagaaaggaccgggcatggtggctcacacgtgtaatcccagcactttgggaggcccaggcgggaggatcgcttgagcccagaagttggagaccagcctgggggacgtggtgaaaccccttctctacaaaatattcttttttttttttttttttgaggcagagtcttgctctgtcatccaggctggaatgcaatagcgcagtcttggctcactgcaacctctgcctcccaggttcaagcgattctcctgcctcagcctcctgagtagctgggactacaggtgcttgccaccacatccggctaatttttgtatttttagtagagacagggttttactgtgttggccaggctggtctcaaactcctgacctcgtgattcatctgccttggcctcccaaagtgctgggattacaggcctgagccaccgcgcccggctctttaacaaattagctgggagtgatagtgcaccactgcactccagcctggggaacagagcaagattctgtctccaaaaaaaaaaaaagttgtgtttttcactgcagagcgcagagggttatcacacatggaaagagctgggactctggagtcagatgggggcaatggatcctcaggtgctgcgaattactcgctgggttaccttgagcacagttcacagcctctttgagactcagtttcttcattcgaaaaatgggttaatatgtagttgctgttataaagattaagtgggataatacatgtaaagtgccttgcccagggcctggaggtggtgtgttgaggagcacgggctggctgctattattagtaatagaacacttcatccccttctgctacccctcctaccctggcccaagctcacagttctccaggtcagaatgccttaacaattctaatagctactatttatggagctcctattatatactaaagctttacatatgttaatgaagtcctataacaacccaagaccgaagtcctattgctattcccatttcaaagatgaggaaattgagctcagaggagttgttatatgcctgcggccatggggtaggaaatgtcaaggaagaatccaaaggaatctaagcttttgctctttcaaatgccacaggctgctttcctgacccctttcttcctgctttactcccacctgtctataaagccctgatcctttaagaaaccctccaggatttcattccagggtagactgtgtcctgcctcatctgtgcatttttttgttttgttttgttttgtttttaatagagacagggtctcaccattgtgcccaggctggtctcaaactcctgggctcaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccagctgctcaggagactgaggtaggagaatccccggagcccaggagtttgaggctgcagtgaactatgatcatgtcactgcactctggcccaagtaacagagtgagaccttgtctctaaaaatgataagaataaaaataataagaattttaatgctaaaaaaggtttaaaaaccactgaccgctgggtgtagtggctcacaactgtaatcccagcaccatgggaggccgaggtgggcagatcacctgaggtcaggagttcgagaccagcctagccatcatggcaaaaccccatctctactaaaaatacaaaaattagccaggcatgcgtggtggcaaacgcctgtaatctcagctactcaggaagctgaggcacaagaatcacttgaacccggaggcggaggttgcagtgagccgagatctcgccactgcactccagcctgggcaacagagcaagactccgtttcaaaaaaaaataaaaaataaaaacccatgacttagtgtagccctctcattccatagatgagaaacttaaggttgagaaggggtaggggcacccctctggagacttgccagtttctgggtctctacctagcacttggaaaagaaagaacccaggacacctccctgagcgtgcgctgtgccaatagggctgttggtgtcgattctcaccaaagcaaacccaaatccttcttggctgagaggctcagcatggctggtccctggatgttccatccagcaggcttctcagagggggcccagagagtctgtggggctgacaggcaggagcttgccaacaatagccctgtaggtccagagccgctgcaggggctgggaccggagggagcttgggcaggcattacctccatggctgtggaagggcctggccctaaggggttacaagcaggggctcccattggactgcaatcaaatctcagcccagtgctgcctcctacctgcgtgacctcaagcaaatctgaacttcagttttcttttttcttttcttttctttctttctttttttttttgacgcagagtgttgctctgtcacccaggctgcagtgcagtggcgtgatctcggctcaccgcaacctccgcctcccaggttcaagtgattctcctgtctgagcctcgc

SEQ ID NO: 509 - DNA, 1635 bp, Homo sapiens
acgccgccccaagggctcctcccgacctcccggcctgccgctccggccactgcgggatccagaaacatgtcgaccacacttctgtccgccttctacgatgtcgacttcttgtgcaagacagagaaatccctggccaacctcaacctgaacaacatgctggacaagaaggcggtggggacgcctgtggccgccgcccccagctcgggcttcgcgccgggattcctccgacggcactcggccagcaacctgcatgcactcgcccaccccgcgcccagccccggcagctgctcgcccaagttcccgggcgccgctaacggcagcagctgcggcagcgcggcggccggcggtccgacctcctacggcacccttaaggagccgtcggggggcggcggcacagccctgctcaacaaggagaacaaattccgggaccgctcgtttagcgagaacggcgatcgcagccagcacctcctgcacctgcagcagcagcagaaggggggcggcggctcccagatcaactccacgcgctacaagaccgagctgtgccggcccttcgaggagagcggcacgtgcaagtacggcgaaaagtgccagttcgcgcatggcttccacgagctgcgcagcctgactcgccatccgaagtacaagaccgagctgtgccgcacctttcataccatcggcttctgcccctatgggccgcgctgccacttcatccacaacgcggacgagcggcggcccgcgccgtcggggggcgcctccggggacctgcgtgcctttggcacgcgcgatgcgttgcacctgggcttcccgcgggagccgcggcccaagttgcaccacagcctcagcttctcgggcttcccgtcgggccaccatcagcccccgggcggcctcgagtcgccgctgctgctcgacagccccacgtcgcgcacgccgccgccgccctcctgctcttcggcctcgtcctgctcctcctccgcctcctcctgttcctcggcctccgcggcctccacgccctcgggcgccccgacatgctgcgcctccgcgccggccgcggctgcggccgctctgctgtacggcaccgggggcgccgaggacctgctggcgccgggggccccgtgcgcggcctgctcgtcggcctcgtgcgccaacaacgccttcgccttcggtccggagctcagcagcctcatcacgccgctcgccatccagacccacaactttgccgccgtggccgccgccgcctactaccgcagtcagcagcagcagcagcagcagggcctggcgccccccgcgcagccgccggcgccgcccagcgcgaccctccccgccggggccgccgcacctccctcgccgcccttcagcttccagctgccgcgccgcctgtccgactcgcccgtgttcgacgcgccccccagccccccggactcgctgtcggaccgcgacagctacctaagcggctccctgagctccggcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctggggg

SEQ ID NO: 510 - protein, 516 aa, Homo sapiens
TPPQGLLPTSRPAAPATAGSRNMSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAPAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 511 - DNA, 144179 bp, Mus musculus
  misc_feature (1)...(144179): n = A,T,C or G
ttgtatctgtgtacactgactaacaatcagtttacttaaaaagattatcagtgtttctaagagagaaattttatcagtaagaatattttaaaaatttcaaaatagagaaaagtctttgaagttaaacattaagaaaatgttaatttcaagcacagtgagaaaaattatcaataatattttcatgcttgtagaaaatgattttaatattttcaactgatgatattcaacaaaccgaatagttattttaagatatacttcgttgttatgtctcccttttcatttctgattttgttaatttggacactgtctctgtgccctctggttagtctggctaagggtttatctatcttgttaattttctcactttggttttgttgattctttgtatagttcttttttttttcctatttggtttgattattttcctgctggctactcctcttgagtgtatttgcttcgttttgttctagagttttcaggtgtgctgtcaagctgctagtgtgtgctatctccagtttctttttggaggcactcagagctatgagttttcctcttagcactgatttcatcatgtctcacaagttttggtatgatgtgtcttcatttacattaaattctaaaaagcctttaatttctttctttattttttccttgaccaagttatcattgttcagcttcccatgtgtatgtgggctttctgttgtttttgttattgaagatcagccttagtccgtggtgatgtgatagggtgcataggattatctcaatcttcttgtatctgttgaggtctgttctgagaccaattatggtcaattttggagaaggtactgtgaggtgctgagaagaagttacgttcttttgttttaggacgaaatgttctataaatatctatatttagttagatccatttggtccataacttctgttagtttcactgagtctctgtttagtttctgtttccatgatctgtccattgatgagaatggggtgttgaagtctcccactattattgtatgagatgcaatggaaaacccatatttaacccatttcttgacaactgtgaatagtattgcaataaacataagtgttcaggtaactactttatatgttaatcatatctccttgatatatacctaagcagtgagatagtcaggtcatatggtcaatcaattttcagctttttgaaaatcaccttccatcatccttcccataatggtagtaatatcttccactggagatgagttactttagaggtgcccagctaacttttgatattggaacatgacattgccctctacaaatgcactgggtcacattcatacctaatctgcacaagtgtgcttcagatgaacacggcacaggggtagaaagccctagctgaaacaaagatgacatgttttaggcaatattcatatacattatatatatttaaattatatatgtacacatatatacacatatgtacttataaccatatatacaaatatacacaaatatatgtacatgcattttacacatatatatacatgtgcatatatatacatatatacacgtttgtgtgtctttgtgcgtgcatgcatatgccagggcagctgtatggtgatcagagagcaactttccagattcaattctctcctttcaccatcgttccaaggatgcaaatcaggccatcaggtttggtggcaagagactttactcagtggttctcggcttttctaatgctgtggctctttaatacagtgcctcatgttgtggtgacccataactgtaaaattatcattttgttttgttttttgtttttttgagaaagggtttctctgtgtagccctggctgtcctggaactcactctgtagaccaggctggcctcgaactcagaaatccgcctgcctctgcctcccaagtgctgggattaaaggcatgagctaccaccacccggcctgtataattatgtttattactactttgtaactgtaattttgccactgcaatgaatcataatgtaagtatttgatatgtaggctatctgatatgtgacccttgtgaaaggatcattccatcccgcaaacagtctcaacccacagtttgagaaccactgctttacctgatgaaccatcttgcaggcctccaacaagggctcttgttgctatttattttcacatttatttggtgtgtgtgtatatattggtatctacatcaacaatgcatatgcaatgtcaacaatgcaacatattttaatgaaaaattgtctccacctgtgctgttgcttgctcagtttatcacgatactgaatagataccttttttaaaaaggagctgtcatggtgttctggtggcatatacctgtaattccagctctagggatgtatgggcaggagaatcaggaatgcaagaccctttcaagcaagtttgaggccagcctgggctacttaaaaacctgtcttcaaaaacaaacaaacaaaacccccaaatccccaaaatgagctgtgttcaagttagtgtattctgagatcatttggcaaactttctaaacagtgagtttcttcagggtggcgccaggctgaaagttatttacagtctgcttgggtggagaggccgtttgtcttcagaaatcttgtgaacttgaagcgacccaagtgatgtcagagaacttggttatgaaagtaattactgggctggggacataagtcagaggtgtacttgctaagcatatacaaagccctgagttttgactctaagaaatgacaaataataataataattggtgcactgaattcaaattgatgttagataaaattatataggagaacaaagcccgtaagccacccatttctcatgtaaatcaatacataatctattgttcttgcatgaaagattgagtggccagaagtttctctgaggtaggacattttgaggttgagtctgaataacaagagataccaccatttagaacttcctaaagtgggcccacgtgacttagaggatgtagagtagacccttgcttctcaaagtggattttctaaaacagccagtagtttgttcagaaatgcagactcccagaacctcaggtttattgtattataatctacactgaacaaagtcttctaggtgattcataaacatggtgctaggctgctagtacttggtaccttctgaggtctcctaaaaattccagaaaggtggggttgtgaaatggtgttttatcactggagtgataacacaggaacatcactgctgtctttgtagcaaataagccaggttctaagagaaggtcgttcattagtagatattcaagcactaggatgcaaatgatttcttagtcaggctccttgatttaagctcctttaagaagtgaccaactgcccatggtgggatactttgtgacagagtcaggacttcaagcaggactctcatcccctccccttgaaccagcttttcacttttaattttccctcatgtggccaaggctgattttgagtttgctacatagctgaagctgcccttgaacttctgaccttcgggccttcatttaccaagtgctgacattataggaacacaggaacatgtcaatttttaatactgacaaagagaaattagagtgagcatgggaaagggtggatagtcgcaagcaagagaggacttgaaagaaaatcatctcataaggatgaactaagaaaatatatgtgagaaccatgtctactaaaaagcagcacatttcagctaacaccaggagcatttctaatagaaagtattgaacgcttcagccttcccttctaaaccatctccattcctttgtatcagccacagatctcaagaaacactttccatctggtaccctcttcctgccccctcatcacaaatagcaccaggatgacactcaggggattttccttatccttcctgtccttcattatgatctctccagtctcaagcaccacaagaacaaagtaacaaggggctggtggtgcatgcctttaatcctagcattccagatgcagaggcggcagagaggcagagaggcagagaggcagagaggcagagaggcagagaggcagagaggcagagaggcagagaggcagagaggcagagagagaggcagagaggcagagaggcagagaggcagaggcaggcagatctctgagtttggggccagcctgttttgcaaagtgagttccagaacagccagggatacacagagaaaaccagtttccaaacaccagaaaacaaaaaacaaaagcccaaaaaacaactcccccttcaacaaaacaaaaatcaaacaaacaaacaaaccaccaccaccaccaaaatcaaaaccaggaaacaaaaaaatttttcattgataacccttaatgttaatggtctcaatttcccattaaaaagacacaattaaacagacaaattaaaaaacaggatctagctctatgtctacatacaagaaacattactcaccattaagaatagatagctcagggtaaaagaatgtaaaaaggtactcaaagaaaatgggcctaagaaccaagaaggtatagccttttaatatcttataaaatagtctccaaagcaaagctaagcagaagagatatagaaagaaactatagacttgtttaaggaaaaattcaaggagatgatattgcaatcctaatcatttatgcaccaaacacaagtgtacccacattcaaaaaagaaacattgctacagctaaaactggacattaaccttacacagtgatagtggatgacttcagtactctacatttgccaataaacagatcatccagacaaaaactaagcagagaaatgttggagttatataatgtcacaaatcaaatgggcctagcagacatctacagaatatttcacccaaacactaatgattatacatttttctcaggagctcatgggactttctcaaaaatcgataacatgctaagaaacattatacgtcttaacaaatatatttaaaaattaaaataacaccctgcatctatttgaccatcatggattaaagctggatatcatcaacaacagaaacagccgaaattatacaaagtcatggaaatcaaacacttcactacagaatgaaaaatgggtcaacatagaaatccagttggaaatgtcaaatattttttgaattgaatgaaaatgaaaacacaacctacccaaacctatgggacacaatgaaggcagttttatgatgcaagatcactgcactaaatacctactttaaaaaaattagagagttctcatatttgtaatttagcagcacatctgaaatctctagaggaaggaggaagcagaagaggaggaggaggagaggaagaggaagaagaaatagtaatatcccccaaagaatagatgaaaaggaagaatcaaacccaaggcgtaaagccatgagctggaaacaaacaaagtaatataaaggatcaatgaaagaaagagttggttcctaacttagagaaaatcagtaagattgattaaaccttggccaaattaattaaaatagaaagagagaagatcttgggataactctatctacgaaagtaaaatacttgtataataaaaactttaaggcattgaaggaagaaattgaagaggataccagattgaactatctcccatgctcacggatcagtaggattagtactgtgaaaatggctattctagcaatatcaattcttaatttaaaaataaatgaaaaattgtttcatatattctgagtattttcgtgtatccatacaaagttgaatttttttttattttcaatttctgtgaagaattgaatccagaatctgatagaagagaaagtagggcaatagtcttgaactatttgcacagaggaggcatatctgtgtgggacactagtagcacaggcagtaagacctcttattaatgaatgggacctcatgaagtgaaaaacttctgtatggtcaaggatcatatagcttccataattttggcaaagcagcagcctatagaacgggaaaagattctgccaagattatcagattatatatcagatagagaattagtatctaaaatatatgaagaaaaaaaatgaacatcaagaaaacaaatagtccagcccaaaaatgcagtacagaactaagcagagagctctcaaaaggtgaaacgcagcagttgagaaacccttaaagatatgttcaagggctggagagatggctcagtgcaccgactgctcttccgaaggtactgagttcaaatcccagcaaccacgtggtggctcacaaccatccctaatgagatctgaagccctcttttggcgcatctgaagacagctacagtgtgggctggtgagatggctcagtgggtaagtgcacccgactgcttttccaaaggtttgaagttcaaatcccagcaaccacatgattggctcacaaccacccgtaatgagatctgactccctcttctggagtgtctaaagacagctacagtgtacttacatgtagtaaataaataaatctgaaaaaaaatgtttctttaaaaaaaataaatctaaaaaaaatatgtccaacatccttagccatcaggaaaatgcaaatcaaaactactttaagatttcattttacagcagtcagaatggccaagatcaataaaagaatgcacatgctgctaagggtgcagggaaaggggaacacttacttatagctggtgggaacgcaaacttgtctagccactatggaaatcagtaggaagctggaagtcaatctacctcaagatccacctatatcaatcttggatatatatatatacccaaagggttctacatcctactatagaggtactagctcatccatgttcatggccgctctattcataatagcctgaaactggaaacagcctagatgtccaccaactgatgagtggataatgaaaatatgataaatttacacagtggagtatttttcagctattacaaacaatcatggaattcatgagtaaatggataaagctagaaaaaaacaaacaaacaaacaaacaaacaaaaaaaacaaaccaccctgagtgcagtaccatagattcccaaagacagatattttaagttttgtcttatatgtaggggcaatagaatatattgttatggaaagataatggggaaactaggaggattgaattgagatgagaataggagagaagtgtaagaaagggactgtgtggagggacaagtactacttttgaaaagccaacgtggaaacctactgtagaagcttcctaaaatacatgaacataggaaaggcatctaaaaggaaccactaaataatagggagacaactggacatcatatgccactctgtaaagcctccagtgccaggaatgggcgatatcttgttgcgttgttggccacaggggccctaatagaaaccttcaagtatcacaggctgtttctactccccataacctgatggtaaagcccggttgctgaagataacagctgtgtgtgccatcacacatggaagggttgagctggtgactaactagaagcttcccctttactgactagctgccatgctactggaagctactctgcaaggtaccggagtagaaaatgtaatcattgatgttatccagcaacaaaatttgtgacttagaacaatgacctgacgacatgacatattagttgaatagtggcaccaatgttatgggagtaaccaaccactttgtgattccatgaaatgaaacccaaacctacattgactgctaaagtggctaagaacttgaaacttgataggtcctgggtctaggggaaacctattattcttcttctgctaaaggaacatagcaatacaacgattcttagtgtcatatggctatactcataagggccttgctcaatccacatcagagaagcttcgtgtagtggatgggaattaacatagagaccaaaaagtgcacaacatatagagtgggacagacattggagcattagtcctagacgggaccttctaacctacccctcccctcaagggtcaggaaggagtgaggaagaggaggcagaaagactgtaagagacagaggtgatggatgactacaaggaaacagtgactaccagacacaatagggctgatatgcatatgaactcatgcagtgttggcacacaaaagatttgcaaaggttcaagccaggagtcccagcatctagagggaggaaggggtcatgggctcccagcctctaagcaagaagatatatgcaatcaatatgccctggcaaagggataatccgttttctccaatgcactctcactggttttatcaatcacacttcagggcaggcctcatgttccagttattggccaacacaaaatggactcagtggtatttttgtggactttttgtttcattgtgctgtgttttggctttctttttctttttggacttgatcctggatttgattgtttgatttccatttttgtgtttcatactttttgcttttgttttatgaaggaagaagaaaaaaaaaaacatgaagttggatgagtagggaggtggggaggatctgagaggaactggagagtgggaaaacatgatcaaaacatgttatatgaaacatcgtttcaattaaaataattttaaaaagggaaagtgacatttaacaacagaaaatgcctggtacaatcaccaggcactgataatactttctgttaaatattttcatgatggtagtgaccttgtctggattaaaacttcccaaataacagtgactttcattcttgcagtttttggcaggtccatatcttgtattactattttttttaaactgactttgaaagtatatgaagttaatcttttcatataattctttgaacattttcttcattcatattatatactttggccacattctcccaacccatccctctcaacttcttattctccttctgctctttaaaaaacttatgatccactgtgttcaacttgtactgtccatagctgtgtgggtgctggatcatctactgggagatggttggccagagggagtccaatacttaaaggaaactgtcccccaatggggtatttatcttaggggtacagccacataatattttcatattaatatgttttgatcacctaaataaaaatgcaaggccagtacccgcagagattccattctgttccttcccagtcaatacccttctcctcctaggaaactacctttcttacttcgaccacaataaatattaaactgcacagaaaacctcacatttcttgcttaatattcataatccccggcttccccccccccaactttctatcgaccgaaaaaaataacatgtcaaaatagtttggcattataggcatgtttcccttaataacacattacaatatgtaactatcaaaaagaagtttctttttgtaccaattaatgtaatatcttgggtcaccattggaacatgtccatacttggcttctccgaagcaactagatggtttctgaagtccatggcaactcaaaggcaatgattttgtggtgatcgaatagctcaaagtcactgtgacaatcttcacccatccaacatacttgagtactttgtgccgctccaccttggactcttaagaagactccattgagtcttagcgtcaacgtgtggtaagtgctccgacttaggtaagcaccaggcgcacagaggaagggtggcttccggtgatggggcggataggagaaggtgggtgggcatttccccagcagctgctgccagccacccgactttgatcactttgccgcctggcagcagtggcggtcaacctcatcgttccttagcaaccagagccaactgccaagaagccttcctattgggctcacagaacatgatgggtagtctaattgtccaatagaaaattttaggcttggctcgttgcaccgcccaccccgggccgcaggcggcgcatgcgcgggtgggcaggtctgtgtgcagggcggtcgctgagccggagctgctgctgctaagctcttgggctcggttgagaccgccgtgcttgctccttgctccagccgtcaccgccgccgccgagggagcggccgcctattgtccttctccgcggccaaggcgcggagctgctccggctcggcccgcgggggagcccggggagccgcacggtgagagcgcaacttagttgagggagttgagggaagtttgggcgtctgaggagggggcgcgcgcagagccgcccctccccctcggctgctctcggccgcgcgcgcgagctgcgggacgcggggacgcgcgggcgcgacgcgggtggcggacccttcttagcgtcggcagccaggggtggatagcgcggccgccgatcccggcctcctcggacccacgttctctgctgcccgcttctgtggcgccggctgcggctctcctctgagggacggctgctcggtggggcgcgccgctcgaacagagagtgcggccccgggaacgagcagctcccccggggcagtcaagccgggtaaacactgcgcgccccggccacctttgggggctttctcccgagatggggaggggggcgcggtgggcgccccgggaacggtggcgcattcgactcctctgcccctcgagctctagtgcaagcactttgagaactagcgaatcactgcttttcgtaaataggctcgctgacacttaactggggtgcgagacgcaccctcagtttatttctcgctaagaaagtgtctgtctttcggctgaaaatattggctaactctaagtgtctagactctactgtgaactcaggagttcacaatgaaaatggattgagcaatctctgagtgtttcagtctttgcttttccccttcataatgaagttattttgagagttcattgcgttgagcagatttacaaagtgatgtgcctttttgtctgtctgtctgtctgtctgttttttgttactaccctcatgatttcccgaagtcacttactcatttaaacccccaccccccaaacttttggattgcccgggtcaggaggagcgctccagttcttgaacgtgcattcattgtctgtaaagaagttcctatcagtcgagatgactctgagataaaccagtgtgtcactttgtacaccatcatctcttgggaatcattccgctgcatttcgttgactagacttgcgctataatggtaattcagttttagctcccaagagagaaccctatcattcatactgaaacacaatgcctcccccccacccccctccccccgtcacttcatgttaattttagttgtatttctttgacatttgttaaacttaaatttttctttgaaggctactgctcatggcattttgctttttttttctatgtgaataacatggacaagtggtgtgtggggttttctgttttgtttttggcttttctttgtatgaaacccagcttcgtttacctgatgaaaccaaggaaaaatattctgaaggcacagggattcaggactcacagtctttgtgcttaattttcctttctggggtgggtgtggtgagcaaaggaggtggacagaagttgggagttattggttagttacataatataaacaaatactgcaaaatcgggtggccaggacaccttctctggactgtggtaacatgctacacatacttttgttctagggtatttgcttcactaaatgggaactatgtgtagtataaatggtcttttctagtctttttacaccttaaggattgtgatgggtggtattttgctatgctctgtgtgtgtgttgttttttttttttttttttttttttttctagaaaagtccacacagttggtgtttagcttttgtttatttaggtgaggtattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcccttgccttggtttccttagggatagataacgcgtgtgtatcacttttccccagctttaaaaactctttttgttgatttgttctagaaaataactgggatttaaagagtacactctggatttaaaaaaaaaaaaaaaaaaaagaaattttcagttttgaaatgcatccctcacactctccctgttgagactcttaagctactgaacagattcattcatggctcttcccagtccttcattgtgaaattgggagggagcatagtttagaagaaattccctgtttggagttatgtaaatctgagttcagatcctcagctttccttccacggttttgaagccttgagcactgcacttgactctggagcttgcttctttccttgtaaggggtagtaatattatgttcttaggaatgcatgaaatggtctaggagacttagtacactgtccaatattctgcttcctggtggctaaaaagatcattgtggtacggttttacatggcttttaaaaagtgtttttaaagtgagggttccgaacagaaggtgggtcagtgggtaaaggtacttgccaccaagcctgatgacccaagttcaggtcccacaaactcctgaaacttgtcctctgacctccacattcacacttgtgaattaacttccaccctaaagacaaataaatgtaaaagacgtcctctgaacagaaggatgagagaggctataccgttttgtcacctgttagctttcttttgagtgggatcccaggtgccttggtaggaatgaaatctgtacagctgtatagtgtgagaaatgacaagagagagattgttttcagtactagcaagagtctgtcttagtgtttaagacactatgaaaatgactgcccttatgaaggaaagcatttatctggagcttgcttacagtttcagagattgagtccattgccatcatagaagggagcatggcagcatgtaggcagaaatggtgctggagagatagctgaaagttctacatctggatcctcaggcaacagaaagagagagagagagagagagagcgtctcggtctggcttatgcttctgaaacctcagagcctacccccagtgacataattcctccaataagaccatatctttccacaaaaagccacaccccctgaccctccatatagccccattgcctaataaggacacaccccctaacctttcagatagtgccactgtctgatgagcaagcattcacatctatgaacctatgagggcattctcattcagaccaccatagtgtcttgagttatagtcagtaccctttgttttacttcggtcttgaaaataatatttgtggctttatgacatttctcaggtttgctcaaggtagaacgggatggagtgtcagcagaatacatagttcagagactcgagtacaccactcagttgctttttcaagtgccactatttacagagaggagcagtggctaaagtcagttgtaccaacttagttcagaatgtttaaagtgccagacagagtagataagttttagaactgtttacctgatcaaacctgagattgtagggataaacatcccagaccaagccacctgatgcttgcttgtcttaaagttagtcctgagctacagttaatactgataaggatggatatccacatggaagtgattgtccctgtgttgtgtggcctgcctagcttactgttttgaggaagagagaaggaagctgtttgtaggaagaagtttatttcatgcccatgtcgcacatttacagttttctagtcaccttggtgttgatacagtcatcataataagatcaaacccattttcatcagtctttgctaagaggttggacttgcagatccagtactgaaatactgtgcttgtctgaattctgtgttgggtaatggggtgctttttttttttcttttttcttttcagaactgtatcttggtatgtttgcatggtgtgatagtgagtgaaagaaagtggagagtgggaggtgtttgctctttatgccaccggataggtatcttgtaatactttttattttctcatcataagcctactcttgatcatagagttggtccccaccacccaaaataatgaaatattctgaaaggttaattaattcctgtggcacacttttgttcttttttaacttgagatgccaatgcatgtaaaaacccttagagttaaagatttagttttgtagaacccaaggatggttttttcatgttgatctctgctaaaagcacatggtatacagacagctgcatccacacactgccacttaccggcagtctgatcttgagcaagccattttatctttctcagtatccttgcttattatagcccccaggccccccccccagtattatcctgtcagctaaatgctactgttgtgagaaacacaggccagaaagcaccataccgtgtgtggtgctacattttcaatgattagctcctggtatggataaaatgtaaatcccagccccaaagggcagacttgccactagcttctctgtcattcccccagagaagccagctaaaatgttataagatgtctaccctccttctttcctgggaaagctgacctgttttcatgttctatctggtttttctcacatttccttttaccaaatatttatcagggaatattggttaaactagcttttgattcagcatgcttgttgttagatgcaaattactgtctactcagcaactgacctgggctgccagggcttgatgtcaggtgagttcacggtaaacagtgaacaaagaatgtcaggatgttggaattacactacagaggaggtcagtggagctctggttgtttaccctcactttcatactacactttagtatttgtttacttagtcttctgttttagatgcactttattgcactttattttaccttcattcattattcatttctcaactgtcccttggggagaaaacaagcaaacaagaaatcttgagaatgaaattattaacccatttttaggataagaaaaggcttctgaagttacttgacagtggccgtgttgctagctaataggcctttatgctattattattgatggattactatgattattgattactaaggcacagaagtcagacttttccatatcattgatattgtcatatgaaaatttcaagtacattttaaaacaaatcaagtttgtcaaggttattatagaatgtaataaaacacacccattttaaggacagagtttagtgagtttattatgacaaagtatccttgcctgtaagtcagtagagtcaaaacagaacatcactaccaaggtaatatgcctgccaccttttgggccagtctcttcaatgctcatctcctgcccactttatcataggcaactcctagggtattatgtttttggcaccgtgtgtcctcttagctggcctactgcctgttttcataaataaggttttcatgagctgcaaccacacccatcttgtctctgtctgctttggaactctagttgcagcttagagtggttagtgaatatagagacttccacataggtggttggcttggccttgataatacctaattgataatacctaataaaatccagttattcacatctaatttaaacagtactacatctttcaacatatattttatttcaactagcattgatttgaaaaaaattattgagggactgggcaatagctccttggtaaagtgcttaatgtggtaagcttgagtaccaggtgtgacactgtgtgtctgtaatctgaaggttgggaggtggaggatctccaaggcttcctagccagctggtctagccagtctgtgagttccaggttcaccaagtgactccacctcaagaataaggtagagagtgactgcccacatccacctgtcctccatatttacttgtgccagcaggagggtctacatataggtgtgcacaccacacagagattcaagctagggaaaaaaagcaagtttcactcagtacattgttactatgtctttagtctcccatgggtttcattcatacacttactcagattcactggcttcagtgcataatgtcttctaaattttgacaaattcgtatattcatctaaccactgcttgaattagaatagtacctttgtcctttcagattcatccaaatccttttgtagttaatttggtttttcactccttgattttcagaacccattattctgttttctgtcttcatgagttttgtttgtttgcttgtttgtttcattgttgttgttgatgatgatccctttaaagatcatttaggactaggaatgtaggtcaattgtgtgcctaggctgtacaaaaacctaggtttgatccctagtaacagataacttggaatatggtggtgaatgcctataatccctgtacttggagtaggatggggtggaggcaagaagatcataaatttgaaatcatttcttcctacatagggagttcaaggccagcctggactatatgagactgtctcaagccatggtgtgtgtgtgtgtgtgtgtgtgtgtgttggggggtgtcataaaagtggaattatatagaatgtaacttctgtagcagtttggcctggaactctgtagctgaggatggctttgagcttctggtcctcctgcctctacctcctgagtgctgggaatacagctgtgtgccactacattgtctttgtgtgatgctgaagattgaactggggctcctatattctaccacctaagttatattactttacttttttaaaattaaagagtgttaaagaccaaacctcagaccagaaaacttagggaaagcactctactgagctgtatgctccaggagctacagttttgttttttgaagcaatggtatccactctagggccttttgcatggtagacaagggtaagggctctgccttgaactatctatatagctctacacaacagctattacacattttacttctggattgacattggattgagtctgtaaatacttaggaggtaactgtcatctttgtaatattgagccataaacatgacacatctgcttatctaggtcttttgtgtattattggtggtgtacttttcagcattcaaatcctgtgtgttttgtaagctttatttatacagcccatggttttcatataggtggtttcgggatccatgagtacagttgctagtctcagtaaacaagatgagtatagtacagtaagacatttttgagagaaaaaaccatgtgttttggttaggtgttttttgtttgtttgcttgtaagagtttcccaagtatgactggttttagctgcatggaagctgcagtatttagaaggccatgcactgtgtagcagaatcagagttcaggaagaggcctggagaggttgttgatgaagattcatccttagctagagtgaaacccccctaaggacagtaacagacaggagtggagctggtctgagcttctgagacaaaatgtgtttctcatggcagaacccaagaagtagagctgcctgagcctctggagcccagatcagggtcttgggcgttagactctgagctggttacactgttggaatttggtattgttaagcatggtaaatgtgccctggttcttccatcttggaataagaaagtatataacttagtttttactctacaggactccacaattgagagagttttgaattgtaagaagactgtggaacttatgtactgttttatatattgtaaaattaatgaaaacttgagatgagctattgagttgtttttgaatctgatatatatcaatctcaactctggttttcagaagtattctttgttctagccggtggctgtgcaaaaggtggtggatgtttgagagacttttttgtaaatctggcattttctattacctatgaatcacttaggaaacctcagaatgacttgagtgttatgtatatctaagcacatgtccttggcctagccattcagtcttgtctaaagtaggtggttttctgaagtgggttgttgctaggcaatgcctgcatggaagtgatttgttacttctgacaaactgaagaagatttaaaaaattctccttaggttccctcaacagaacatctagactctgaatacagagaaactctcctctttgagggacttaggaaaacattgtagccacaagagttgagaaacagtgtaaatgtttatttggtcacatgagtgtaagtgtttatttggtcacatgaagctgtgggcctggctaagatactttctctttttgaggattaaaggaatgcataggtcagtgggtaggaatggccaaaacttgtctaggccttccttccaaaatggttctgcatatatgcttagagcataggtcaatctggagtaatatttcaagggcatttcccagtgttttttaaacaggtcagtaaagagaagaaagaatttgtatgtctctttatgaaaataaactatgacttttatcttggatttttgatatgctctagttttattgtatatgctgtaagtcatatttttttttaccctgatataattatatccaaagtagtcagcttaaaattccaacttgttcttgttataagaaatccttgtggtctgctcttaaaagttttcctggaattcttaaaaacatgctaggctttcatgtttgtgcctggaaagtagcaagaacttgccagtggttcctttccatatgcagtgaccgttgtggatgggagccagtaattaacgttcacacgcttgttcacatcttcaaagtgttttacaaacatttaattagttcatgcttaacttatgtactagaagttggaaaaccagtttttaaggttcattttagcagtgaactttaaaagttttagaagtttttaaggttcattttagaagtgttggggggtaaaaaagaaaaatacaggtggagttagcttcccttgctcccctagcctttggtccaacatgactttgggggtgtataactttgggttgatgcaagggcggagttatatggactgggaaaaagaacattgggtagaatgcttgggaaaagtcatagataattcactcaactttttcctttatgtaggtccatatgtgaagattggcctaattcattcctgtgagcattctgaagagtagattgtgactggggcagactctggatacatgctaatacatgcttatttggggagggatcatctttgctatagtttcctcactactgtttcctactactaacttgcttttgattctcttctcgaccccagtaataggccaggttgtacagtagaaggagacactgttttcaggtgtgctgtgttcctttcacattagctgtgtgacttggcctggccaaagcaaaagcttctgctctttgttactttgttactattctgttactttgttctgtgaaattgcttatttgatttagtttaatggtttggagacaagctttcactttgtagcttgcctggagctcatttatatagcctagtctgccctggaactccatgtagttctcttcagctttaagagtactgaattggtttttaggtgtaagccgccacacccagttgtgaaattgtatttgtcaatgactcaggttttaatagtgaaaaaacaaaaacaaacttaaattgtttttctgtatcagactgactatatcagattgcatttccttggttggcaagtgagacccaggataacacttccctttgattccctggagaatctatgttgttcacctgtcttttgaaggactcagtttcttaggagttctgtgttcatgaggataccaaggtctgctcactttgctaagttatatagtaggtcctcttttaaggtgttcacttgttttcttctaattttgtttatagcacttgattgtatgtttgctcatggcttagaggttctgtttgagggcttggtgctgtgtgttcacatggaatactgttagatgtcagggctctgctttatagtcatgatcatctagaatggatgaatacggtagacttatgacaaacacaagcttacctttattttaggttagaaataaatacaagaactgtagctgccatggtgtaatcatcattgtttatagcctcagctttcagaggaaattgaatctttgtatagataatcttgccagggaaactttagtacctgactgcaggaagaagaaaaattctgagagcttggcatgtatatttaattaaaattttatcatgaatatggatttgttcttcatggtactagataagcgtggccccagggccaggaagatacctcaactgctaaaaatgcatgctgtgcagatttcttttgaggtcagattcctggaacacattttatagctcagtatatagttctaggtatctgtaatcttagtgattgactctccaggcagatgggagagcctcctgtccaccacctctatgccagttgatcaggatagctgatacagttgggatcttacctcaaacaagttgtctgtcagttactactctttacgtttatgttctattttctttgtgtgatatgtgagcacacatgcctatatgtgtgccactctctctctctctctctctctctctctgtgtgtgtgtgtgtgtgtgtgtgtgtgtaggtcagaggataatttgttggagtctgttttctctaccatatgggccccagggattaagatttaatgctaaacacctcaacatgcttgaacaacatggctagccttaattcttaataattatttttattttttatttaatcttctatctgtctgtctaacaagtcattgtctaacaaggtcaagacaacttgagggagtcagctttctttcctaggtatgctgtagcaaactcaggttgtcaggtgtggtggcagtcacttttacccgctgaacctccttgccagcccagattttattattattattttttattttatttgaacattttaaaagattttattttgtgtgcatgagtgttttgcctgcatgcatatatgcactccatgtatgtataaatgccacacagaagaaggcatcagattcactggaactgaagttatggatgattgtaagccaccatataggtgcaggggactgaaccctgggtctctgcaagagcagtgagtactcttaacccttgaaccaatctctccaccaccaaaataacaaagtggagctttgtaaccaggcatgtttagtcctttgttatgagtcagtgactcacagaataggcttaactgacctggaactgactgtgtagcacatgttggccttaaactcagagatttgagcacccctgtctcctaggtgctgtgattaaaacatgcactcttatacttagcggtttttaaaatttacttatttgctaatttattttgagagagagtcttactaaatagcccatcctggcctggaactcactatatagaccaggctggcttcggacttacagagatccacgtgcctctgcctactcattgctgagattaaaggcatgcgccactattgcccaacaattttattaattttcaatagtgagtttaaatagtatctcatattagtacatagtactgtacacactgaaatatcattagaaacatgacatgatctgtttccaggacactcatcagacagctactttgtcaaagtagctgagcgcttagtaccctggtttcctttcaccagagcagttacagaccatgagctacctttgttttaatttttcattaaactaaagctgtgaaaaattaaagctgttcaccttactgatctgagaagtttttgtattctccttatgttagacttttttctcctccagttggctgtttcccttaaatactagtacaagaatgttttggtttatatgaaattatctttggttttatgtcagccgtttttgtttttagttacctcatcacgtaagatttagttatctttttctttggggggattatttttctttatacgatgcattcccacttgatttttgtgaagaaaatctctttatttttatttgcttttttaaaaaggtaaatactttgttgctcataattcatttggcttttaaattcacatcatcatcttaagagctttcacccaaagccctcacaacagctgctaattcgtggcccctgttgtaggcatagtatcctctcttgtgaattctgtgaaataccacggtccctcgccctgaccgtgataaagtacgatttggtgtctttgcccagagtgctttggcactgtgaagcttaacacttgacctgttagctgcttaggacacacattcttaagtggagacattttcttcatgaatccaaataaaaggaatcattcctgctgagatgtctccggaccggaagaagcatggtgtattctgcccctcagcttgatgcctgttggagtggccaggggcagcttgctaaagtagcagctgcatgattttgatttttcattgctatgtggacaactaacatagtgatgtcctaagcttaatgcacgtgctctgcactgtaagaggcagtcagtctctgcttaccatatttgatggataaggagtccgaggctcagagaagctagatagcttgctcagcattgggatgtaactgactctagagcccaaactcttgtatatgtcttagtctaagaggaattgaaaggctgtcttctcttgtgagctatggttttggcagggccttatgtaactttgattttgctagtagacttacttttataggtagttttctactttataaactctgaagataaggcttcatgaaagatactagctttctatcactccagtagtgtgcagtccatctagaaattcaagatttggatataacacagaaagtaacacttagaaacaaatgacattatctataaatgacattgtttagtgtcatttgttgtttctatttccaaacttgaaaattggtagagggtgcttgagcatgtatacctacatatctgtttgcaaaccatgtgtgacgtacatacttggaaccaacagattatagaacatttcgggaacgggagtttatatactgttaactatgtggcataactaacttaatggctacatgatagttctttttgtgtgtgtgtgacatttcattacgcagacttagatttttttccccgttaggtcactgattatcttatttgagtacttacattgtatctctctgtcctctgttggtcccttcttcctttctgctacttaaagactctgctgtggtgaagccttacagacactatctgcaaattcttgtttatgtcttctcacagaaacagaattgctaggacaaaggggttcaaatgtcagcagctgtcaatagatagtgccaagttgtctgtagaaagcggcacacaactttaatcccggcacacacattcactgatagtcatgaatacccatttctcatattttcataacttttagcaagcaagtttgcaattttacttttttgagagtcttgctgtttatgccagactggtcttaaacttaatgatccttttgccttagtctccccagtgctaggcttataggtatgtgccaccatgcccatctctaaatagaaaaattttaatgttttgaatgtcatagaattgccacatattggtaatcactaataaatgaagagaccttatatttttgtctttttaaaaattcacattgttttagttcctctatgatttttagattttatctatatatttctacatatatttttaaaactggaaaagcaaaatacacatagcccgagaatggggctgggaaggtcctgggactagatgtgtttatgagtcttgcagaggacctggttttggttcctcagcacacatatgatggcttacaaccatctttaactccagttctaggagaccagtggcctccacaggtactaggcatgcacatggtacacatatatttgtccagccaaagcattcatactcacaaatcttaaacttttaatgacattttttattcattttgaatgtgtttgtgagcacattctgcctgcctctgcctgaatgctgggattaaagttgtgtgccaccgtgcctggcttcctttgcctctgtaagtgtagggaccatgactgaaatcactgtggtatcatgtatttttgtgactgtgagtatgtcttgtgctttttcacctcctctgtggccttgggctggatcctcaattttgagctccagcttccttggtgtaaagtgggaaaaacaacacccactccactccacacacagtgctggctgctgggcacacagtatgtgcttagtaagcatctcacccgcagtttgggggaagatttagtgtagataatggagtagtggattggaaggtataaaagatggcactgtggcagtgtagaccattgcagttcccatttctattaaacgattttgtacccacatttttatttttttggcgggggagggagacaggaagtatctaataacttgtttccaactttgcttcttaattttgtaaatgtcattagattgcatattattttccaagatcagatagatgctttgtaggaaaaataagctagaatggagctaattaagtttcttatgtaaatttaagtgcaagttacataaccgtattgtagaacatgtctgaacagaatgtgccagaccactagaaatgttttgcatataccaatagagatagaaagttatggtgtaacagtggtctgggcctggctttgtgggtctgaattctagggcacactggtaatggatgagggactgtactggatctgcagcatggctagaattttgttaggcatgagttggcaagagcaggaaaggtcatgaagctatgcagtgtgaacaaagaacaaacattgggaaacttcgtgtgctccaagcgagcagcgaggtgtatttgagttatttagtttgattaggacacagaattaggccaacaagtcaagctggggtgagtgtaagcatcttacatgttgtgttagagaatttagttgttccttctgaacaaaagggaaggcagctcacttggggaggatcatgcgtagtcacagctgtcgaaaatgaagcacttgcctctgagggacattcagagcccattgtattagtttaggacagggattaggagagccagaatgcagggactgcagggacggtgaaagagaatcagatctcctgggtattcagagtgaaagggaggaaacctgctgaggagaccaagggaagtgaaatagcatcgttgtccacagtgattgtgagtttctaacatcagttttggtgaactggagtatactggctggtattttacaaaagtacagctagtattttacaaagttggaagaaatttagttgtggcaaaacacatacagcataaaacctactatttaaactatttttttcctttttaaaaaaagacctttaaagttatttatgaatatgtgtctgtgtgtgtaagtgatgggtagatacctgtggaggctagaagaggacataagtgacactgaagtcagaattaaggtgacggagctgcctgatgtgggtgctggggactgaactgtggtaccaaggaataacagtaagactatctctccagctccgtctttatcatttttaagcgtggaatttagtagcattagttattttcatgttgttgtatacctattaccaccgcctataagttttcatcctgcaggatccaaactaccctttaaactataaatgcctgtttttatcccccagccactggcaaatagcaattcttttttctgtctctatgaattttgctactccagcttgtagggtttgtcttcttgtagctggcttaattcccttgtgtgatgtctttaagattcatttatgttgttcgcgtgtgttagaatttacttcttttctaaggcagaattgcattcattgtgttgtatatacactacgttgcttctctctattggccgttgtaagcaagctgtatgagcacaggggtgcaaaatctctttaagcctttgctttcaactctatggtgaatatgcctacaatacttgagttacatactcggggaaaaataatgccagttaacactaatgcctcttgtgtgcatgtgtgagtatgtgtacctgtggcattcagaagagggcatcggatcctgtgagcctgaaattatttatggtcagttttgaaccactggttatatgggtgtgtggatgctgagaacttcagtaagaacaatttgtacttataacagctgagccatctccactaacatccctggtaaaagagtagacattaatttgttaaatctcaactttaaagcacgtatttagaaacgtgaccaaggagttatgcttaaaagtctctgaaaatattttggttgtgttgtggaaaaactgttgtatggttttctttctagacaaccatgcttcttttctgtttcctactctttaatgcacatccattttgacttgaaaggcaaactgataggctgttatttgttatttagaaggtagttatttggcacacactctcccaggctcttctccctctgaattttacttcattgttggcagaattggggattgctctccaagtctcatgcatgctagatagtgggagtggaagagaagctatcttagcctttgaaaggcaggaacaggtaaaattcttttttaaactttatttttttagtgtggcttaattcaacctttgttcctagattttttttctataattcacactgtgacctgaagccatagtcagcactgctgtggccgttgcgtaattggtacttgcatttgtattatgtaaataagctttgactagagcaaatttaaactgttgtaaacattgtctattcattcctacaactgtattttgtggtagaattgaattactaattctgtgaaggtgtttttttaaaataagggacaaaaatggaagcgcttaggagtagttgcccagtaaagtcattgaaaggaatatgattgctgtgttcatttttaatttttcttctctaaagctggcaatagcttttttcttacggcactgccttcagaattgtctctgtgcacatagaaatgaattgaggaagtagagatgatgatgtattgaatgacagtggagaaaagtcctgttactataaatggacagaacagatccttctgtctgttcatccgtccgtacatcctttcttccttcccctccctcccccttccttctctccctctgtccctccctcccttctttttatataacctagagttagggagccagttggcagactgcatattttattaactgttatgtagaaattgtcttgatgtgaatacatttctaagatgaatagttaatttgttcttgttgcttttacaaagtctctttgaacaaatgatatggatgattccctaattctgaagaaaaaactgatggcatatgcccaaggcgttttgttctcttagccttgccaccatatgtggctaaaatggtctactggaggagaattgggctttctgtcttcaacagttgatcagggcttttatgggggctggcaggatggagttgatggtgttagagcccaaaaccacttaggcatgcacttctaccactgaacccccactgtaccctccttttaattaaagtagggtcttttgtatcttatgctggctttcaactcactgtgtaatagagggtaagccttgaacttttgctcctctgagggctggcgttaaagccatgctcctccacactggtgtgtgtggttggtcttaggtatttggaattgaacccaggtcttgtacatgccagccaagcttagttacccagccctggtcttgaactctttatcctcctcctctgtgtcttcattgctgttgacaatagatacataccaccatgggtttccaactgtatttgctgccttataatgtggaaggaagacttaagtgtactccagaattacactgattttgtgagctagtttggttgtattttctagagttaatttttttttaattgaactctcagattgggttggtaaatcaattctagaaatggacgatcttttctttagtctgaggaattatggagagaaatgttcttttctcctgtgagtatgttgttcattagcttttagacaggaggtttacgacagatttaatgaactcacaaccctgtagttctgcatgggtagttgttttctggaacttcagggatcaagcagatttagaattaaacttactttgtgtgataaatgtcaatgggaagatttgaatagtgacatgtggatgtaggtcagtagctgtaacttctttgaggatttggagagaaggaagagaggaccattctgggttgtgtgtgtgtgtgtgtgtgtgtgtgtgtgtgtgtgtgtgtttaagactcacagtgtggcaagcctggaacttactacctcccaagtgtgcacctccatatccagcctgaaaagggtcattctaaagccttgagcattaacaataatgtggggttgtcttacaagctcagatttcaccctgtgtagttgcgtaagtggacacttaggagttagtctgggactggaaagatggctcagtagttaagagtgttaactgttctagtagagggccagaccctacatggtggcttataaccatctgtaatcccagttctgccatcagacagcttctgcagacaccaggcatgctggagggtacacacacaagcaggcaaaacatccatacatgtgaaataagtatgtaaaaaaaaatcctaaatatacatatacaaaagaattagcttaagcaattttttcattgtataatctatagttaacactatgtgctaggatttaaggaaggaattaaaaaatatatatccagatacagtgattaatgttttcattcattctgcttatttagtgtttcttccctggagctaagctgctttggaaggctctccccagcccccattcattaatgtaaaatcacaccttaaacctttctccagtaatagccttggacttgattggtaactgtagtagttttggagtctcctgtggttaatgagtatgtaataggtacttaagtttttccatgactgactaggttttagtgggaaaaggaagttaatttgctgttaactttctgaatgtgtaaggtattgaatcacatctgtgatgattataggaagtttgatgtatgtgtgagagccagggtttcagggtcattctctggaaagtgacccactggatagcagtatgctcattctactagaccctaagcaaggtgtcctcatgctttattccacttcctcccttcccatgaaacagtcctttttttttttttttttttttgcattacacatacattctcctttaaaattatactgtatcttaaatggtgcctgcagaatctatctgataccttgggattggagttctagatggttgtaagctgtgctgtggtgctgggaataaaaccaggttctctgtaagcactctgaactgctgaggcatctttctagctcctactctcatcattaaatgtccatttacacaaatacagagtcaaagtgttctctacataaaagggtaatgtacaaataatgtgtcttcaagatttcgttttttccccatgtacagtacagcataatttaaaccagctgcatttgaagtgctcagcatcctcatgagtccagaggccgtttcatgggatcgtctggtcctattgctgatgcagtgaccacaactccattttgcttttttttaaaagtttaagttaggagccagtacttcagcatctgcctaagtgttcatcttttctttccctttctctctttctcctctcctctcctctcctctcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagagtggtaacaatgatactctgatcaggagtgtaagatagctgattacatccaacacctcatctttagttgtcatcatgtgccaggcattgttcatatgtttaaactaagatatggacctggttctagtcaaggtcttcacccataagagttaattataataaatcacatagtaatttttaaaagtctgaatagaattgagaagacaattttggaaggaatgagaagagacaaagtatacttttttttttttttaaattatgaagactatttgctttaggtcttagtcctgtagtgtcataggataagtgaaattttcaaatgtatggctgggctgggagatcttccagcagttaagagtacttaactgctcttccagaggacctgaatttggttcttagcacctaaatcctgcagttcattattgcctggaacgccaaccccaagggaagtcaataccctcttctggacttcctggggaccacactcatgtgcacatccgccattgaatatataattaaaaggtaaactcttttaaaaatagatggtgaattgtgtggtgccgacaggctagatctgtgacagccccagtgttgtctcataatgtccttgtgacattctataacttgttgtcattctgccaagtgatattcatgacagagacccgttggtcactttgatgaactacatttacatttctggccaagccttttctttttcttccttttccttttgatttttcagtttttgagataacagtctcactatgtagctctggcggctacaactctcactaactggaactcaataactgcccacctctgtctccagaagtatgagattaaaggcatggcccccgttctgagctagaccaagcacgtcagtctgggatctgtcctgacaccagcattctaacccttgcggcccccaacctcactcctcctccaaaacaagctattgccacttcactttcatggtaagtccagtctgtgaatatgaaatgatacgtgatacggtgaaatatgatatgatgaatggctccctcagctgaggaacggatgctgagaatgatgctatactcacctcttaatcctgtgtagaccattgctaagttacttggaacaatgagtcatccctatcttgagatagaaaagataatataagctggtatttaaaattcttccctagttgatgggctcgatgggtccgctcataaccccagcactagagtaaggaaagctgatgattctgaggtcctgaccagcctggccgacatgttccctgtctcaaaaatccaaaccaaatggaaaaacactcaaacggcttacctttactgagatctccctttaccctagaaaacaatgccagaggttttcataaagtcacaaatgtaggtacttgtaagtacgagaaatacattttgaagggagtcaagagctagctactttatgggggcgaaattatctaaataacaaactacagaaatggatgctgaaataggaaaacatggggtttcttttttggttttcttctgatgtgggatattaactttcttattaaaaaattaaaggactattaaaaattagaataatgctttaaaggagttatggctcatttctaatttcataatttgtgagatctgattggtgtgggaccatgggagttgtttccagagaataggattgtactaagggtatagatggaataataacttaattcaggcagttttttatgttttatgttttaaatttgaagaaaaggtgtctgggcacacttttaatcccagtacttgggaggcgtgctctacatagtaagttctaggacagccagggctttactaaccccctttaaaagatgtctgctctagggaaaatgactattttgtgaactatgcaagtgataaatagtccaaaggtacatggaatttgaataaattaaggagaatataattttacattgcattttaggtcttgtggtatactagtgatgtttgtttgtttgtttgtttgtttgagacaaaaactctattatgtaactctggctgtcctgggactcacaatatagacgagcctggccttgaactcacagagatccacctgcctctgcctcccaagtgctgtggccaaaggcatatgtatgccaccacacctggctaaactagtgattcttagagctaaatctaaaaatagacgcacttgtctgtgcatgtgatgctgtggaacagctggggtaagtctcagctctcttagccccccctagtgcaacaggttttcctttccattatccagttgatggggatgtgttcactcttgaggagcttatgaaagtagcttagattatcatagaaactggaatgaatgacagaatagttgatgatttctgatgtcaaaataaaaataattgagttgggaaagtgaaagatgttacaaatgctttgatggaggtctgctagtgtgctcatgcatgtcttatgtaatttttttgttctttgctctcttctccccattgttgttttaatgctcatctagatgtctgtaaagtaatgaagaggtaaacactcttgtacgattttgagttttaggtcccaaaaggatggcaaagagtgcttttacttcataggcctattcctatttttcagttttttttaaagtcattttgtctgcttatccatccatccatccatccatccatccatccatccatccatccatctattggacttatcctgtgtgtatttgtgtggggggtgtacatgtggagcctagagacaacctgtgagagttggccttcttccaccacgtggaacctgagattgagctgaagtggtagacctggtggcaagcactccatcagaccctctgagtaaaagttcattttccagtttgtatgtattgttaaacatctggtatagcaatgacacctttcctctgctccatgagggaggtctctgccttcctcccatatttccatattcctaaagcactgaactaattggtcctctaacatagggcttcttaagcttttcccacttgtaacccctttttaccagagacgtttacatgatcttgagtatatatagatatataaaataggcatacagattaaacactttcaggaaatacatcataaagaaattaatttttaaataaaatttattttatcacttcttagaaatggaacaaacaaacagtatacaataaaatcatggctgaatatttgataatgcaggacttggcatcttcagtatttttaaaattaattgttggtttgattttataatcagtgctgagaatactactctgcataaatataatgcaaaatggcagaggtatatatagtctctgttcttcaatattaagcagttatgcttcatttaaaacatttgttgtttgcatagtttgtttgtgtgtgagagagtgtatgattgagtgtgtgtgtgtgtgtgtgtgtgtgtgtgtgtgtgtgtgctttgcatgtcatggagagcatgtggagggcagagtacaacttcatgctctgtctctccttccatcttggtgtgtgttccagtgactgaactcaagtccctgtgctttcccggcagcagcctttacctgctgaggcagctctggctgtttatgtctctttatgaacagaaagtattgtatgaaaacacaaaggatcataacagataataatctctaatctgagctgaggtctcaggcagccattggttgatgttaggtagtgtgacagcaacactgtgtgcacacacactgtgtgcttataatgaagtgcagcgcagtgcacgcactgtgtgctcataatgaagtgcagcaaagtgagcacacacttcataatgaaggccgcagtgaggaatgatgcaacatggataagtgttcgcagaaacgcctcagcttcattatgcatttgagtttttaaattaaagttgttgttgcatgttcagaagctttagactcctgccaaattattattattctttttcaaaatccttcctcctcaatttagtttcatgatcccatgtggagcctaacccacagttttaagaagctgggcctggggggcctggagagttggcttattgcttaagagcagcgggagctcttgcaaaggactcaggttcgtttcccagcatctgcttgtcagctcacagccacctgttaactcgagttccagggactctgttgccaccttctgacctccatggatgctgcatgcatatacataaacatgtatccacataaacaatttttaaaaaggaaaaggccttaaagtaagaagggcttaatgatcctcattccttctctgtataaatcaaggtaaggcttttgagagaactggtatcagatggtagaggatggtaagttttcttgtaggcgatatataaaattctgtatatatcacaaaagatatttaaaataagattggctaaaaactgatcatcaggttgaaaaatagttatacaaataaaaaaaatgaaaatgagacatatctgcaaagtaatgacttgttccatgttatttgaaggtctttgaaaaagaggctctgaagatatttggaaggatgactgcctttggggagtaagcgttcactcacttaaaaggaccttgaacaagctaaatgtttcattacaaaatttccaatcttgactgttgtcttagtttgcttttccgttgctgtgataaataaaactgaccagaaagcactctgggaggaaagactttatttcatcttccatctttcagtctgttgtcaagtgaagccagggcagaactgaagcatggctgtggaggagcgctgctggactggtttgtcttccttgacttgctcagcttacttgcttatacagcccaggactacgcacccaagggcggctctgcccacaatggactagaccttcccaggtcaatcattaataaaacgtccacaaagggcccatagtccaatctaatgggggcagtttcttagttgtactctcttcccaggtgaatctagcttgtgtcaaattgacagaaactaaccagaatagctcttaagtgctttacaactctgtatgttatcaacatgtctaaaaaggttttgtgtcattttaatcaccactaacaggcttttcttttaattggtgtaaatgtgaagtgttaccgtagcatgcatgagtccttgaattattagccagtaggcagtggaagggcagaaatagtgcttgttctgggggtaggtagatgacagcaacttagtcatttcctataaatgtatgattgggcctttctatcaaagatcatttaaaagaaaatgggcaaaaatctaagtgtatgtgcagaatctcttaaatagtgaagttagcatagcttatggatagttttatggattctttgggcgtagaggagtatgctttcttcatagcaaaaacctgggataatttatgaagaggctcaccattttggaaagtatagcccatgatggattggccctggggtgttggatcattataaaccaaatgtgcttacattgctggaaggaaaagagcagaggaagagactgagtcttaatctctttccgaggcaagcccctgtggtgtgaggaccttagtgtaggttctacttcctcccaatagtgccaccaacccctttgacatataggcctttgggagacagtgcacacacggacttactggcccggttgtacctgttttagatgcattttcacatttgatcttagacaaaaagaagtggggatatcagaaatgcggaagaaactcttagtagttctcagtgccactccgagaaacttggtggaagatggtgtgtgatggttatttagaaacacagcttatatttcttcccccccccccccccacagggtttctctgtatagccctggctgtcctggaactcacgttgtagaccaggctggcctcgaactcagaaatccacctgcctctgcctcccgataaaggtgtgcatcaccacgcccggctatttcattctttataatcctaagtatagagaggcaatagccaccaagtgatgtttaaatcatgctgcactgtgactgatgtttcagattggatcttctctctctctcataaacatctctgaattttattcctttttgaaagtgtgagaatatttctagaggggtttaagtaaggcagggtttgagtagggaagacccagtctaaatgtgctgttatcccatcagcttgggtcttggtctgaagaaaaggaggggacactgctgttttctcccagttcaggatagtcaacacagatgaccagctgcctgttgcccctgtcccatgccttccttgaataatgacctgcacccttggacttgaactaattaccccctcccaactttttgtttgctttgaagatggtctcattgtgtggcccagctggcttgcaactgagagatctgccttcctttgcctccagaatgttagtattaaagatgtggactaccattggccctttcccctcttaactgcttgttgacaggagacttgattgcagcagtgaggaaactaacaaatccatctgaacactgattttggcgtgtaggaattagactctttactttcctttgtcttcagtgctctgctttcattagcatatggacaatagttactggaactgtggagttttcagaagcttacagtattctgtctcaactgaaaatttggtagagaaccaggggttatggtgcacatctttgatcccagtgttcctataggcagaggcaggcagatctgagttggaggctgtcttagggctttactgctgtgaacaaatactgtgaccaaggcaactcttaaaaggacaacatttaattagggctagcttacaggttcagaggttcagtccattatcatcaaggtgggaaacatggcagcatccaggaaggcatggttcaggaggagctgagagttctacatcttcatctgaaagctgctagcagaatattggcttccaggcagctaggatgagggtattaaaacccacacccacagttgacacacctattccagcagaccacacctccaaatagtgccactccctgggccaagaatatataaaccatcacagaggccactctaagtctacctagagtcccaggttagtcagggttgcaaagtgagaccccaaaagaaacctcacccctacccacccaccccacaaaaccttgacaagagtggtttaatgacaggggtgtgagtaacatgcaaacatacttaatcctttatataaggtctgtagcagaggaagggaggatcttgagtgtgaggcagtctgagtgagcaatatattgagaacgtatcaaaactgaaacaaaaacaaaaaataaaacaaacctgggtggaaccattggcgttgtctggtcacatctgttaatttcctgatgaaggaacctgtgggtcaaagagttaagattggtaagagtaagtgcagtatagtcagacatgcaacttgatgtcccaggagggtgtggtcccgaaggggagcttccccttctctgaggatttgtgagggtagggctgtgaagaaaggaggggaggtggtggtggtggctgtgttcaggatgtaaagtgaataaataaataattttaaaaaaccctcagtagaagcaattgtgaatagctatatttgggcccagataaccagttatgcaagtataaagaaaagtataggttttaagtaaggtacaagttgactgaccatagtcttgttttaattgagagtatcatggctgacacagttgttgaattaatcttgaattatagtaaaaaaaagtatcatgtataaaaaaccagacacttgtggttaattagaagagcacactagaagctttggtgtattcatgtggatctattttcaggggactattgacagaatatagcttactttctcatttccactcctaaggaactacaccctggtccactcattgcaattgttgatcataactatcaacaatcttaaatctggagttttgtttgttttccttaatgtgcattttttcccgtcttatcaaactaagatggcaattgtttccaccctttactttgctacaggctcagtgaagtcatgggctctcatatctaaagctgggaatgctgaaaggtgcttgtcacagtgtctggaagtcagccttctgaacttctataaaaaggttagggtgtctgccacattctgtttaaagagtttaagtgatggtactacctgcgctaataagaacataaaaaccaatggctattaatcactgttaggtttgctgtgatcttggatgtccgaagtagtagttgtggaaatgtgtaaggggtgatacacctgctagaaaaacaaaaataaacaatctcctccactaccatcactaccaatccatggtctcttgaagcagtcaaaaatggggttagaagaacctgccttgtcctctgcaccagcagctgtctgtcttcagctccattcgaggaaagggactgttcttcactgaacatgtattgcccttaccttatgaccgtgttcttaccccactcagcgctgaatcactgacctgtgagtgaacagtctcataattgaggggtggcagtttaaatttaagagcccggtagcacttggaaggcagaggcaggtggatttctgagttcgaggccagcctggtctacaaagtgagttccaggacagccagggctacacagagaaaccctgtctcgaaacccactcacccaccccaaaaattcaagagcttaaaccaatgattttgtagaacatttaacttatgactgtagaagacatttctcttgcttacaatcaccaaagccaaaataacaaaagaagaaaagaaaaaaaaaacccaactatcatttctgcctaattgcttacctctcttaagcccccgtttcccctctatcccaacaggatctgttaatagacccaccttcctttttctctggagtgctaggattgaaacatttgccaccacactctgcttaggtttcttttttgtttcgttttttttttccctcaaaacataaaacacctcaaaaatttcctcaaaatattttgagactttttattttacatgtatggttattttgccttgatgtatgtctgtgtaccatgtgcatacagtgtgctcttgcagggcagaaggtgtcagagctccttggaactggagttagagatgattgctagccactatgtaggtattgggaatggaaccccaagtcctctggaagagcagccactgttcttaactgctgagccaactctctccagccctagaatttcgttttcttaatttccttgagttctttttttctagtcatttctccagattaaacagcctatccaggaactattttctgggatagagaagcctgactccttccatgcagcatagtagataattttccaagtgatttatttttcccaatatacaatcttgcttctgtctgaaaatgataaaattacatgtgtgataaagttattagaaaataaaaaatgtgattattactagtaaatatttgatttgcatatcaagtttatatacctatatgcctgggaccatgtaccaatgtctcaggtggtctttgagtaagagtgaggaaggtttaagaagccatattctcaatctgtagattataaccctcacaggggtaacatatgagatatcctgcatatctctacattatgattcatatcagtagcaaaattacagttatgaagtagcaataaaataattttatggttggggggggggtcacaacaatatgaactatcaagtggtgaccccccaaccataaaattattttgttaaaagttgaatcattaggaaggttgagaaccactgttctggaccaacactaaatggttaacatttttataagatgaattcactttatgtgttcaacatttgccataaagatattctttgctaacatgatttggtgctagcttcctacataaatactaattttcctttggctctcagaaacttggtctctagttggggagctgaagtatacacagaattgagagagtgagaagtgcctcaaggcccgagagctgtacagtgaaccaaccatccagtactaaaacaagctactgtctgttctgagaatgcaaatctgcatagatattatcaggaggctctggttcccatcctggctttgggtcttaatatcctggggaggttttaactcagtcggctttgggtgggacaggaagctagtttctaatctgcactgtggcttataacatcaaagagaatcttgtattttcttacttccaagaaacaagtttgctctttagttctacatattctgtttcatttagatagcctttatttaagcaaaagttgtacatattcatagggatgagagagagagagagagagagagagagagagagagagagagaaaattgcaatacatgtatacaatgtacaacattcaaatcagagtaaacatttctcacatagtacctttgtggtgaagctatttaaattttttcatcttaactttttgaaacctaacagtacacagtcgtgatctatagccacttgctatgcaagagaacccagaactactcttttttttgtttgtttggttttttggtttttttttccattttttattaggtatttagctcatttacatttccaatgctaaccaaaaagtcccccatacccacccacccccactcccctacccacccactccccctttttggccctggcgttcccctgtactggggcatataaagtttgcgtgtccaatgggcctctctttccagtgatggccgactaggccatcttttgatacatatgcagctagagtcaagagctccggggtactggttagttcataatgttgttccacctatagggttgcagatccctttagctccttgggtactttctctagctcctccattgggagccctgtgatccatccactagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtctttgtaactccttccatgggtgttttgttcccaattctaaggaggggcatagtgtccacacttcagtcttcattcttcttgagtttcatgtgtttagcaaattgtatcttatatcttgggtatcctaggtttggggctaatatccacttatcagtgagtacatattgtgtgagttcctttgtgaatgtgttacctcactcaggatgatgccctccaggtccatccatttgcctaggaatttcataaattcattctttttaatagctgagtagtactccattgtgtagatgtaccacattttctgtatccattcctctgttgagggacatctgggttctttccagcttctggctattataaataaggctgctatgaacatagtggagcatgtgtccttcttaccagttggggcatcttctggatatatgcccaggaggggtattgctggatcctccggtagtactatgtccaattttctgaggaaccgccagactgatttccagagtggttgtacaagcctgcaatcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggttcttctctgccattcggtattcctcaggtgagaattctttgttcagttctgagccccattttttaatgaggttatttgattttctgaagtccaccttcttgagttctttatatatgttggatattagtcccctatctggtttaggataggtaaagatcctttcccaatctgttggtggtctttttgtcttattgacggtgtctttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctcccagaactactcttagctaactgtaattgatcatctttcatcttttccccctttccccagcttctggttactggtcctctgctctcagcttctctgagagtaccagattgcaaacgtggtttagagagctttcgtgttgtttgtctccctgccccgctttgctctaaaatggaagttattgnnnnnnnnnnnnnnnnnnnntggtggtggtggtggtggtggtggtggtgtctcttctcattctccttcatagatctgttaatgtaacctgtgattaaattggcagactttccagtatagaagccaggtccgtcttcactgcagttaattgtagaagctagtgaaacaggcttcacttataattgcatgattcggactaaatttttgcatttaatagtaaggtctcatcatattccataaagtctcattaacttgaaacctgtaatgtaaatttgtcgtttatatttggaagcatgctgacataaagtttattaaatgtgtaataaagtttccattgtttgtttcaatgtgctaattacatgttttaacagttatagcaggacagacttcactttgggcattgttttactggctcctagtttcaagttactaccttcattaaactagtaaatgtttacattgaaaagcttgttgctaaatgggttttctcaagcaaccagagattagttgaagttgtaaactgtaattgctgtggtgaaatgtgctgatattttctgttgaattatagcaagaagatctttttcatgggagaggattgagagtgaagagagccactgaggagtggctgtgcgtggttttatttcttaaaaggggtttgctggctgccttaaagtgtcgtcattctgcccttgtgtttgaagtgatcctgtgctgtgtgtctttgtggcctatctgctttggctccagtgttaacagaccagttactacttcaccctcatctttaccttaattgtcatgtagaacaacctgagtttggtcacctactgtattaccaggcaccatgttttaatggcttcatatctactaggttaacatctgtaatacctgcactagaaatactgtttcagaggtaaagaagtaggtgctttgagggatcacatatgtgctctagctcatagagctatcagagttaaggttcaaattatgtctgcctttagaacccatgctcttaattttgctgtaccatgaccatggagagcctcccccaatttcctctttatcaagtttataagctcattctctttaagtggggtcttctgctgcagaggatagccttccttcctcccttcctgccttcctcccttcctcccttcctcccttcctcccttcctcccttcctcccttcctcccttcctcccttcctcccttcctcccttcctcccttcctcccttcctcccttcctcccttcttcccttcctcccttcctcccttcctcccttcctccctttctcccttcctcccttcctcccttcttcccttcctcctctcttcctcctcattcgaactcccaggctcccttcttcactctccttcccaccctccagttctgctgttatgatttgttttgttttgtttatttaacattatgtattcctggctgccctggaacttgctatgtagaccaagctgcccttgaactcacagagattcgcctgcctgtttctgcctctgtctcccaagtgctggtattaaaggtgggtaccaccatgaccctccagcccttggattgtgattcttgagaacatattactatgaacatttgtcagacactcacactgatggtatagagagactcatgctcaatccaaggcagttaatttaacattgttcatgatttgtataagtgaaagaacctggtgtacctagatttaaaaaaatatgggctggtgagatggctcagcagataagagcactgactgctcttctgaaggtcctgagttcaaatcccagcaaccacatggtggctcacaaccatccctaatgagatctcatgccctcttctggcgtgtatgaagacagctacagtgtacttaggtataataataaataaatttttggacaagagtgagcaggaattgagtggagttgacaggagtgagtagggtggccagagtgagcagaggtcctaaattcaattcccaataaccacatgaaggctcacagtcagctattcagctacagtatactcatatacataaaaataaataaataaataaataaataaataaataaaatatccatttggtcatatgagtacaatgattagcaatttaagctgagagttgttctcttcatgtctgccagcaccataagtccaaggcaaattccctaacctctgtaaatgtttcctcatctttaaacatagatagcactggtactgtcttcaaagaagatgaaattaggtttcatgaagtacttaggagaatgttcttaacattgtaagctttaaatgttgtcttaaagcccctggtaaatcatgaattggagcctagcctggacaacatggaagactcccacccctttaaaaacaaacaaactcaagctaaactcaagctaaaaccaaaaagaaaatctcacacaaaacaaaagttgtcaaatattgccttattttcatgagctaatagaacaactatgatactgctaagttcagaacttacatgaaagtgttgaagcaggacaggtacagtctttagctaactacttcaggatgcaaataaaacatctaaattctgagttagttactatatacaattttaagtgggctatgtttgaaatactctgcttgtagtgagaaagacaagcaaattgataaaattgtgttagctggccaagctgtatctgggaaggtaggactgtgtgtgctttgtttgtttgcaaggactccaaggaagagaagctgtttccttatgagacagaggaaaattggcatgggttgtatgaaaaaaatggatgaatttctttggaagtttaggtttaggagagaggttatttcccacactggattttatttttaatttgtggttctcacgattgtacccaagccttatgtgtgttagatagtaagcactctgactaccgctagactgaattcttgagatggattttgggttttgtttgtttctggtttggggtttttttgtgggggagggcattattgagtattacataccagattagttctcatttcttactttcatgagaatatgcactttagcccaagtacaatagaaaacagccttctctttcagttaccaaaactcacgccaaacctcattcctaacagcctaagtttatggataattttagctgcaaaaaccctgcccactttttatcttttataaaaatgtatttttcattcactgaggggaaaaatgtaaggcattacctgattattctggactatctttcctcttatttgcagaaccctttgaggtctgttcataccttcaccagtcttgagcatagctgaagtgtgtgtgtgtgtgtgtgtgtgtgtgcgcgcgtgtgtgtgtgtgtgtgtgtgtgtgcgtgtgcgtgtgcgcgtgcgcgtgcgtgtgtgtgtgtgtgtgtgtgtgtgtgtgtgcgtgtgtgtgtgcacgctcatgcgtttgtagaactggtccctttaccaactgcagttccagactgaaatacacagtgttcgcttcagttcagagatcagtggaaactccccttccctgttaaaggaagacttgtattttattattgatgtggcagggtgaagggagcgcagataagggctggttgtgtacgttccatgtgcgtgtggacatgatctgcacgttagccaaagaacaacttttgggagttggttggttcttgggattgaactcaggttgtcaggctgtgtgacaagagttctgctgagctggactctcaatttactttcttatctggaaaaaaacccccaaaatcaaaacaaaataaaaaagcacatagatttaaagctcattacagctctaggttttcactcactgtgcagaattggcatttattaggctgacacaagatgagaaacagttcataaccttatagtgttaccagatagacaggactatatagaggagcttttgtctaaaaaaaaaattcaaaacccaaccaaataagcaaaaagccaagaaaccaacacacacacactcttcccaatctaagtatagcctgtggttaaatcttacagagataacataattattttctcctacatagttgagaaaatcaggtggtatgtgcataattggctttcatttaatactgcttcccatgttacatagtttcttttgagtattttaagagttgtgtgttcctgttggagtgatcagttcagatagtttttattagacaataaagcccctccccttccacaaggaaactatcgattcaaataatatttttctacagtaaagtaaaattactggtttatgtgtttgaatacttgcctttctttggtgggtggtgacacagggccttatgtagcccaggctggccttaaatagactatgaggctgagcataaccttgaacttttgatcctcctgcctggtcctcctaagggttgagatcccaggtgtatgccaccacacccagttttggacatggtagagtccaggacttctgcatactgacgggtgttctaccaactgagctacttccccagttcatgagtttaagtgcttccaaatgtcttaatatattatttcattaagttttacccatagttgtgattactttatgtttccttttttttttccagaatagataagttcttgctttgctatatctttatcaacagtggaaactttgctttcttaccctctcttagtttgtagatgaaaaaagatatgatctcaagtgcaatgagattatgcatcatttagaaatgttactaatatcttgtcagtctgtgggctccctaacctttgtttttggctttaatccaattcttagaacctcctgattatctcttcatattgcttggtaaacttcctaaactcgggtgtgttacactaacatggcttcattaagaagaggttatcaactggatggtagtgcacccctttaatcccagcacatgggaggtagaggcaggaggatctctgtgatttcgagaccaacctagtctacatagtgagttctagaacagccagggctatacagagaaatcctgtctctggggtaggggtgggggtactaagaggtgtatgtatgtgtgttttctgttcttgtccttaatgtatttaataattacagtacctgaaccagtttgcatccagaggaaccagtctccttcctttgacactagtaggttcccagctgtgatggttagtgtttaatggccagtctggcaaaatctagaatcttctgggagaagggcctttggtcatgcctaatggggattatcttgattatactggtatgagcttaacagtaggccctatcattccctagactggaccctgggttctataaagaacaaagtgtgctaagtattagcttgcctgcattcattcccccctgttttgtgactgatatgtgaccagttacttttgagttcctgctgacttgacttccccacccatcatggaatcttgccacaaggaacctaatcttgatactgaagagctgatatgaaaatcatgtcagtcctgacctgtcctatccttccccacaccccctaacttcctcccacttttgagtcttgatcttactatactgcccaggttggtctcttgaactcagaggtgtaggctattctgtactgcgtctgtccaggaagatcctgtgtgtatgtttgtattaccacacctagctctgatgaagaacctcagagttaaagagctttcttttcatcagtagcattctatttatgcttctgtggtctatttagtggtctagtggtctattttgctttcacaggcgaatcaccttgtgactttgcccccttccccattcctcccttttgagaccagggccttactatgtagctctagctggcctggaatttgtaattctgttttagcaccagaatgttaggactatatttaggacagtttttacttgagatcagtcaggtgccacaaagggagtgaagagagtctaaacagtttaaaaagctgtcagcagggtagtacaattatcaggtggctgaaagttcaggtcatcgtttaaaaacacttccagaggacctgggtttgatccccagcatcagtgtggcagttcacagctgtgcataacttcagttataggggacccgatgctctcttcaggcctccacaggcataagtcacacacatggtgcacagaaacatatacaggctaaacacccacgcacagaaaaacaaacaaacacataaaaattatgaggtaatggatttcactaatggaactgctatatcaagtaagtaccagcagtttgataaagccaacaaatatatacttaacccaagggcagcattttggtgccatttggacatttcagatttttgtttaatttttttaaaagtgtagcagtaaaattgatgaattaaatttgtcaacgtggttatatattttatattttcactatgagttacatgagcattctgttttcccatgttttttacctgtttcattgtagtcatgtttgttggtgtgaattggtaatgactaatgatattaaacattttttttctgtgctcatttgtcattttttcctctagtaaagtgtcttcacattttgcttattaaattttatatttgtttgagtttaattttatatatatatatatatatatatatatagcttagggacatagctccttggaaaaagatggtttgctgtcaagcctgacgacttgaattcaagacctatatgatggaaaatgagaaccaactatcccaaattatcctgtgacttccatacaagggccatgccataattatgcctacatatatacaaaatgagtttttaaaatataatatgtaattcttactgtattgtggacatgtattttgtatgatttgaaatattttctcttagtttataatgtttttattttctttttaaaaaagccaattttatgtgtatgagtattttgactatgtgtatacatcacatgtgtactgagttctggaaaccaaaccaggtcctttggaagagggatgatgtatttgatgtcttagatcttcatcttagtaaaggctttcttccatgtttcctctaaaagtgtttttatgcttctgcttgtgttatacatttggtttaattttcatcagtgacagctaaatttaactggtgttggcatggccctccactccaggccttgtgcacactcagcaagctttatctcagacattcagttcctctcttcctaagaatgtatatctgcttgttcttgtgccatttgttcaaaaatctctccatttttaaatctcatatattttgttattgtcttttgctttgtttttgttttttgagacaggatttctctgtgtagctctggctgtcctggacttgctttgtagaccagactggtcttgaattcatagagattcccctgcctctgcctccctagcactgggataaaaggcatacgccaccacgcccagctttgattctgttttattaactctcagttttatatatgctgatgatcagaaggcttcattatctcactgagttggggaaggaagatgagagacagtttgtcttggttcttggcctcattccagggagcccttctgtcatagttgtctctgctttgatgcctcgccttttcagaagggacccacagagtcttttgtaaacaaggagtccaaacttggctttgtaagaagttgctctgttcccctctcccctgaaggtgattatgaaatcttatttttacacacaagggtgggtaagccttaggcagtggaagctgtctttctgaacattaatggctccagtatgagaatggtgaagttcatcaaacatttttgtcccagcagtaatttttagctatataaaagtaaaacaaccttattgtggaaactcttggaaactacccaaatataaagaaaaggtccttcttcctccgtcatcactgtcctgttctggctcatcagtgtgcttgatatacagtcagtatactttcgtgaaacagtgttgggattttgatggatttgggtctgtttgagaccagcctcatctatgtaaggaatttaagaccagtcaggactacatagtgagactttgtaagcaaaacgtaaaatgtgaatattatctatttggagacaactattttctttcattcttagaagggagcaattaggagtagtaacaactaggtaacaggcacctgttgtggtaccaggccctgttctccacaaagctctatgaagtattacaattacattacaaaagtattaaaattatttccagctctgtgcttattatcttcctccttttacaggtgtgggttaaattatttgcctagtgtctttaagccagtgtgggacagactttaaagcttgaacgattttcatgtttgaacagctgtaaaagaataagggtgaaacaggtctcttttttgtgggtctcgtgtcatctttgtgttctctacaagagctagaagcctcctgagtgcctggttctgaccagattaaagcttgtttctcttctttccgtgttgtgctttgacttgaagacccttccttgccgttagctttggtgagtaccattggctgaataggcagaagagaagccaggatagattttctagtaaggagcatctaaaggtttctaattgaaaataaagtgattttcatgtaatatattcatggtttctcctccctcatcttctcctttggtgaaactaatttttcctttgagaatggttgttaattggagacagcttcttggttggggatgggagctcttgtctccttcccatccaaggcctgtttccttgcttcttccatctctactggctctgacaatgtttccacctcctcttccctgaactccctgagccttaatggagggatttgatgaagacatcccatttagcacacactttttacacactgtccagttgtgggtctctgtctttgttagcatccactacagaagaaagcatctctgaggatggctgagtggttatagcagaatgttgttaggagtcattccttaacagatagtatttggctttccttgaagtctatggcccatctagtctcagattcttggcccctggagccaagcagtggttccatttcatggagggcatcttaaatcaaatcagatagtagttgattactgttagaatttttgtgtcagtgttgcaccagtgtaccatgcagacaggacagcaccgtagatcagagggtttggtgtttgcctctctcctgtggtagcataccgagtacctcctgtaccataaataccagttagtgagagtgaaggctttagttaggctccagactgtcttctctgtgctcagttagatacttaggtgttctctacagcaatagggccttaccatcagtttgtggagagcaactagtagccttggcaatagcctgaatggtttgggatattccatggacctctttaccccaatatctcaatgtgatgtaacccattcctgtcactggaggttccacttggtgtgagagctacctggttggggctctgtcttcctcataatttgaggattgcattgggatttccttcatagatgtttctattttaaggagcttctactgtagtaggtttctgtaagacccctcacatggctcttagtgttagcaatttctccccgtacttccttaccctcttcccttctcctcctcatttaacatttaatcctcctgtcccagtctcctcctgtttcatctacttatatattgtttccctttccttgggagatccgttcctcccactagtttaataaggaacattgttttgagttgggttgatttcatcagtattcttgatttattaagcattaatttcggatttacgagtcctgcccatttaacaaagatcctttcctagtgttgacacactaggacataaattcatcattgttgatgttggaaccagaaataaagttctgatgctgtgtcagagaacatggtgtagagacaaatacttaactgctgtcttagtattcctgaacctcagatatccaaactgttaggaaggagacagaggagacactcaggataggtagctggagatagttatgattctgtagcttcgtttccctccaccgagcctgtatttatgagtgccagggcctgctccacagccagaacttgccattgacccctcagcttatcaaatagcacagcttattatatgtttgtttactttgttgtcatagtatccatctggaaaacagaaggtggctgtgtttgtgtaggaattcagggcttcccctcagttgacatttgctggtagaaatccttcggtgaatcaggctaaggctcgaggctgtgagcacaaaggaagagggtatgtttggactctggacagttgcagagttcttaatattaacccactctgttaatcgctaagctgttttgtatggtgattaggtctttccacttaaagtagttacttgttaaaggaattgtatttattccaggcaggcattcttagactgaacattaggacctgctctacaaaggagggcttcactgggacaacaggcctatacagacagaaacagaacaaaacaaaaaacaagcgaacaattaaaaaccgttcagcactggctttgccacatttggcaaaggtagcttatgaaatgcaaaaatgaaaacataaactaaaatgtgatgaattttttggtttgcagagagaacctcacaagggtaaactcactactttgtattgtttttctttttcatggatagagaaaggttatgaagaaaacatttgcgggtttggtgaaatgtcagcatataaaatacaaggtctttagaatgtgtaaggggaactacaaacagttttaagaatgggattatataacagttgagttagacgttagtgaggttggcgccaggcttccactccgctccggaagtggtgctgccctcttcgggcttctactttactttttggatggtttacttcctggactatgtcttttcagtccctttgccctcaggtactcaacttaccgtggaaggaagttctcttcatcctcacagctgatttccctctcctttacagctgaggaaattaaaagtcatttcatgggtcatgtgttgtctctccatttaatgcctgttttctcagaatgtgtccccttcttcccccaccaccatcctacatgggcttactcagacagaaagcccccacctctgatccgtgataagcaaggggaggttatctgagcaaagccagttctttggaatgaacctcattagggttatctaaaatctcaagagatgctgggttactttaatgaatactgacttaccacagtttgtgggaggtgtatttgaagccatgacagtatccaggaaaacagccttcatctctgctcttcactgtacgcagtgaactcaaggctgtggtggcactcttgagaaccagcactgaggaaactgcctgatacattctaattttagaaactttgaaaaagtaaactaatatagcttgacatgtttaataatcattgattcccaggtagcttaacaaggaaatttggttatttaaaatagtccatttcctgaaatttggcttaattttattttttcttacctgactgtcatattacggaagtggtttatgtggtattgtgctcttgatgagtgtacatttaatcacattccccccggacttccagtgctgtcgattagcctttgttatacggttatttagaaattgacctggaagaggaggagataccaacagggatggagagagccagcagccactcatgtttgtcttactgtggtgacatagtgcttgaaagctcctcctctttttgtctcacttggtgaatgtcctgatactggggcttatagtggcagcaggaacctaagatccaggcagtcatgtgaagtagacttggtaagcagaaaacactgggtccttggaaggatttgatgaggaattgcttgctgctcatacttaaattgtgggtttgaacctgtgataaggtaaagggttagatgtatttggagacagggagaacagcagggaagctatggtccagtggggcagcctgaagacctggacagtgtggttaggtaaacagcccgggctaagttctttgacagtcccagctgcttcttcagcccaagcatgatcagcatacacagatactttgccaaaatattgaatgaatgaatgaatgaatagctctgattgcagcttttggcactgttctcattcctaatgaaccaggcttctactgtctgcatttctctatgtgtttttattttccatgttctcacaggaacagcccagtaaacgatgaccacagcacccaatgactttttcaactctaagttccaagctctttcacataatagtccaaagagccacatggtcagggttgtcacaggactgaccctacttcctcgtatcagtttctgttatataattctggtgtggtgacaaaaatacctgaaaaaacccaacttggtgggggtgagtgttactcagcctataattcccagtttcactctattattcagaggaagtcagcatgacgggaacccgaagtctcaggtcttgttacatctacagccaagatcagagagcaaatgaatgcacacatgtctagtgctcaacctgatttctctattcttacacagtccagggccctaaccaaggaattgtgctacccacggtggcctgtgtcttcctgtatcaagtaataatcaagaatgtttcccccagagacatgcacagagacctgatctaggccttcattgagcctctctacccaggtcattgtaggctccgtagatacaaccatgtgctatcacagagtgaagctggctggatagagcagccatacttgtaaatcagagactgagaggcagaacagggaattgtgtagcctgataattctgaagactggccttcaaagaatactcttttatagaccaagacagttgttgtaccctgaaatacaatccagggaaatgaggtgctctcctaccccccttttaatagaacaaaggcagtgtcaaacaaatgcatgagaagacttgaaccataaagttccatgatttccttgagttttgatgtgctatttcacaagtttgtcatcatcgttatcatcattgttgtcgtcatgtgtttacccatcctcactccgttttctttctattttattcttgaaataggattccttagtgtagcctaaactggccttgaactcatgactgtccttccattgcctctcaagtgcttggattatagcatgcaccaccaagcctgactatatcttatgttttttaaaggtgatataattagaaaataacagaacctttttatttgccattttttattgacgtaatgatttatttaattttgagacagggtctcactgtgtagccctgatgatcctggaactcattatgtcgaacaggctggccttgaactcacagagatccaaatggctctgcctcccaattgatggtattgaagatgtatgccactactgctggctttaaaaattgttattattactatacctattaaaattagaggcagtctttatacatgggcttggctgttcttggaattcactatgtagatcaggcatacttgaattcagagatctgcctgtctctgtctccttagtgctgagattaaagacgcctgcaccaccaggcccagctgcttacttgcttgcttgatcgattgatttacttacttacatactgtttgtttgtttgtttgtttgagacagagtgtccttgtattgccataaacttttgccctcctacctcatgagtactaggattatagttgtataccactatgccaggcttttcttggcttttattttttatattttcattagttctttgtgtatatgtgttatgagggtgtgtgtttgagggtgtgggtgtgtgtgcacaccggagtgccagttcttgcccctgtggaggctaaaggtcaatgttaaatgttatctgacatttttcactttaatctatttttaaaaaagatttattttaatgttaatcatatttatatgtgtgagtaagtataaatgagaatgaaggtgcctctagaggtcagagatgtcagatctcctggacagatctcctgggagctggaaccacccaatgttaggtgggttctgtgaacagaactcaggttctctgggagagcagcaagaactcttaaccagtgagccctttctccagcccccaccttatgatttgggggacagaatctgaagctcactagtttagctagattttgaccaccaagatccctggatccctccctagtactgagttacaggttacactgccattcttgggttttatgttggggctggggagtctgagtccatgctcgttggctgtaagtccagctccctggggatccaatgcttctaagcactgagggcatgtgccccaactaataattaaaattaagaacagcgaagctttaaaacacacctttaaggtagaattatatttgttaaggttctctagaggaacagaactgataggttggatataaaggagatttattagactaactcacaggcttcagctagtctatcaatgactgtctaccaacagaagctccaagaatccagcagttgctcagtccatgaagctggatgtctcaggtacactgagatcccagtgaaggaatggacttgctggtgaggtacaggtaagtaggcagagagagcaagctgccttcgtccaggagctttatataggctgccagccagccagtgtagcccagactaaaggtggatctttcccacctcaaacagatacagagtgggtcttcttacttcagatgatttaattaagaaaaagaacttcacaggtgtgcccagccatttgggttttagtaacttacaaatgtaatcaagttgaccaccaagaatagccctcacgcatggccatatgtgtaatggcatgtatgatagctaatccttaaagagtactgttttacaatcccatagctttctaatgtacacagttgagcagccatcatcatgacccattttaggacattttcatcatcctcagaagaataaatgtgctgcttagctatcgtttttgtcctaatgcttaataaccttttgcctgagtgactcattttatctctctgctgagttcactctacctgtgaaaggtttttctgtctttttggttggggttttgttttgagatagggtctcatatatctcaggctggccttgaacttgctatataggtcgggatgatcctggaaacttttgctgcagccacctctgctttcctgagtaagttctggtgttgccaatgtgtgtcattacttgtggtttatttgggagttaaacataggcccgttacatgccaggtgagctttctaccatatccagccccttgattcattccttttttattttattttaaaatttattttatttatatgggtactttgtctgcatgcctacgtcacttacatgctcggtgcccatggaggtcaggagagggtgttggattcccttgacctggagttacgtatgtttatgagctgtcatgtgggtgatagttttgaacctgggtcctctgaaaaaagcaactagtgctgttaattgccaagccacatttacagctccttgtttcatttcttaacatccagcacaacattgaatcagatcagctcacttcttgatttggtaactttgtgaaaaggacactgtctattagcaaactatgactcattcatattcatattctctctctctccaccctccagtctctctgtctctgtctctctctctctgtatgtgtttgtatttgtatacatactttaagatagatttctgtcatttgcatgttttgtcaacacaggatcatgtttatccatattaaatatcagcttggtatatattgtggcttctttatatcttggtacacattcatttcatattcatttggactttcctgtgtttctggatcttcagtgttttgtcttttacttccttttctttcttttttttttttttaaatcctggactttgggtatgataggcaagtattctactactgaattatcttttgaagataatagtattgccagataactgcatatcgtttcctccttttgtcttactgactgccctagtttcttctgttcctgtgataaaaaacaatgacaaccgtaaaccagtgggagggggtatttgactcacagtccaccatggcaggcagggagcagagtgggtgaatgcctactgctgcagctccttttccttcacagtacagggcctagccagggaattgtgtcagccatagtgaggactctgtctgaagagtatctcaccaccaccaccaccaccaccaccaccaccaccaccaccaccaccaccacctccagggagttgtagattctgtcaagttgacaacactaattacattttattttcttatagtagataggacccctactcggggccctccctgcacatggtaagcaagtgctgcccacagagcttcacgttctggtcattctgtcattagatttctcgaatcattgttcagcatattccttcctaagaagtggacaaaggctgggtgaagtggtgcacacagttaatctcagcactggcagaggcagggggatctctgtgagagccaggatagccagagctacataaagaaaccctgtttcaaaaacagaacaaaccaaaaagaattggatagagttaaggtgaagaaatttctgctgcttgtagagaatacttgtttcttgtaggtgtcaattcatattgctcctttaaatagttgttgttgttgttgttgttttctttagacagggcatcattatgtagctctggctggactggtgtcactttatagagagtgtcattttgctttttattttagttagataaagcttagaaaggactgttaaatcagtcttcattgcttgtgaaaagcattatagggttaaagatggaaatactggattggaaacatatccttcttggctcacattgttttcctaattttctagaagagtctaatcacttccccatgtgtcaactcagattgagaaaagagtcattacattttctaaccatctgctggtaacgttttcatcatttatacatcccataagtaaagtcagaggtgtgcaatccgtttagttgcttggatgtatgcagttggcattttatgtaagcttactgtgttggattggaaatgacagttaatagactgttggtgattaaaaactaaccctagccactcctttattgggatacccataaggacctacagtgcataaccactgctcttagttccagtgtacagctcatattggcagctttcttctccactatgaacctcctcaacttatgctaaattattaatctgagttcttgttgagcttataaatgtccatgtggttatgaatctgcagattctattccacagcccactgagaactaacaataaaaacctgtcattgtgtgtatcattgtgtgttagacactgggcattctggtaacagtttcttgttttctcctccatgacaacaaggacgtgatcatgtgatccctcttctgttgtctgggcatctgatgcttagaaaggttaaagaaataatcccttaccttatatgtctgcattttttatttttattagcttttgaaaatatacatgaggttctaatttaggtgtgtttatctccaaaatgagtttattcttctttgtggtagtttattcttttcttttctttttctttttgaagtaggagtttgaactcgcagtaatcctcttgcctcaggatcctgagtgtgctgggctgtggcctgtttactgtgctattgtgccaagtgctttggaaagtaagaactgtgaagaatgctggacttggttgcatgtctggggcttgggaggcagacagcaagaggaaggagaatctctctgacttgcaggccagcctggactacatacacagtgacactgtctcaaaaatgaacagacaaaccagtaaatataaagcaataaaattggcctggaagaaccttataaaaataaaggcagaggaaaccaacagtagttaccttagcagactgcctttctttcgggaggcataggcttgttctatcagcagtgtacagagaggaggaattgtagaagtcgatggaggtctgtcgtcttaccaccaccatggcttgtgtctgattgtagctcttaactcttcagagaggtctgtatgccactgaacttggacacagctgttgcttcaggcccattgcacacatctgttttctggtaataaacacatgatttgcttttattttaggctattggtgtgctatggcctttttccttttatagaactgtatctcttggtggaggatcagtttgagtttgacgacattatttaattgtaacaagtgctttgtttaaagtttctaagccaaagctccatgaaaagagataggagtaggaacatgtcttgtttagaagtaagacccctttacggggtgaggcatataattgccttaagcagttttaaggaaactaaacatctctttaacaaatatatcacttcttgattttttttaatttcgggtgtgttggcggggtggtggtgaggagtatggtggagaggagttgtgaatgagtgagtacatgtgcctgcagaagacaaaagagggcatcagatcccctcaagctggagttatggctatgagctgcctggtgtgggtcctgagaactgaacctgggtcttctagaagagcggaaagtgctcttaactactgagccatcttgccagcccctcatttatcttgatttttagtaatagatgcttatttggagcatttatgaagaattatattatggagaatttaactcacggaagcttcatgacatgaaatggaaaaataaaattacccataattgtaccttgagtcatcgagtatagtctttctcttttattttcttctttaccttgtagcatggagtgatacatgcctacattagacttctggtcgctttaagtgtaattattgtatacattattaagtctcttttgcagttttaattgacatactaaagcaatcttaggcattctccaagtgaaatacagattagtatctttttaacattttgaataccattcttacaattcctatttaaaattgtgatttttagaatatcttgtatgtactaactagaattatattaccttgaatattttgaatagttggtcactttccagggactgttagactttcttcaccaaactattaaatttaagaattttgtataattccacctcccttctttctttttctttttcctttctttcctttcttttcagacaaggttcctcactatgtatttctggatgtcctggaactcactatgtagaccagacttgtctttgaactgacagagatctgattgcctctgcctcccaggtgctgggattaaaggcatgtcctactatgcccagctttagatttttttttccttaaaatcttttgtatattatttaacagtttaaaacttacatcatcatcgggagccattttttgttgttgttgtattgccagaatgctttaatgctttatatcataaccagtcttgttcctccaaccttcctggcttccttctaattaattcttgtcacaggttctagcagctcatgcctttaatcaaaacactcaggaaactgagacaggacaggaacttggcttataaaccagagccatcctgaattagagagttctaggcttttctgggctgtagagtgatagtgtagatgattgctgatgtgttagtgctgtcagaacctgtgttctaatggacttcctgtgagcttcagatccatgtgtccatttctcttttcttcactgccaacagctgttattcttgactatagcaaaggcatctcaaaagtggcgtccctagaatcaactctatattcatctcaagttattggctcaatgttttcttccttctagtgctgtcagtaatctaaaccaaggtgaaacgcttggtaaatgcctgcgatttcacctttgaagctgcaagtgctaactctgatctttttcaaagccttttcaggtttatcctcccctttgtccctgtttgcactggccatatttaggcatacagccttttataatttactgagatagtttcagtagtacctcccagcttctagtcacaagcttgtccttttatgtccattaccatatatcacaggcagaaatcattttctcggacatacatgtcatggctgctgtcctgcttagactgtttgttgatggctggctattgtacctagagttcaagaagcctagactcctcaccagtaaactgttactcttttccctttctgaacctgtctgtccctcatactcaccagttctgtgctaacaaaactcctagcggtgtttctgagattttctatgggactttatgtacataagcattggcacatgcagtctttctgtctgccgagtgcagtgtctcccacatagcttgcccaccattttaaccaacattgtaatcagttcttaagcagctgaagttaatttgtgtgatgctgtcgtcatgagccctgtcacccatatgctgacacactttatttgcttcaatcattgggccttttacgatactttagataacagaatacccacactctctcccttgccacagccaatgtccatgatcttatacttagaactaccttacttagcatggtctgagggaaggtgcagagaaggtgacagttaaggaccttgaaatggggaggctgttttggattatccaggggttggatctggtcctgggctggataaggagagaatagttgaagaagttagagaaattagacttgctggccttgaagatgattaaaggggctacagccaagaaatgtaggtgctgtacagaagctaggagaagtaagcagagagggagaggcagataaatactttgtgatagatgctgcagaaaggggagaagtcctctgataacctgggtttatgatccattaggtcaccttccatttcagatctatagaacgataagatgacttttgttgttttaaaccagtttgttgtgcttggtcaccatggcagcaaacaaagagtatgtatactctgctctgtcttaattattgtattgtcttctagctcggaattgttcttgctccctctccatcctccccttctcccacctccctccctttccctctccccttccactcctcctccccccttccctccattccctcccttcccctccccttcctccactccctctctgccccatactctcttggttctaagttcttcagtggcagggactgcatattttcatctgtctttaatacctagcatagtgccataatgtatgaattcatggtttatgtaatgtttctgcccttgtaaatgttttggacagtctttgctgtctatgtttagatttctttttgagttactatttcattttaaaaatcacttgtgtgcatgagcaagttcttgtgcatgtgtgagtgcgtgtccctttgtgtgtctcctttctgttactaacttcctttttatctatttctgttttttttactttaatcatcatttttgatctaatcaaatcctcctaatgatttgttgtgtcaaatatatcttttgcacatgacagttttgagttcctttggagaataatttttgaagtaaaaaaaaaagatgctaggagctttttaatttctttagagcttctttatagatatgtacttcccttttactcttccagcaacctgaatacagtgtttaatttggtaatttccaataaatgaagtacttacattttgttatttttgttgttaaactgtgacattctaacgaagtcagtatgaatgccagacttaatcatggtgcttagtttactaactgctagcacactcacccagcctaactcttcctgttctgttattcacctttaacccttttcttactattgttctcctgtcaccccttccttgagagttcccttcttccatggcctccccccccccaccccccagcatgtcctctatgagaattccaaatgaaacaaacgcacctgaagattcaaagctaacatctacaaattggagacaacatggggcaattttctttctgggttacctcagaatggatttttctagcttcagccatttaattgcaaatttaataatttaattttttaacagctgaataatactacagtatataattgcttcacatttttattatccgttcatcaattgttcaatatctaggctgattccttttccagggtcttgtgaatagagcattgatgagcgtgggtgagcaggtgacactggagtaggatgtagtcctttgggaatgtggccaagggtggtggaactggatcttggggtagtttcttgaggaacctacactctggatttcactcccactagtgatgaagaaaacattcccttccccacatccatgcagacgtgttgcccttttgcaaaaagatcttgggcattcagactaggaggagacaaaatctcaaaagtagctttagtttcccttttcctgggggttgaagctgatgaacagtttttaaagtttctcatccattggtatttcttctcttgagaactctgtttaattgtgtgctccgctttttttttaaattaaatttgctttcttaatgtttaattttttaaagttgtttatgtattctaggtactgtctgttaaatatgtagctggtaaatatttttccccatttccagtctgcttcttcaccagtgatttcatttttgtttttttgttttttgtgcagaaacttttagtcacatgtggtcccatttgtcagttgttggtctttcccctctactgaggtcctctttcctaagtcattttctgtgtccactccataccatttcctcttgtagtttcagggtatcaggtcttatgtcaaagaccttgttataattgattttgtgcaggtttgatattatgacctcgtttcattcatctacatggctttccagtttaatcagcactgtttgttgaagaggctgtctttccccagtttgtaggtttggctttttgtcaaaagtcaggagactgtggatgtgtagacttatatgtaggtttccatttcggttccattggtcagtgtggctgtttccatttctgtaactccacagtataacttaaaaccagggatggtgatacctccaacagttcttctattgttcagaatggttttggctagtcttacttttttatgttcccagatgaaatttcagatccccccacccctgccccatttctgtgaagagctgtgttgggattgtgattggaatggctttaaatgtctaaatttcttttgaaaggatggctactttcactatattaactctattaatgcttgactctgggaggtcttttccatcttttgacattttcttcatttctttcttcagtggttaaagttttttattttttatttttttataacagaactcttaccttgcttaggttacatttattccaagagatgcaattgggggtagggcaggctttctgattgtttccctgatttctctttggtatgcttgtttgtttttaggaaggctactgatttttttgttaattttgtattctgctactcagctgaatgtatttactagctattatacatttcctggtgggatctttaggatcttttatgtatagaatcttatcatctgcaattaaggaaacttagacttctttttctgtatgtaatctctttttttccttcacttgtcatgttgctttagctaagattcagtcactacatagcataggaatggagagtgtacagccctagttttttttctttttggtggaaatgctttaagtttttctgcctaggatgttgtggtcttgctatatattttggctttattgtgttgaggtatgtcccagagttctccaggacttttgtcaggaagagatagaggattttgtcaaagaccgttgtttcctctaatgaaatgattgagtcctccctggccttgagtttgctcatgtggtggatcacagctactgttttacttgtgttgaaacagtcatactctaggatgcagctgacttgatcatggtgtttaatatgttcttgaatttggtttgcaagtattttattgagaatttttcatcaatgttcattagagagatcattagaaagattagctaatagtttttttcttttcctcttagatcattgtctggttttggagtttggtaatactggcttcgtgaaaccaatttgcaagtgttccttacttttgacttttgcagaataatctgaggagtgttggtattcttttgaaggtctggtagaattctgcattgtatccatttggtcctgggtgttttgttggtttgtttttgttttgtttttgttttgttttttaagctgggagagtttaaattaactgtttttttattggttattatgggcatatttaagttattgacttatcttaatgttgatgcttgtttccttataaaaggcttataaaaatctataaagaaataaacttacctatctataggcagatgtatatttctagaaattgatacatatctagtttaaccttttcaattcagtggaatatggattgttttgtttttatttgagacagggtttcataaggtaagctctggttcacctggagctcttgtgtagactaggatggcctcaaatttacagagctatgcctgcttctgccttctgagggctgggattaaatgcgtgtgccacagtggcccatggactatagatttttaagggatgtctatttaaatctctgaattttctcagtgtttttgtaatgtttctttttcatctctaattttatttatttgagtccccccccccacacacacacagtttgactaaaggttgttcttgttaattttttttcaaaaaaaccaactcttcatttaattgatatttgtgatttttttgttcctattttattaacttcaactctgaattatctcttggcatctactctttttaaaaactttttattgattctttgtgaatttcctatcatgtgctcaaatcccatccatttcccttcataccacccttctgcccttgcatcttcccctccctccagaagaaaataaaaagcaaaaataaaagacaacacaaaaggaaaacatctcattgtggatgttgtcatgtgtcacattgtgtcacatagtatattcttttgtctacgcgtctttacttgcaaagagtcattggtttggttcaaggcctctggcttctgctacactatcagtactggatcctcaccaggtgtcctgtagatcctgaagctttggatctacagaaccagccccttcacgcactcgatagttcataggtgggatacatgtaagagtgggccaactcacagccctggatctgggcctggctggtatctaagttggtcagctgccacctctcatacccataccaccaaggcaagctctccagcactgccctgactagctcactgtatgctgcagctggcaaggggcagggctagctctcccactctcatgcccttgaagcctgcactcatgctccccccttctctgtctctctctgtctgtctctctgtctgtctctgtctctctgtctctgtctctgtctctctctctctctctctctctcacacacacacacaccatcaagaccatctctccagagtgctgcagctgcggaaggggctggatgctcacctgcctgtctcaggacgggaggggagggcatcttttgcccatggtgggccgggttacttcaggctcctctccaccctgaagtctccagttcctcccctcttggtaatactcaactgttgcacttctctttctctcccatctctcatattgtagtggttcttactgcaggcaggcattggggctccgggtgtcttctccccgcctgtaccacgtgtcagctactttttaaaagtattgtttgttcttgttttcccatggcttcaggtgaacattatcatgaaattgttccatgttttgatgtaggccagtggttttcaaccttcctaatattgtgaccctttaatacagttcctcatgttgtggtgacccccaaccataaaattactttgttgctacttcataattgaaattctgctactgttgtgaattgtcctgacccagcatatcacaggttgaaaaaaacgctgatgtatatgaacgttcctattaggactgccgtccctgagacagcagtgtgttgtatttttatttttgttcaattctaggaatttttaaattttcttgatttcctcttgacccagtttcgatccagtagtgttgtagtttcatgagtttgtgtgctttctgccactcggctttatttgtagccagatagtatgcaggatgttatttcaggtttcttaagtttgttgagacttgctttgtatccaaattttggagaaaggtaagtgggcagctgagaagagagtgccttttggtggtggtggttgttttgtttttatttttatttttctcttttagtttgtgtggaatgttctgtaaatggctcttataaacatctggtttatgttcacttactttctctaaaagtaaaataaaagaaacaatgtttaaaaggtttattatatgtatgtagtcagagccataggaagaatggagtgaaaagggtaaataaataaaagagaagtgtttcccaaattaaatttgtcagcggaaacccgctcacaattggggagaaacagatggttcttttcccagtgagcccaagaagaattgttgcttgaccatcccatgtatctccaaaagtgtggttccaagaaggcctctgactgcagttcctgttgtgatgtaccgttccgtgtcttttaaatccacagtgttgtgagataagtagattaagtgtatgacattgcattaaatcccataatatggcaatcctccctccttcttcctttctccccccaaaccttgtgcaggtatctagcgaacattgtcagtttggctgaaggcaaagcccggggaggcatttgtcaggctctgcttattaccctggtgagtttgctgctgctggtgctgagtcatgtggtaatgtcagtcattgttaagggatcttggttgaactgtggaagcctctgattctgaatctttttagaaatgcatgtctgtataattcatgcccagccttcgtgtactcatgcgggaggcaacagtgattgctaacatttcaaaataccgccccagctcctgctcccactcttttccctgtccccctggacctcttcgaaactggttgctcctttcttcccacgttgcctttacgacgcagcaggagtcaggtctgagctgcagagaacacccatatgttttgctcatttgatactgattttcctcttgatagctattaaaatgtctcctgtgcacctgtgaacttcatgtatgctcaacagtaacttagtcttagaagccaagttactgattcagggaaaatgttttatattgcaagattccagcctaccacttgcgagcagagtgtcagtaaccaaagactttgagctttgctatccattttcttagagaataagagttgtagctaagttttgtttgtttgtttgtttttgttttgttttgttttgtttttaatattgtgtgtgtgtgtgtgtgttttccctgcacaagaagagggcgtcaaagcctctgggactagagttacggatgagtgtgagccaccatgctgattctgggaatcaaatccaggccttttggaagcagcagcctgtgctcctaactgctgagccaactctccagcccacagcgatttaagaggtttaaagttaaaacattttatatataataagctttccatggaaatatggattcctctgattttcctcttggtcttatggccaagtagtataggtcacttagacaattatagtgtaggttttttgtgtgtaattttttgggggttaaagattaactctaaaggaggttaaactgggttgttttttacttatcctctcaggtacagtgttataattgggttactcgagtttggggctggggagttgtcttagtgggtaaagcacttgccaaacaacatacaaggagcagagtttgagtctcaagaacccatgtaaaagatgggaggcagtcagtaggatatctggaggttcatgggtcatctaacctagcacgcacagccttctttaaaaacaaggtacaaagtgagattgtcctctgacctccacctgtactgcagggcatggagcatctgcattcacatacatgtgtaagggcatgagtgtgcgctcacagaaactgtaccgctaggcaggtagtagctagaataacaggattcccctagaagtaaaactcagcaagagctctcagcagcactcctgacctctgaccctacctcccaaccccaccgagggggtcggttctaaatattttaaaaagagaacgttcctgggtattactggagacattttagaagttttttatgaagtttttttttcttactctttttcataatgtcggtctctagccttggtgtcaaggcaaacttggcttcatgaattgagtgctgctgccaatacttggcatcttaactcctgtctgtagtaatagaaatggacgttcttgcaccttgtccctgtcacctgccaccttgcggccacccctcatttgtagtgggtttgttgtaggtttctatttcatgcaaataaagaacagcattacttctctcccagcccctgcgccattcgttcgtgtgcctttcattttctttctttcttgtgcactcattagctagcattgccatcgtgggatcccatagtgtactcaagtttcctgtctcagagtaaacattgaaactttcactttgttttatttcaaatgtagggtttttttttttttctcctttttttagttcaaaaagttttcgtcttgttgtgctgagggttattaaagaggtggtcactgttttttcaaatgcctttttaatatttaatgaaatatgtgtgcatgtggtttttgtttttttgtttgttttttaatatttgtatccaggagtggtgggaaatgcctttaatactgggacttgggaggcagaagcagacagatctctgtgaattccaggccagttggtctacaaagcaattttaggcttagctagggttacatagtgagcccttgtctcaaaaaagaagtgccattgtgctgtgtatgatgtgtttttataggtacatgcatgctgtggtgcacgtgtggtccgtggacagcgctgtgcagtcagttctctgctactctcccgtgggttctgattgaagtcaagtcactaggcttttgctgagctgtttcttttcttgttcttttcacatggtgaattccattaactttttcaatagtttacacttcaggataaactccacttgatcactgtatattattcctaaaaataaaacttcttggggattggagagatggctcagcagttaagtatacttgacaaacatatacataggtaaataaatattgttggagacatttttaaaggttttctatctttgtgaaggtttgctttgtcctttttcataatgaccttctctagttctggagtcaagcaaacttagctttaagagttgagtggaacccctctcagtgtttagttggtacttgtcacctgggcctgtggattattagaaaactggaaatgcatatttgacgcagataaagggagctgctagatgaatagaggctttttatgatcccagtcatgttgaacatcttttatgtgcctgctagccattgataggtctttactctttgagaattttctacgtgtacacaatgcatttagccatcctcagtctcccctccagcttgcactaggcctcttacatccccctttcaacttcatgtccttctccttctcctccagttaacacagtgattgcatctagtgctgccctcatataaataggtgtggggccatccactggatcatgggataatggccacgtgcccaaaggaaaaatgattctctctccccagcagccattaactgtcaatagctcttaagctaggggtggggacttctcaggctctcctctgcccgtgctagaaaattgacaagcttgatcttacacaggtaaccacagctgctgaggatgtgtaaatccaataaccaggtcatatgctgcattttcacagaactcctgtgactggtatattcttttcttccttttctctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagcctgactcctctctgttctgcaaccaagttggcaaatgggttttaccacctcgttttggtgagcaaccaaggttagtggcaatagccattgttgatttgggggcctcagatgcttccttgattcatagtgagataccccatgcctagcactgggatttttgtttaataacctattatttctgggggaaacatttgcaacctactcatatttctgttcaaattcatttgtaaaacatttgtgtgaattgttgtcagtgtgttgttgcccttgtcctctgcctcttctttttcctcctcctcctcttcctcctcttctttctcttcctcttcctcctctccctcctcctcctcctttctcctttctcctttctccctttctcctttttcctttctcctttctcctttctcctttctcctttctcctttctcctttctcctttctcctttctcctttctcctttctcctttctcctttctcctttctcctttcttcttcccctgcaccatgtagcctttgctggtctggaactcattgtgtagaccaggctggccttgaaattatagagatcctcatacctctgcttatcaagacatatgctaccacactgggctctgtgcttgtatatttaacatagttaagaaagtagcaggtttctgtaatgcttttcatacgtcctacattttggaatccaccctccatccttgataaaatctttaagccccagtattctcccactccacatctttcatagcacttgtgtttttttcttccctgttaaagcatcttttctccccttctccctccaagttaacatatggcttcgttactgaaatgatttattcaaataatttgtttttaatgaaatgtcttactaagttggaagagtacctgttacatcctaggtatacggtcttgatgagatttaaaatgtacagatgtgtctctagctcgacgtggataaaattagaagtcatatgcaagtataagtgaacatatattttggattttatctaactcagttattagtgagggatttggtaaaatatttaaacaaattccacatacctagtaccctttaatgtgtgctgcaccttggtgatatttcttttagggtccattgtgttcttttatcttccgaatgttagtgcttgttcttttgggagcatccattttagtataatttctgtgcctttgctttgtgcgagaagccttggactctcatcagtaccagtccgatttagtgtagcgaggacttggattcacacatagctttctaagactgcagctttctgcatgagctcttgctgctccaccatgtggtctgggcagccttgacctgcaaagtgaaaagaacaaaagtgaatctcagcaacgttctcagctctcagcttttactccctcagtgctttcagacgattgctttttctgttttgttcagaacttaaaatagtctcagtcttcttacacatttattgactttttaaaaaagctctcttctaagtctcattcactacttatccattctattaattttaatattcgaattgttattttgcttcagtgtttgtaaaccatcctgtccctcttaggaatacatattagagaatatgctccaagcctttgaacttatttgttatcacctctggttatcctactgtagaatgtttcttaggaattgtgacagtttcatgtgttggaaaggagcaggttaatttggcaagattttatttattgcataattagttctaagtgcttcagaaagacagaacttacactagggttagttatgtccagttcgttctcagccagagtggatgtttgtgttaaggctgctaacaaatagtcaactgagaagtagtgtcttggagagtccatagctgagttttaagttcctccaagtctgtggtatttcttttgccttctgtgagactgactgggaggcattccttgcatgggtgggtggctgccttctgtttttgtttcttgctctggcctggcttagctgctcaggtttacaatggcatgcgtcagtgtatatggctttgctttgtccattgtactgggccattgtctgctcagcttaatagcagattccaggacttgtgattgctttttgaaaagctagtgtgctcttgagtatgtgccatgcagtgctaggatggcgtgctccttatcactacttaaagttagttaatttatggcggagcaaacagaaacatcatacatttgtttctctagaattttgaaccataagcagactcccttttcattcttggaaagcttgaatattgattctgacccctctgggttttatagaatttggagtaaaccattcttagagaattttattcatttaacagcaactaagtttgtgtagtagaaactctcagctggtggctcagttttatgtggagaaaaacaaaacaaaacaaaaaaaaaaaacgaagcccatgtttatgtggaaaggtctaagagtgctttccagcagtttctcaagttgtcagcatttctgtttgcttgtgggttggcctgtttgcttgttagctgttctggaaaagcagaaggtgtcatgtatacattagtttacaaatgaagaccaacaacaaatgctacctttgttgtctcttcatttcagtgacttaattagtaaaatttcacaccctctgtcaagcatcttctatttaatgaaaatcttctaataacaactcttttcattgttttctgtattaatgtacagtatacaaaaccaccttccctccttcttggccacatccctaaggtactctcgtgtttctgtatgtggaaaaagtataaacatgactttagagtcaggtctgggttcaaattcttgtggctcgtgtatatgctagtagtgtaatgttacattttcccctaattttgttttgttttgttttagattttattttattttgtgtataccggtgttttgcttgagtgtatgtcagttcaccatatgcatgcagtggacacagaggccagaagagggtgtcagagcccatgaaaatagagttaacaacagctgttagccttcatgtgggtggtagcttttgaacccagattctcaggagcaacagctatatggcagctcacaaccacctctaactctcggtggttacaacacaatctgaaagtgtagtggcctttaatcctggcaggcagctgggtatctcttgagttccaggctaattaaggttacatcgtgggatcctgttttaaaactgcacaaaacaaaagcccgtggttgagttttagaaatagttttcaggtgccaggaaagaaacttgcaacaacaacaaaggtgagatgggttggcatattggatctagttaaccacctctttctcacttgtttaaatattacaggctttctagtcctgtgcagaaatgagtttgaaaatatctagggccttccacaagcattcagtgcataagccaaggaagaagaaggatgaagagagtggagattgggctgtgggtcccctgccttgctttagttccatccctgctgggctggataccaaggcagtttgtcttaaaaagttatttgtagttgggctgtgttagtgtatggggacttgggaggagaaagcatacattaaatagtctccatatattaaatattaaatttacatgcacaatgatatggcctgtttgtatttatggtaaagtacaagttattttacatttctaaatttcatgccatttatttctgcacagcaaaaaatgctaaatgtttttataaagaaccagttctttttgtgtctttgtttttgttttttaatctgtgtgggtgtttctctgtgtgggtatacatgtgtttgcggggggggggggtgcctgaggaagccaaaaacattgaatctggagctgggttctagtcatttatgagctgtctgacctgggtgatgtgagtggaactcagattgcaagggtagtgtgtgcaatggttgcattgagccatctctccagcctccgactctgtgttttgtttgaaacaggatcttgctgtgtctccctggctggcatggaacttgctatgtagaccaggctggtctccaattcagaaatctccctgcctctgcttcctgagtgctgagattaaaggtgtatttcaccacatctgtcatgtctgtatttttcatgacaacctttaagtgttagaaagagagttttcatatatgtgttgtataatattaacatatacagtgtttctttaaaggtgtttaataatacttaatgatatttttcttttaccatgtcacccaagattgcagattcagttttggttagaactgcttgacatgttagagatgagtgaaggatatcttactccatgtggtatgagaggttccaaaacatttctgttacttcagagcaatgtctgtctgtctgtctggctggctgactggctgaaattttctacaaacaggattgatggtgctccacatagattctatgctaacatggcacttgatggttaggagtgcttatttgctctgtagaggacccaggctcatttcacgcacccaaatggtggctccctactgcatccataactctagttccatgggatgtaatgccctcttctaggcccctctgacttctgcatacatgtgatgtaaaaactcttggaggtgtgcatgcaggctcacacacaggcacaacttttaaaaacaacaacaacaacaaaaaaacatggtttggtgtatgttataaagcacaacagggattcttcagatcagaagtgttttgtggtttaaaaaaaaatccattagagaggctggagaaataatggctcagcagtgaagagcactgaccacttctaagttcaattcccagcaaccacatggtggctcacaactatctgtaatgggacccaattccctcttctggtgtgtctgaagacagcggcagtgtactcacatacatataactaatttttctttttttttttttaagtcccattggaagagttacttttcatttaagttgggtggtagtggtacaaacctttagtctcagcactcagacgcagaagcaggtggatctctgtgaatttgaggttaccctgctctacagagcgagtttcaggacagccagagaccctatctcaaaaagctaaccaaataaacaaaacacccaaataggaaattgctgaaagtattggaattctcatttcagtagcattttcagttcattaggacactcacagatattttacgttaagtcttattagtaaacacaggtccttctgactttgagattattttgtaagttgacatctctcctgattttcagtgtcattgttccccaaatattgtggaatcatctttgagtagaatatttagccacaagagatgtttttcttagtttaaaggctaatgttatttgcttttagcttgtttgtgacttctttagccttctattctacttgtgtaattcagttgatggtgcttttgttatgtgtccaagctggtaggcccccatggctctgttatgccaggcccagcaagataagccacaaataggacttgggatgtgtcctggtaagggctgtttaggcagtccaggtggctgataacttggcccattaggctgcttatttttgagatagaagggaggggagagtggaggaagtataaaggcatggctttggcagtctcttaactggatatctattttaacccctgtagaaatcaatttacatgtttcacagctgagtatgaattttctaaatttaaagtgtgttcttactaccatagggataaatgtcagcacttaactgaatttgtgggatttctctcccttttctggatgcctaggtcacttaacagtttcctttcctttggatgacaggatacagctgttctcacttgtagaatggccttctccattgtgggagtttccttctccattgggatatttgcaaagcaacaaaaacattatttgtaggaaatcataggctttgtaaatatcaaaagataactgaagtggtgaacttgtgtattcctgtccccagaggttgttgcatctgtcatgtgaaagcctaatacagggtgagatagcacccagcccttcccttttgctccaatagtgtctgcttagaagagccttccattctatttctgtcttgtctctggaagagccatgacaggcacagaaattcagattcatttgtttttgaagttaatcccagatttttctttcttttttaaaaagacttttactctttgacagttttatccatgtatatatcttgatcatacttatcccccatttcttcctagaagtcattaaacacctctactttataccttcatgcctctttctccttttcttttctttttttgttttaaccacatagtctaattagcactgcccgctggaatagtggctaatgttcttgacttaacttcatgcatgtgaccgtagctgcgttgcagattcatgagtgcagtggccaggtcatggccatgtcagctttcaatggcattcctccctagcctctgtctgttacataatgtaataagaaatcatttctgtccctgcttcaaggaaatttcctgagctctaatggtagaaagggttatatgtgatcactcagcagtcacttattgtaaacaatatgaccagttatgaacatacaaggttcagtactggataagattgatgtctttcccctggcagctgcctgcacagcatcatctagcactatgaaaactaaccatgaaggaatgaagtttttaagtcagttttagatttctttctgtctgttttgcaaccaaagtgtgttgtggttttggcaataggattttatgatttagttctggaggacggccaaaagcaatggcagtaacctatactgccctctctgatcagtaacttgtaggactgtatcccagctggcactgagacttttgtttaataactcatttctcctggaagcagcattgtctactcacacagggtatttagagtcaaacccttttgaaaatatttttagaaactaacttacagaatattatgtctctatgagcacttttcatagcccttggctttggtctgctcctctcccactcctcctctcccctgtacctccacctccacttttaaccccagtcttcccactcctatatcttgtatcacttgtgcactaccatctccttacctcttcagacctcttcctgctcagtctcatggaccctttgtcaagttttcttatttgcttgtttgtggtggtggtgttaatagcatttatttaggtgctcagcattgcgggatgatatggcacatgtgtggtattggtgagaagggcactacagagcgaatacctttataatgtatagcatatttaatagattactgtttctgtttactcaacagcatcttgggcattaccctgtacttatgattgtggattaattagcattagatgttagaatgtaggaattgattataatgtaagagtcgccatgaaatgcttgtcacatcatttataccaggtgtgaggaacaagaacttaacttattgagtatttccttattgcccaccacagagttaaaaattttacacacctttgttatttgtctctattttacaaatagaaaggtaaaatatggtagagccttccccacaacatgagagtctcaagcataaacactgcattctacaaaccaggccatggcagttattaagtatatgtagtttacaccgactgtgtataagccacttcatggggataaatactctagaaaaagtaaggtgggtcacatgcatccccaaaatggagcatatagtgttgtccttcggagatgtcttttgagtcttgacttgtcactcttagtgttgtgccccagaaatacttaagaaaagagattgacacctcaaaataagccctttaaaagactgcttattccagtgtacgagagagttacagaatgaaaatagtgttttaggaaggttgagtcagagagtgagtggagtctggagagattttctcagggcgataaggctctgccttcagtctacaagcagagacaggcaagttggcagtggttcctccgggggaaggagcttgatctgttctgttgctgagaccctttaagttacagagggtctagtgggatcgggctagggatcgcagtgaagagcacagtgctggtgctgaacaaccgggattccagactgtgctggctttggggaggccatggtgggaatctgccttgtctcagtggttgtgaactacagcagcttctctgctttgtctgggtgggtttgagttggggccttgtgactgcaaacagcttgcactctactcatatgagtctttgggcatccagttgtgaatagcaaaaatgtgagccaagctttaaaaataacaaacttgatgtcgtcatatttgcacagctaatacagagggtttctactatcagagttcctatgttacagaatatgcttctttagtatatagccacaacataggccgttcatgtgttctctcctctttcctggcctggctttctaaggccaggcaatttgggaggcattcagatatacatgaggttttcctcctgtctcctttcccataattttctgcttgtatttcatgtatgtcgtggtcagcagcccgctgtgccctcacagcttgtaactgctgctctttgtgctctgctttctccgtgtccatgtggggagacctgctttttgatttgcctcctccagtaacggctacctgggatcccctttctagagagttcattgctccatcctgaccgctgtaacgttgttactgttctcattgcactgtaatttaggataggacataaataatttatttctaggtttggtcatgaaatgctgtaggagctcagaaaaatgaaaggattttctttgctcttttttatattattaagttgtatgaatgtaataaaaaaagagggtctgatatgctgtcatgaattttaaaataatatcctaagataaatgtaaaaaggtgttctgaattattttttattttctcacaatactgaaaattgaactcaaggcctcaagcatgctaggcaagtactccgtgaatgagctacatatgcagaccaaagttgtgattctttaaaatggtttagtttcctcatttacagtttttatttttatttatttctgaggtaaaaatgtgcattattactttgatttgtgtataagtatattttcctaaatttgtggtcattctgccagttggacaactcagctttgaccaaatataagtagacaagtgaatgtgtttgtggggtgtttgtttgtgtcttaacttacgtgggtctgtttgtttctctgttgagtgtgagtgtactttagagtcctcattgatttcatctccctccaatcttctgcggcttatggaagattcttgctcatttggaccattgctggtttcctccaaatcttgaggattaataaataagtaccgagtcatgtgacagtgctagttggacggagcaaggctaactgccaagttagcagacccatgctgtggagtttgatcatttcccaaagtgtgtgggccctgattgcagagcagagacagtaccagatgtggttcttgattgtgactctagatagagtgaaaggctattttatttaaccaagctttgaactgctgctcatgaaataaggttcaagaatcactgcttacagctgaccattcagtagttaatgcagttgtaaacagaagcaagcacaccattcatgggtcccgctatagcccacccccactctgtgtgtgtgtgggggggtgggggcaatcatttggttttcttaacaggaaaaccccattgatgctacaaactctatcttttccttttgacttagaatcctgtgttctagcctccccaacttcccagccagtacacatttatagcaaccagcctgtgttcctgggaatgtaagaacgattgttgttttctttgagcaagagctgaacattttctcttttaccagaatcctgagcatgttacgcattctcatttccaggcttactcccaccatacatgttttgggttctaggacttgatgatagcttagtgcttggtagagtgctttggctgggagaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagcttatttatgttactctatctatagttacacgtttctataaaggccattagtaaagattttagttgtttgtttttctttcagttttgcacatttgcatttcagatgtgttgaaaaactacaaaattaatactcagattttatttgaaaagttcaaggtaaggtggcttggaaagggaaattccccatagtccccaaagatgcatactcttactgtgctctactctagtgtctacttttcctggccagcttgaatcatctggggcgccatgcctctgtgtgtgtctttgaggaggtttccagagatgtctaacggagggaaggaaataagtatgggcagtacatctcccaggttcaggaccttgtctgacttttaaaagggacacttcggggagcaggaagccacctgagaccagcatccatctcacttctgcttcctgactacacatgcaatctgaccagctgtctatctggtgcagcttctgctgtgccgtcctgccatagtagactacacgccccagattggccacaataggcctttcctccctgcactttcttcctggtaggcgtttggttacagtgagaaatataatcaggagacttaccaattcttagtatttgttaccgatttttttctatggtttctgtattagtttagaatttaatttacataccagtccattttaggatattgtcagaaagatatctctaggcacatttagtatttcatggttttctaagagaccaagaaactacaagaagatgaagcaatggtttttggtctatcccttaggttctatacctggtttctgtattttaagtcttccaccaaccctgtagtacatgtaataattatataccctttctgtaattgaaaagactgggattcaggtgagcagtttgctttaggaggagtgttctgttgcggactagagacttggttgagaacacagtgtatcacctccctctgccttgcctttgttagcacttgtttttagctggtagcgtgttgaggcacatgaagcctcgggtgggtacacactgctgcttgtgctgcaggtgtcacactgacttgtaactaaagcttgttactgtaaatggcttgctggatgattctgctgtttctttctataaatcaagcttccataaatgcagatgtatctattaattttacatattctatcagagacatgaaccataaaacttcagatatttgcaacatggtctttaaacagtgtttgtggacactagatttatttgtttgtaatcttcttgtggcctttaagatttctcactcatttatgcaaccacgttgtttcctgtgccccttttcccctcaggtcagccttacagccatagaatttcatgccttagttcctgtgatatcttgtataatcattacatttctacacatcatcttcggccataccacccagaacatgcccaatctcatctgaatttccacatagccctttataggcaataatttcaaaatttccaaaatgtttattattgtttatttttgtaaacactgcacacctaactgtagcagtctaatcatggtgtctgtactgtaccctatgaagaaaatactggggaatagtttacatcaaagtacaggagaatgttagtttatatgattgcaacagttggattaaaattggatgcctcttgtcttgacataaaatgaatatgccacttttatacatcagtaaaataggaaatttgtgttcctcccacatttataaaataaagtgggaaggacagaagcacttggtcactgtcacttgcttattttacaaccattggatttaggacccattttaactctagctaattttatagagtttgtgagcatacttcatagcatcatattgtttaagactgaattttggtatttcctcttagttcaaatgttagacggctttcactgtctgtatttttctgtattgtttgctgaaagcaactcatctgaatgtattatttgctttacattactggctaaggaagacattgtaaagctttctctcttaaaattactcgttgagattattagatgttattaataaagcatttcactaactttcctttgcagaagggtttagcagatcttgttgatgaagactcctagttggtgacatgggggaaaaagtctacatgttgatattggacagattttggctctttccttagtgttaagtaattattctttgaatcagtgaaatggggagaatagtatcttctgtggagaaggaataaaacatcaaatataaaatgctgtgaaagttagtctgtgtgtcagcgtttaaggaacctaaaaggcattcggttccgcagccattcctggggccttctgatcgttgctttgattctttttgacagatggattctttctggtgccctgtgctgccaatatagcagtgatctgactctttgaaaagtgtgggcaggcagacactttgtcatccctctttaatccttgtgttggagcagtgtgtatgggtctggttttgtagcacctctagatgagtttataattctacgctattgagacggcatcaacccaccttccctcatgtgattctcaccagtacggtggcagtcgctagagaagccacttgaaaccagcattttatttttttcttagcagatcatgaacattttataagatggctagggcgtcaaactgcttctcatcacagatgctgccagtccttagtccttatggattgctggagtattaatctctatgtctgtgtaaccaatattatttcactgtgtataatggcagaaccatttcgtaaattagccaaggcacattgactcataaacttatgttttcttccagttctgcctcctaggcaggtctgactgggatctgaaaaaccgattaaaatgctagcaacttaaaattaaatggatgtttaatgcactgaaaaactattcaagctcatcaacattttttttaaaaaagattagtcttattttttaactttgtatgtatagatttatgctcacttgggtgtagtttctcaaagaggccacaagaagggattgagtcctctggagctggaggtacaggcagctgcagtggatatgggtgctgagaactgaactctggcgctttggaagagcagcaagtgttcttaactgctgaaccacctctccagcccctagccttcctttttagtctgtgtttcctatttgagtataatggcctggagtgtgcttagcttgtctattaaaaatagctggtacatttgctgatcttggctttcggtgattttcgtacctctacgttcagagtccttaaatgaatacaggtaaggaggaaagagcactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacacacacacatacacacacacacagcttgatttgtggtagttctataaggatgcttattttgagaagtgtgtttagtttatttatgatcatgaaaacttgaccattgaaaacctctaactttatgctgtttagattccagttttattgctgggcttttgaaatctgtgagaattcatggtggcagttaacctactgtttttcaccatgtgatgtttctgtactgctggggttgccagttagtatgtgccttaacttatctattatgaataaaacttcagatgaagttttaatcaagtcacttcggtctcctctgacctaggtgaggtcagatcagtttatatacaaggacgaaggacccactgttctgttgtcctaataagattaccaagccaaacatttaagagtatgcgattctttttctttttaccttgggggggggggtaatcttttaaattttttgtatgtttgaggttatgtcacatcatttctccccttcaccttttctttttccaacacctcctgttggaaacccctctttctctctctctctctagaattcatgtcctctttctattactgtgttattgtctgtgtgtattcctaaacatataaatacagcttgctcagtttgtataatgttaggtgtatgaatgtgttttcagggctgatcatttggtgttggacactcacttggtgtgcccttccctgaggaagaccatttctcctgctcttggcattgcttgctttcttacaggtttttgtctatggttgaggccttgtgagctttaccccttctatcccagagtgtctattcatttggtggtggtggtggtggtggtggtggtagttttggtgagaattcagttacagaagtttgaccattgattttagcttttaaggcaagctatagccttccttttctgggggaaaggcagaaatggagagcgctttagtggtcttctgttacctactttcactgcagacttcctagtggggttttggggtcatgcactggggagcagtagttgatgagcttagggtgtcatgtgaaagctcaactgaggatgtttactgtgaagctgctgatcttgatctttcaatctcaaatcccatcctcctcctaaaagactagaacgtaagtattctgtagcctttggacttccgtcttcttaaatctctaaggagagagagcttacaccactgagacttggggttatactcacagagccacgagtgacatctacaacttttatactcacagagccacgagtgacatctacaactgttagctggtatatgttttttatattttggttaacaaattttgggtttattctcatctatttcttctttttttggtttcagtgtcctgggtcatgaaacttagtccacaacaagctccattatatgtaagtaaataatgtgattttatacttttctgtgtttgtccacttactataattaacttgaaatctcatgtagaaattaggaacattttacatgtatgcactttgatataatgatacatttatgaatctagtcttgatttagtaagctctaaatgactagtatatgcgtggagctgaactgagaacaatagtactttactatctgaggtcgtctagtcagtgtggtaggatgctcatatgaagcagcatgccctgcaggtgggactgaggtgtctttctttcacctggagagcatttctgtaaaaatgggatggagatcttcaactgccctttgagatgttctgccttacaactgtgtaacaccatgccattggctaaaatactatttaccccaggactctggctaaaattgccatattatttccctaaaacaaagacattgtaaggtgacgtggctaaatggacaaatccaagttgaacgaggtaaattctacatagcatttttttttttttattgctgtagaaatgaacttactccactgaagtgggcaagggtgtctgggaggtgaggagccagtcagaactgtgagaagccctgggccttgtcctacagtggcttgagattgggataagctcctctggaatgggatttgagtcaccttgaaaataagggccagttagttgtttcagaagcctctgcagtttgcttaggacaaaggacagatgttggaacagtgggaagcactgagcatatgttggctgagtgattgcatacctgtgtgaaatatctcttcagaccctttcccatctaaaaattgggttattcatgtcagtgaggtgtaaacagattattggtatgctttaggaacaaattccttgtcaggcttgtgatatgcaaaaaaaaaatgctgttttgttcgttgccattttgctttttaaaaagatttttacttttgtgtgtatgaatgtttgcttacatgtatgtatgtgtgccacatgcatgccttgagcctttggagactagaagagggtgttgcatgtggatccccaggaactgtggttaatggtacttgtgagttgccgtatcagtgctaggaatgacagtctctaagttcaaggccatcttgatttatatagagagctttagaccagcccaaactacatagtgagactgtgcctcatctggggggggggggtgcgcgtgcgtgtgtgtgtgtgtgtgtgtgtgtgtgtgtgtataaaatttagtttgtggttttctgaatgataattgtaaaggagaaagtagtgccaaagagatgaggtaaaaatccttctgatcctactaccgtgggctgaaccaggtgtgaatatttgtagagtaaataatcacttcagaatgatctacttcacccatttttatgcttagacgtaagaagatgaagtctgaacatgtgataaagtggcaaagctgtgattggaggctgttttctggatgagtcagaaagtactataaacgtgctaaattttaaaagcttcattttgggtgtgggagagatggctcagtaggtaaagtatggggacctgagttcagatccccagcacagtataaaaagccagatgtggctggaagtggagaggaagatgggaagatcttgggaacgttcagtacagctgtcctcgccaatcggtgaactctagccggggtcaatgagagagactatctcaacacacacacacacacacacacacacaccacacacacacaccacacacacacacacacagagagagagagagagagaggatgagaaagagaatatatgaatagctacaataataagcaaaaagcacaattcttttaaagaggcaagaatcatttttaagggttcttattaataaaacaagcactttatatctgacagtctgtgtaaaggaatcaacagactctacagaggtaaccttaggcttagcttacaaatgtctgccagcagtcatagtcaatggcacggtttgttgtgtctttttgaaaagaataagagtatattccactgtgaatggactaaattaagaaaagcaggttcagtatatcagtatattaaccagagagtcagttctctgcacctagaaaacgaagtagtgagcaaaagatcaaagactatgttgaagttttcttttaaattacatatttgaggtctcctggggtgttaggagcagaggagagaaactgcttcaaaagaagaaaaacaatcctttcatctcttagttaaggtaagcagacaggactccaaagaattactttactcagtcattgagtagagtttcatacaaaacaatttgcaatagttaaaaactgtgaggcaggcatagtgccacatacctgtagtccccggagtccttctgctggatgcagaaggatcaccatgtgtgtgaggccagcctggttacaaagtgaggtcctgcctcaaaataggagttatacactaggcagatgcttgtattgtgaaataatttaggtgaggccgccttaatgcacagttatttcttggaggaaatgttctggatggatgtagagtctggattgtaagtgagaccatttgctcagtgtgagtatgttctccttccctttcatgttagttcttgtgtgtggacagccttcatgttaggtatgtgaattagatcagcaagggatgcactccgcacctccacagaagtagtgttctaggatggattacaagatgtgtgtaggttctatcaagtgggggtgattaaaaatggtaaaaatttgtgggaatatccttttctatgcgatcttgatagtataatgagagtaaaaatggaagacagaagtagatgcaaacagtattttagaataacaagagaaccaatgctttatttaaaatgagaagtgaaagtgtgatgagtgattgatgggactgagaatgagtgtgacagctgatgccgctgtaagtgatagtgtgggcagaaggaaatgctcttgttctttaaatacaaatggcacatagctttcctatgagaggctgagcttggaactcaagggtgaagaaatggagtggagatagtctgtatcattcaactatgagaacagaggagctctttgagaaggtaaagaagtgggaggtgtttgagtagaggacagtcaaggaagaagacaaaggtgaatcagaaggagaaatccagaaagctttcaggaatatccagcaagagatggatgtgtcccactggacaacaagaagtggatccagatggacctacctgctggatagctgttgagtcctggcatatctatggttgcctcccaacacaaaaatcatgaatctgaaaaattcgatcatttgatttaatcaggcatgaacactgtacaatgttatgtaacagtgtcaaagtttgggcatacctacaaattaataattgcgctttcagcattttattcctggaataattaatgtcagtcacacatcaggattagacatggaaattaggatgggactggggaaattcattctttaattcaggtgccttgcttgacccagcacttgttccagataatggagattgatccatgaaccaaacagaagccctcttggcacttgtattacagtaaggagaggaagacaactgatgtagaagacactttataaagagggaaaggtttttatgaactgtataaacccagaggatatgatggtgcctgcctaggggctctttgggattgggtggcagagaaggcttctgaggatcttgatactaagcagagtcctgggtggcctggaggagtacatatcttcaagagcaccaagcagaagctccctgtgaaactggcgtggtgctgtggaggagcagcagaccgtgcgtgggcataatgagcacatggctgggaagtctggcctcctgtggatgaggttagagacatagggaataagaggaagctagattttgtcagctatcagagacccttaggtaatctccttagacctgccacccacacagtgaaggacagtgtttgctctcacatgctctgaaggctaaccctgcaacagcttggagtctttttggatgctgggatttattctaataagcatgcgctggccttgggaaacctggatttttaggtagtttaagcatatgtattttggactacacatttgagtgaaaatagtttatctagtcattgagatcagtgttgtagttgtaaattgattcttttgaactaaggatcaatagtttaaccaagaagctaacttagaacagtgctgtcaagattctgcttttggaaaagttctttcatatctgaattactttgtaagggtatgatagtaaatctctctctgtcttttgtttgtccgtctgcctgcctctctctcagatcaatttctcccttgttcttctctctaaacccgctgatatactcctccctgcatatatatttctaaatataaccttttcagccatataatgttacttgtatgtgtgttttcagggctgaccatttgacatggggttaagcagttggtgtgctcttccctagggagggccacttctcccactcagcttccttcagttgcctcaaagttgttacagcggttaatcttgattgtggatttgacaggatttaggagacaagcctctagatgtctgttagatgcttaactgaggaggaagggcatgtgagtgtggatggtatgatccctgtgggttggtcctaggctcaataaaaaaggagaaagcatgaccaacattcatttctctctggttccttaattgaagaaattgcccatcttctacagtcttgctaccattatggattgtatttctttttaaaccatgagctgaaataaatctttaaagtttctttagtcatgtatttttttatcagagcaacagaaaaagttattaataactgaaacaaaaagggaaaaacatttccaaaatttgtttagtccatttgtgaacctaagtggtggttgatactattttagtataatcatttcactctcttctttctttgaagatcgttggtaacacactctcatttgtgccactggtaacatttttagataataaccctttaaaaaaagaaagcttattcaggcagtacccaacagttaaaggcatagcatacctatggcatttagatctcacagcacatttgtgacgctggaaaaccgtgagttcaagatggttcattttagtgagtgggcaggatagtgcattttctttgttctgtatatcaagtgattaggaagcccacagctgttccattgactgtaaaaatcttataccatttgcataaattaaattcttttgtcttttacagtttaatctgtttcattttaacatttttaattatttcgtttgaaataagtttaagtttacaaataagtgatacaacctctattggtcactcttagtgtcatctgcttatcatttacattgtgtttgtattttgagccatttgaaaagtaaattatcccatccttatgtattcctacatgtatttcctgaaactatgatagtttccttcttaacctagtacagcaaacaaaaatggaaattatatcaatgcagtgattttaaataatctaagtccatattcagttatttttttactatctcaaaattttgtagccctctcctcctagctcaggatttcatatagcattagaatgtggttatatctcatttttctcttaatcaagaaaaagtacttttttcatactgagacttaagaaaaacataagccatttatttttgtagcagtttggctttttgtgaccctttcctctgattttgtagagttactaagtaaacagttcccttcttttgttaactttcttttttattgttgtcttgatgtagggtcttaatatgtagctgtggctggcctgaacatgctgtgtgtagactagggtggcctgagactcagggatatgtgtttgcctttgcctcccctgtgctgggattaaaggtgtgtgccaccacttccagctggcatcattcattcattcctaagtattagagaattaactttttggtctcttgcttaagctagtgaatgaagtttcataagatggtatgataaattgctcattttctctatctaatgttgtctctagtttggaaccaccttttgatactggatttcctgaaatggggcaaccttattctctgtaagatatatctctaactgccatatccagggatccaccccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctannnnnnnnnnnnnnnnnnnnctacttccctttttagtctagtatggttttgttcatttccatcacctgtttggatgtgttttcctgtttttctataaggacttctacctgtttggttgtgttttcctgtttttctttaaggacttgtaactctttagcagtgttctcctgtatttctttaagtgagttattgaattccttctttatgtcctctaccatcatcatgagatatgcttttaaatccaggtctaccttttcaggtgtgttagggtgtcctggattgggcgaagtgggcgttctgggttctgatgatggtgagtggtcctggcttctgtttgtaggattcttacgtttacctttcgccatctggcaatctctggagttagttgttatagttgtctttgttaagagattgttcctctgttgattttgttaccctctatcagcaggcgtgggagacaagctctcttctctgagtttcagtggtcagagcagtctctgtaggcaagctctcctctttcagggaaggtgtacagttatctggtgtttggacctcctcctggctgaaggtgaaggcccaaaacaggatctttcccagaagctgtgttgctttggccaggaaggtggccagttgtctggagtcgaagatgtcgccgcctgagaagctctgtggctcttgtccggaaggaggccggccgtctggagctgaggatggtgctgcctcagaagctctgtggctcttgccgggaaggtggctggttgtctggagctgaagatggcgccgcccagaagctctgcgactctcgcccgtcccagaaacggctggcactctgtattccacacggtcacccgtgcagcctgccctccgcggagtcccggagccaagaaggctcccgccggcgcctttgccacaaacctctcaggccgggcagacccccgtgctctcaccaggaaggtggccggctatctggagctgaagatggcgccgcccagaagcttattctgattttgaatgggaagcgtctgccacaggttcatgtgtttgaacatatgatcccatgtggtggtctgttttgagaaactgaaattttataaggtggaacttagctggaggaactgggtcattgacatgcaggcctgttagtccaggctctctgtaggccccagtagtctctgtggtgtggctgttgagagggtagtgagctttcccatgtgcccactctctggagtcactgttgccatgccctcccactcacaatggactttgtctccttaaacgtggagctggaatgaatccttccacccttaagttgctccttttgtggtgtttggtcacaacagtaagaaagacagctaatgctagtgccagtagggagctcattataaagagcacattacttgaggttggaacagaactttgtccttacctttgtgggcatcccagcttctttttttcttcgtttttatgtgtatgagtgttttgcccgtatgtatggttgtgcagcacgtgagtgtctggtggtcatagaggccaagaaggcatcagatttccttaaactagagacagagatacctgtgagtcaccacatgggtactaggaaccaaacccatcctctggaagagcagcatgtggtcttaactgctgagctatctctccagtgtcttgcatctggttcttaacaaatgtccttcccaactgagctataacaaccatacctaatatggatgcagtaggtaggtaatatggatgcagtggtcatagagcaagtgaagaagcacttcagataagattataaaacttttgagttgtgtgtgtgtgtgtaggcccagctggcctggaactacctttagaccaggctgaccttgaacttagagactcccctgacactatttcccaagtgctgggattaaaggtgtcccagcgcttgccagtatttaatgagcacatgcatgtgcactttggtcttcttgctctgaagaataaaagtatggccttctcaagaggcaaagagtgagggatgctgttacacagtcaaaggaaagccaggcacataaagggaaagtggtgtttataaaacagctagaccctgctatatgctctaccactaaatactactcgatataacaagtggacaccagtaacagtaaatacatcctcctagatgaacagctcaaaatgaagccagatttgcagatgttaagaggaaagggtctttgttgcctcttaggcctaagatacaaagaaacagtaggtatagggggtcaagacttaggagacttggaataaatttcttagtttctatttggggatatggtggagaatgaatatgaatacatctttagtactttataccaagtaaattctttatggtttactctgtatgtgggatgggctttgtgtgaatgtctaggccgaggaataatttggtcagccataggaattactgtattttaggaactgttgattgtttcttctagaagagggagcaaacggagcaataaagagactgaaggaattgcctgtagttttatagtgaccagatctgatcaggtcgcaaaatcttcagcttattagcttattcattgtgaggggcacaggacttgggttaatttgattttaagacaacatgcaaagagaagttgcaggataagaattagaataaatgtactaagagaaatgtagcaattgggagactgggggtaaaggaagtctttgaatagcaccttgaatgtccttggtagaacgaacagacaggtactaactagttagttcatgacatcttcatgaactgtagaaagatagaatagtgtgtcatcttcatttgaaataggtgggagaaatagtctaaatcatattttgtgaattttggcatagttgagtcgccatctcaggcaagtaattaattagccagatacttcatcctactcaaagcatccttaaaagggtgatgagtttttagccctgagccagcacggcgaaggcactacaacattaaggtaattctcagaatgcatcttctgcatttccaggtgctttttctgtattagaacaatattctttactggtttctgaagtgttctagtgggctctgagtcttctgtggttaatgctatttttagctgtaactctagaggagactgctgtgccaaaacactctcccagatggtttatattggatgttggcaatttgataaaatgaccagaacacatttaaggaggagaaagtaggggtgtatttctcatattcttctgttacaaattgcctttttatgcctctgaggctgcctgtttacttttcagctgtggggccatagagagagtctctatcaactcttttcggaaacacacagacacccctccgacagagtaaatgcctttaaaagtaccagtcacacatgagagagaaattcttttccaagacaggttccaaagcagcacatgggttaataatcattatctaccatatgtttgggataagactcttatttattagattttcaaggggaagagccatttcagttgcaaaacagattcccagaaccccaacaaatatggtttattatgttaccctctctgtctttttcccctggtaccaatgtttttgaatgaatagcttcttagatgagacagaaaacatcctgataattgacaagtattatatgaaaagaatagccaacactagatgccttttctcatttaagttgtgaaaaacaagactgaatctagtgattttagctgtttttattagactaatccacaagctactagtgtctgcttaaaaaaaaaacaaaagcaaacaaacaaacaaaaaaaaaaaggaaaactctctcaaatgttatttccagttggggaaaggtactatgggcttgcatttaatatacattgcctcatatgctcttcacagtaagcatataggatttggctaatgtttccattttatatcctggcaagtgcgagtttaaaagtccgccagccagcctccccagtggacttgtgttcaggtcttagataggctcagaagacctggtccatttgatctgtatctgggtgttgaggtggaatgacttagggcttccacattggatcttttcccactttggatttgttttcagcctcctaacaatgtgcactttgtccattggattgatgtgcttgtccgtgatagttagaatagatttccatctaaatgccattagaatcctcatttggtagcgcctatgcagatactatgttcagagagaggaacttgtttaaaaaaaaaaaaagaggaaccacttaaaaaaaattcctaaatgcagtttgcgtaagacaaatttgggaagaaccatagaactaggttacctgtacttaaatgttctcagtaggaaagaggaccaatttgttagtgattccccttcccactcccactcctgttcctgggaaacatgtttccataccggaactaaaagaatcttgactcactttacagttaggctacattttgtaccctgagccttgttagcattctgacctcttaagtggattatctgttgtaacagtatatttctggtaggccttgcttcagtgtttcactgtctggggcactggccagccagatctgagaattatatttaaataacagtactttgtgaatagtttcagaaggtataaggaaatcaactgttgctccatggtatggttttataaaggcaaatactatttctgttccatctgttggactttctaaccggtttccagtggtttgagctttacattttattttcttggctttgttagaactaacaaagatgctttttggtgactatttaaaggatacattttataatagctttgtgtttcctaagctttcagataacaatgaggggagttaaattttccatttagcatttgaagaggagtcttgctgggcactggaaattaaaacataatgttctgtatgcttaattcacttaagtgggtattatgaagtacttgttacatgaatgggagctttggactgaattctttgattgggagacagaggctcaaatacatgactgactggtaaagtactacaagcagtagcttgttctagacagacagcaggaggagatgctgcagaactgatggggaccctcagaaaggatagcttcgagaacaccccacttcagacgtgtaaatgttgggcttggggccagcaaaccagaatcctgtaatcctggtgcctactaaaatctagtcatgaaccaactggacaagaaggttagttttaaaagcccctgatgaagccgggcggtggtggctcacgcctttaatcccagcacttgggaggcagaggcaggtggatttctgagtttgaggccagcctgatctacaaagtgagttccaggaaagccagggctatacagagaaaccctgtctcgaacaaacaaacaaacaaacaaacaaacaaaaaaaaaaccaaagcaaacaaacaaaaaaagcccctgatgaattaaatcagagcagtttgggttggttaatgtcttccaacatggctgataaagcaacccatcacatataaacaaaaaatggttatgtagattgttatttcaaaaggacaagtgcctaacttctctttaaggccagctttctgagtagactgttaatagattttgaagtcactgttaaggtgcatactattgattaatttcctgcaatttgtctctggtgtagttacctcacatcactggtaatggtgactttcagaggactgctttgttactggagctagcagttcacgttttgttttgcagtaatttttttaaatgtcattttgaattttgcacaggttcctgtgtggatgtagatatggaagcaatatggaccatgatgcaaatagacctgattccataggtttttttttatttgtctgtagactgcctatataaattatgcagcataaatgcaagcagtattttgacattagcattttaagtttaaagatccctactatgagtggtgctatgttgagttggtggaatgccaggtaaaaagtcagttccaaatgtactgtttgttgcttgccttgaaacaccatcacctcctcctgcccccaaatacacacactcctaccaccaaaccatttagccttcagggattaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagagatgaaactacacaggagaacttcgtgatctggagcaagtgacagagtgttccgttgttttgacccctggggtgggtcctttagtgagaaggaactacagagtgaggctgagcatacattcgagttctcgccaagctgctgtcctggatctgttatttacttggaactctgtgtgtgctttcttagtaaccttgttctactgctctgacaaagcagtgaattaggaattgttttctcattttatggaggaagaaattggggtaggatttatatttaaagttaccagtgtgtttgcttgaggatggaagttttccattgcttctttgagacatgctttgtcatttgaaagtgagaccatcaatttgtttttaattaaaacctttatttatgtgtgtgtgtgactgtgtcaactgagtgcagaagcctgaaaaagccacaagagggcatcagatcctttagacctggagctgtggcagctgtgaaccacccatggccagcataggtgctgaactcaggtcctctagccatctccagcttccttgttcactttcttaaaaattaattatttatgttttcatccattcatccattatttatttattttatgtgtatggaagcacacaagtgccacagtatgcccatagatgtcaagaggccaacttgcaggagttaattctctttcttaatgtgtgggccagtgggatccagccaggtctgcaggcttgggtgaaaacacccttactcactaacctatctccctggctctgtttactcctttttaaaccaagaaagagctgttggctcttgtatatccttggagcccttcacaaaactctgtttggattaactgctgaccccatgtgatatacagagcatctggcagctggggtggaattctcagctgtctctctttgttttgtccacagaaggaaatgtgagttttatcttactgcttgggcaatggtacattccttttttggttcatgagacccaccagtctggatgtgggttcatttcctaccatttttgttatcttgcattagtttaaagatcaggaatgaacataacctactcttaatgagcataaaattgggaggcatctctggtgtaccaaaattctattttgaggtttagctgacgttgtctagttcatccttgtattaaggaaatccagggagcaaaccctaagaagctaggtctgcaattttatctttcccttactaaatctgttttctagatctcggtgacattccttattcttgccacatctatgggcatgattaaacattgtttgtatcttactcaaaattaactgtttttatttcttgactaggagagagagacagatgtttgaagacatactacactgaggttgaaaaccatagtttttctggatagtatagttgagaatactgccttttttttttcagatgtgatatatttgtgtgtgtgcaaatgttcatgcacactagtgcatatacacatacagaagcgattggcagaaaagtatattgtagttgtaatcatatacacctctgattatttcatgcctggtagtacttatatagtatgctgtgttccctacttaattttcttttgtaatcctaatagcttcatgaaatgactactctgtattagagagggggagacagtgtcacagcacctgtgtcatttggtggatcatgcagctagtaagggacagaattagaaccaaaccaggtctctgtcagtccctacaaagttagcaataaatatctattctgacttcattgggtgcctgatcagatttttggagagtcttctgtgccttctagaacgtggaggattaacttagaggttctctgaactgcttcattgatgactttggagaaggaaagataattcataaccaagtagataactgagatctggctgagttcaatactcgagccggtctgcccccttctatcagctgcagagtaggaagagcacagcttaagtagcttgctctcacggaggggaagaggagaggagtggagagtcaaggaagacggatgttacctaccagctgtgagctttcctaaacgaaaattaataaacaacaacaacaacaaaaacctttgttttctgcactttaagcaaatatctgatcctgtttaagaagggagaatagactgtctctttacatgttgacctaattattgtagccgttccacgtagttatgaaacggttctaagagaggagacactgctttaaaaaaagaaagatagatctgataaaggtggatggagaggtggtgggagaatggaggtcctcctggggataacagactgctcagggcagctgggggtacccagtggactcaccaagcagggaagatggcttggggaaggtaagctaacctgtatggttcaggatccacagtcctggtaaaggtgggcagagaggttgccaggagaatggaggtctgccgggatagcagactgctcagggtagcttggggtgccccagagatctaaatccaacactctccatccagtttagctgtgtttatttagcaaaaacaaactaaagtgagctgtgtacagcaacagaaagaattggaagattagaacttgaggaatgctgctctcgtaggggacacttacacacattaaatgtattcaaaatggtttgtattttatttccatttcatcttaaatctcaaaattcttgtttgggagagagaagtggatttattgggcgccatctactggttttgtctaatagcccaaagaagtgaagcctgcaaatggctaagaatttgcttcagtattggtgacgcggaattcgaagctggaagacagtagcaactttattagtagtggtactgtgtgagctgagttctgtttacattgaggagagggagacttttaactagaatatccgagaacatgttaaaagaggaagactgctaagtgggtttaattggccattgtcattatctggcaaaatagaaacatcaaagaaactgtataatattttctaccagtgaagtcagtccaagcctgtacttgcaatgacctagttggtagtaaaatcagtgaattcctcagttgatttctgtttatgttgtttgaggtgcttttaagtaaagctgagggctttgcttgctagttgggagtgggctgtacccaaggctcttggaatgtgtctgagcactttctctttaagagagttggtactaaggacaggggagatcctattatgtcttcttatcaggagtgtttctgagtcttggttctttttaactgtcattttatggacgtgagctgaaatcttttcatcctcatagcattatattttagatcttttgatttttttcatccagttatctaacctaagataaattggggagagagatttgcagagtagagttaggcattcatttatccagccaacattattgagcacttacaatcacgcttaggcactgatactgcattgaataaaacaagtatgcccttaactcagataaatatgctgtctaaaattctgtacatcagtatactgtatatatgttaaaatcatgagtcatatcattacaggagaggtaaagcaggacaaggcaggtgagaggcggggtgggaaagctcttactcatccccacactcttgaaggatggtgatcattagcgtgcacgatgaacatatgtgaccttttccagcgatgtgtagacttgcatggggcaggagatgtagcctttccatggccacccttgttagtgtccgatggactgggaactgtggtcctggagaatggattcctgatcctcaagccatggcacattgcttcatgactgtgccatttcatttactttgtggttttgcatacatcctttcaagtcctctgaatggatgtatcctttgtctattcagttcttgcctgagctccccatttaaagattcatgctctttgctttctttaataatctttctgttctatagctggcttatttatttccctttctttctatcttgctcaggttatagcttctgttttggttacttttctgtttgcctgagtgactcctactctgtcaggaactaactcttcatgtgtttctgattgtctttggccaggggcaaggtagtgtgaacttcactaaaatatatgcagacttttctgtccgtccattctgaagaacacatagcatggtttcacctaagtaagccaatacaggggtttggctgggacagtagagttcttacccagcctatgcttcagcactagccatgtcacattttcccccaaaaggtttttagacaaggagtttacagtcgtataccctgtaaatcactgcctaccatctattttctgaaacaaaatttcattgaaacagggttatatctttttaattttattaatctatttgaggggaactatgagtctggaagctagaggacagtttgtgggagtaggttctcttcttccaacctgtgggttctgtggatctggtaaaggtctgtgtagagagggaaaggattaaggggcagggttcccacaagtaccagatttaccacataagccatttgccagactatccttgtttcaaaaagagaattgagtaattgtgagagtaatcagatatgttcccaaaagctgaaagtttttactatatagcccacagaaaacattttcctacccctatattggagttgaggtcaatcatgcatggtaaagactctgttctgacctttttcgtagccttggtcttctcagagaaaggctgttcatcttagtatctggacattagcattaaaacagaaacttgttttatggtattgtatggtacaaaaagaaaggcttgcccctttcttgagtccaacttccttttgccatatatagttcagactccagtctttctgagttggtatggattccactcaaagcctaaggagaggggggcggtattatggtttacagtgcaaatctctgtgacagatcccagcctgcttctggagaacagatgtccacccatacatacaacagcaactggctagcgtagtggcagtggtgcctgctttccctgccctccacccctgctccctgtatcagacttcactgcttctgaggacaggcatcattggctgtaggggaggccaagaagcagtaagttgcaggactgggccacagtttctaggaggagaaattggcccacctgtctatgactggagactctgtggcatgttgcttctcacttagtattttcacgggtggactggagcaggttgcacacaaagcttgccaagtaggaatgagctagaggaatagagaactgcctcttttccttggcacttggatcaggtctcttttaaagatgggaaggaggtgtgtgttcctggggggcaggggtgtgtgtgcaggcatccacagcctcccgagtgaccttcctctctctgtaatttctgtccggtagtatttccctcacataagaactggaattcttttaaaatgtgaatcatgtttctgcattacttgcccctcctcctagtggtttaacaccacacgtaaaacaaacaaatcccccatataaagcactccaaagttatgttgcctcccattggtgtgtatttgtgtctcctgactgaactttgttccttgttgatgctgagtttgtgcttgccttctgcttgccccattcttttctctgacctgatgccatcaagaatcagtataaatgtaacttttcagaggaaagttttcttaccattcttagcacactttgtatgaaagtgtttctcccccctgcttcgtgcacacttcagcctactttttttaagttaatcttttccccccacaaggggattttccctttaaggttacattttatgatctgatttcgtttgactgcctcaagctccttctacacagactgttagagtcagcattccatacttgagcgtcctgcgtggtagcaaataccctgcccctgaggagtggaggctttgtgtgtgagcacacatgcattccctccctctctcctgtaatttgggtcccataattaaattttgtggtattattttttgggataactttcaatataaggaatagctcatgtagatggaaagtttatttatttcaggtttgctgttgttacatggcatggtgaaagttctgtcatagctagtgtttacagcttctcagattttacagctgtttcctgtacaactggatttagtctgtaatttctttcatctcctcccttaccacctttgacaattcattgtttgagaagaaattttaagtcgagcaacagaatttgtgtctttgggccccttagtgacctgtttgagataactctgtgggaagcctttctatctattttgctcagtcatgtcaagatctctcttaattcctgaccctgatcctgtttttcctgcagtgcctcttattcagctgtaggtacgtacagctttatggatcttctccctgaaggaagggactgtgagcccgaaaggagcaagaattgtcttgtctctatagcctcaggttcactcacccacatgctctcccatgtctgttgtgagaagaaaggataagacttatccacttatgtgcagcatgttaaggttcctttttaaaatatgaaatatttcgggttcggcttaacaaccattgagggctataggctaaccacgttaaagagttgttgagtgcaaatgcaaactagtgcttcctgttactaagctgtgttgtgatgtcatcttctgggcttgtgtgtctgccttaaatgatctgccttgagcctggggcatcatgggccatagtcttgtgtatgtataatgtataaatgtatagactcagtcttcagtaattaagtactatttaagaagaacgaatgaggattgtggtaatagagggtagacaaaatggccctatcacctagcctgatgacctgagtttgattccacaaccccacatggtagactgcacgtgatcttagctaaaaggctgagaagcgatgacacatggtagactgaaggagagactctctccacatccaccatagtgagtgtatgttccttgcccctgtatagcacagtaataactaatatagtagaaaatcactaagattgtagtaatgagaacagaatgaaagggaaagtaatgaacacatttgtgtcagataaacttctactagttaccttattaggtagacctagactgagaacttgtactagcagcaaataattgaaataaagtaagatacatggaaggaaatgttttggtaacagatttttttttttaaaatcttttatttgttcttgtgtgtgggtatatatgcatgagagtccagctgtcctgcaagtcagcaatggcagatcgcccaggatttgcaattacaggcggttgcaagctgctggacagggttgctgggaactgaacttgagtcattggcagagcagtatgtgcttacatagtcatcagcttcactgagtaaaggggtgtgccacacacagttaagactcttacctttatataaactagctttaactaattagtaagactaacagttatatcttgtccagattatgttgtcttcaaaagacttttatttttcccaaccactagtatcattaataacagactgttaaagagaaataggaaatattttaagtgaacctctctgttcatttttaacatctcttttggtgtttactaatggtttgctatttcatttatgtaatttttttctattgataattaatacacatttacacacaccacttttttttcatctgtgtttttggcctttacttcaggattaaaataaaggtttgggaattgtgcttgaatttgaattgtgacccattctaatttttttctcagacaagacattgaaataagcattctgtgggccttaggactggagggatgattcagtggttaagagtgctttactgctcttgcacaagacttaggtttggtttgtagcaccacttgatggctcatagccacctgtaactccagtttcaggggatctgaagccctttctgacttcttcagactcctacatacatatagtgcacatacatacacttagacacacacataaaataaataagtaaatacttttctcatcgctaaactaggaataagaatacccagtagtatcacattgcatatagttcagttccaaactgcagcaggcactcagaaagtgacagcagtaggtgcttgctcatcttccacacactcaaatgatattaactgtttaagaaacaaatttggtgcccaagatgctgtgctgtattatttacttatctatataccctcgtaagggacagttgtgtgaaagcaaggacaacctgcatggtcttgagttcagggcccagtttacagagggtagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcttttttttttccttttttattaggtatttagctcatttacatttccaatgctataccaaaagtcccccatacccacccacccccactcccctacccgcccactccccctttttggccctggcgttcccctgttctggggcatataaagtttgcgtgtccaatgggcctctctttccagtgatggcctatcaagagagagttctaggttcatctaacggacactgacccaggcctggcaccacccattgtgagaagcctttgtttctttaactgaagaatggtactactaatgactacggtctgctctggcttcactactgtcacagggtatttctgtgttgtgaaagcttttagtgacattgaacacttgattgagttgagtttataaggaaaaaggctttgcattgttgcctttggggaagctgtatgaggccatcaagttttgcttgctttaggaaatgatttgcaaaatgataacgagtgtgtgtttaaagcagaggagcaaacatggttgtgtcctcgagttgtatagacaaggtagatctgtctcttcccttctcttccatcacacggaaagacaagactttggagcagtgctcaggttaatttactattaccaacttcctcggtttcactttcccttgtactgtggtgggcttaaaccttattttgggaaatcgattttttaaaattgatatatttaaagttttattttaaaagtatgtgtccgtgtgtctgtgtgtctgtgggtttggtcatgtgagtgcaggtgcctgcagagggcagaggtctaagattaccctggggctgcagttagggattgctgtgagctgcctgatgtgagtgctgggaatggaactgaggtcctcctgccagagcagcacatgctcttcacctctcagccatctctgttgcccccccccccctgtactcttccaaaacatttaaagatatgttgtagtcattatgttattttatctttaatatttcattatgtattcgctgaaggcaaggaacaaggatactgtcatatgatcaaagcataattagaaaaacccaggaatttgaacattgatacaaaattaactatgtaaatcttattcaagttttgctcgttgtcctaataatgtaataacaattataaaacaacattcagaccaggatcatgcattgtatatagctgggaagtcttttaaaaatatatttattaattatttgaggatttcatacaacatattttgatcatacttattcttcttcccagctcctcccagattcacccccaccccctatccattcaacttgttctcactcttttttttctctctctttttttaattaaaattttttttcctgggcagtggtggcatgtgcctttaatttcagcacttgagaggcaaaggcaggtggagctctgagttcaagaccagtctgatctacagtatgagttataggatagccggggctacacagagaaaccctgtctcaatattttttcccataacatatattttgatggcgtttttctgttccctagatccttcccacctccttacccactcaactttatgttctgtctctcaaccaccaccaaaaaaatacaagaaaacaaaacaacaagaaaaaaaaatccaagaaataagaccctcacaaaaatgaaaataaaaacaaacaagcaaaaaaaaaatcaataagacaaaaaaatgttaaaagagtccacaaaaataccactgagttcattttctgttgaccaactactcctagtcaacccttaagcgtggttgatatacccaatgagaatgtgttggaaaaaacctgattgttctctttgccagtgggtatccgttgcagacagcttcttgattagggttgggacccaaagtccacttctacctttcagtactggcatcttgtccatcttgaacctgtgtagaccatttgtgtgctgccagtcttcatgagctcatacgtgcatcagtcctcctgtgtctggaacatgctgtttccttggagtcatctgtcaactcttagaatctgtctgccttctcttccacttcgatccttgaggcttgaggggagaggtttgatgaagacatcatgttgaggactgagtgtcactctttgctcactgtccagttgtaggtctgtggaaattcccatctactgcaaggaagagcctccctgatgtggcttgaacaaagcactgatctgtgggtacagcagcatgtcatcaggagtcattttactgctgtgttccttagcagaaaaatagtagtaggtttttcttaagatttttgcaaggcttggggagatgagagaagaataatgaaagcaaatagtgtgctgaaatgtgataatgaatcctgttaaccttgcatgccaattaaaaaagggaaactgccacaacagactccatgttgtcaaaaagtggaaagatgacctagcgagatggctcgatgaataaagtgtgccatctgagtggaaggctgggatttgaatccctagaacccagacgaaagctgaacccagaacccagcctgcctgtagtcctagtatttatagccagggatagcggcttcctgatgcatgatggctagctagactagccaaatggatgaggtctgggttcagtgatagaccctgcctcagtgaatatcgttgcttctacatgcatggacccacacacataaaagcgtacatcttggcatgtatgcccatttttaaatgcccccaaattcagaaataagacaagctcattaaaagtgcctttttattctctaggaagaactgttctcaagttctggtggcttttcccaatatgtactaggtactttataatacaactgtattatagatgaaaattatatcactgaataaaaggatttgatagagtttacagtattacaatattgatttcataattgtctcataagtactttagactagaatttttggaacttgaatttattttggggatttagaatatttgcagagaagcgattagacttgttaaacatcccatatgtaaaagtttgaaaccagaaatgttcccacatccaaagctttttggtcttttgttgttgttgttgtttgtttgcttgtttgttttttgagacagggtttctctgtgtgaccctggctgtcctggaactcaatttatagaccaggctggcctcaaactcaacagagagccttctgcctctgctttctgaacgtgaggattaaaggtatgcaccaccaccatattccaaaacatttttattaaaataaaagtattagttacttttcctccatcaaggtcagactttctgagcctccttagacaaacaccaccaacaactggaagccaagtatttagtatctgagactgtggagggcatatcattcacaccaccacagggacagactggtgaaccaaaaagttaccctacaggtggaacaacaatatgaactacccagtaccccccagagctcatgtccctagctgcatatgtatcagaagatggcctagtcggccatcattggaaagagaggcccattggtcttgcaatctttatatgctccagtacaggggaacgccagggccaagaagtgggagtgggtgggtagaggagttggggggtatgggggactttgggatagcattggaaatgtaaattaagaaaatatgtaattttaaaaaatgtttaaaaaagttttctctgtttttggagcctttcagatttcttgactaggcaagctccatgtataatgttggtgctgttggaatgacggccgatgcagttgctgcaagtgcttttttttcatttcttttttaatcagtcattggattccttcagtaatctcatgagctaagcagcattactgtccttctttacagcgcagggtatgtaagtaacatactgccaagttgaaacaggtaaaagggcagcgccttagctgggcctgctgtggaaattattcaccttcctgccttttgctgaccaggtggaaggacttgttgcttctaaaggggaataaaaagctctcataatggttactgtcaaccattgtcaacttgatagaatttagaatcacttgggatatgagcctcttttacctatggagattatcttgattatatgaattaagctggcgagaccagcccactgtgggtggcacggttccctgacttaaagggagaaagtgaactgagcagtagtagtttgtaaacatttgtaaacatttgtttgctttttgtttgatggaatgtaacctgctgcttcacgctcctgcctctgtgacttctctcccatgatgtattgtaacctggaactgagctaaagaaatagccctttctcccttaagttactttaatcagaattattttatcacaacaggaaaagacagcccttgttttgtagcatttggcaattttagtaacataattttgcctttaagggttgattttaagctttccctccctttttactgaggctgaattggcaagcaatgaatcctgggaaaaaatgttagtagcacactattatgtaaatgttcttccatatgcagaccataatgtaaatctcaagatattatagtatgatgtagccttaataatacagggcttttaggtattatatatgcttttaattaatctattttagttatttgtaagtttaatttctaataataattgtgctctgcagttggcttatagaattcccagaaatttaacagctgactctcatgagttggcccaagctattgccatagtcatcttactgctgaccaaacttaccttctgatatgtgtggccaacattatataagacatcagtgatttctctcttttaccatttcttccccccaaatttccttcttcattttcctgtatctctatttaccctgtttcccacatactgtctcttcagtccacttctacagtataattaattcacttctgaaatgcatagctcttttccattctattacttccttcccccaagttattcctgcttattgaagaaaggtcctaggtgactagtattttgtggaatagagtctttgccaaggtcttgtagagaggcaatctttggtatggaaaaagaacacatattcttggagttctggtggagagtcagagttaaaacagtttttatctaaatcataaggtaattcttgcattgctactactacagtaacttctgtataagtaagtaaaagatgtgggcaactgagacgtcccaccatttataattctttagttttttttaaatccttatattaaaaacccatttttatggataattaagcagtttttttaatcactatacatttttatttgggagatcatctatgcttataagataatgcctaatatagactacctttctcattagttattgtgaaattatggccctaaaaatgatcaaactcaagtatacacttctcattaatgaagagagggaaatttttgtctttgtaagggctgcactgtttcttaggcttatgttgctggagattgatggcataggtgcagtcttttcttgttgttgggtctgactaaaatagtaattgagaatatcttgaccattatttttgttattcagctcatctgtgtagttagcagtgtggcagacttgttagctgttcaaccagactcgtcaacctgtgtattctgagagttgggcctagttttgaacaacagagtgatcgatcagagcttctctcacagagagtagagatcaagtaaccagtcacctggataaaagttctgacggagatctgagactcttctcctacatacaaccaagcccgcgtgcttgatctttcagagtcatctccagtaacactaggtaactcgtgaacttccataaaataggagttctatgcacctgggaaatgtggagtgtgtttgctctctgttactattagagggaatcaactacatttagttccaagtgcctttggaactcagcctttgaattgccttgaggttagtaaagctttgttctcttctcttgggtataggttaaaagtatgaaaacaattcagaatttagtaattttgtattaatgctttgttaaaaggatgtcagttgcttttgtcagccacctcttgccctcattgaaaggaagccccaaattaactagtaagggcacagacagaacctcagcaagaagaccctcctcatgtgagagaagttctggggtctgaaaagaaggattctgtcttagagtgccagtttagaaatctaagttagaaatttcagttagaaatgcgagtggacttcctctcgtgtgaaggtgtaggcaagcgtgtaagtgtggatgaatgggcacagctgtggcatggagttacgtaacaaagcaagctagaggcagagggtgtgggccataggtcttagtttccagcacatgaaggaaaagatgaaacttctctggttttatttgtagaacatgaggggtcttcagtacctacagagaatggactgttctcattgtgcctcagacattcaagctgattggctcatactaaaggatgacatttctctggtttaagccttttaaaatcatttccagagaacggcgtgtatgtaaggccaaactacaatttggagtagtgatcaaaactaatgataattcatttctgaccataatagctctgtgttatggtgctttggagtgttccagttatagccaaataagttatggcttatttggggttatggttcattctgacttatgtgtcgaattcggtggacttgagcactgggtataaaataaaaacaacatttatgctccaggaaacactttgaactcagtctataaagtcaacatgctcttaacatttattaaacttaaccttaggtttgatgatataattttaagttttcagcatatatcaaaatgctgccttctctactgattctgggtttagtaatgtggccacagggtggcatgattcccttacataccttgttgttgattaaaatgaaaaagatgaagacatacaaattaaatgataattctttccccaattttatgttaaaatgtccaggtttttttttcctaaattgatgtttctgtacttcattattaagatttgaagaatattaaatctcagtaccctaagctttgatgtgttaaaggttttttccctgttcttgttagcttatggttatagcacaaattatgtttatatttgagaagaatgctaattagggctgcatgtcacagtgtatatttaactacaagctttagcttttttttttaaagccaacttataaaaactgatagagtatttgaaactggcagacaaagatgtttgtcatcctcaatagttgtgaagttgtttgcatagttactggcatgacacttacctcgttttaaaggcttcctggaaggctgagtgaaggaggagaacagggatgtcagatgatcgagaggcacaggctattcaaagtgaccttttatttaaatagatgggaagtccactctgctcatgagtttcatatagcaactctaaaggcagaagggttgtttccatttatacaagtccaggaaagttaagtttgatggatctaagtcaatctttgtaggtggagtttgaatgcacacgttaccatttcaaagcagatctatataccctcacctttgttgggaaatggatagacttagtagtaatttatgagatgtaaaatttagcaggctcccaataggaaccttactaatacagacttgtggactcttttccagggcgattgtgttgttacagtattgcttgctgaagaggacaaagttgaagatgatgctattttttacttgatattttctggctctaccctctatcactgcacaagtacccggaaagtcagttctgatacgttggagacaattgctcctggtaagtatctaaatggtgtcttttctagccttcatcaattatttgtaattttgctctttattttgagaccaagtttggtagcaaacagctaaacctgggcgtgaaactctgtttcttacctcagcctcctgagtgctgggattgctggcctatataatatactgggcttctttattcttggtggggacggggacacacgcacacatatttggttagtatagagtaatagaaggagcaaagcagagtgctcacctaacagctgttgttagatctttaagtatattgctagtgcttttgtttgctccacacacgaatgaacctacctagaagtaaagtgacattacaaattgaagggtatcagtattaggatcagccaaaaaaaaaaaaaaaaaaaaaaggaacaaaccccactaatttgttagagcttgagaaaactgagagctacatgggaggtatacattctcatgtgattatcatgatgatgcttcagaatttattttattgtgagtttcacagtgacaaaaccaaaacagaaaacctaattaataatacatacctcatgtctggggtgcacagtgtctttgttaatcctgagatttgaaagagaaagactaattctaccattattctttaaggagaaataatgaagctatcaacattatatagagtattcctccaaattttgaagcaagctttattaaatattaaatactgacttggtgaattctggccgggtccactccctggaattcctagctgagaggcccacgacacttgttgtatgtctttttatggacaaaaccattcaaccactgtattttcccatggcttcattgttattttctaagaactgcagctcccagaatacagaagttacctcccttgcgtaggtggggtttatgggttaattttgggtcttacatattttacataaaggcaatgccttggacttacaagccatagaacactatggagtgctgggctacttaccactgcatttataaatgtaaacacgatttaagaaatcaattactagtcatcggggcactgctatcaacttcctgttgggaagggagaagggttctctaactaggagtcagtccctgggtagactcctgccaggaagtgaaatgagattagtcgtatggattcatttcttcttaattagaatttgtgattaaaattaacccccattgtgtgtgtgtttcccaggagcgccctagccacaccctctatgggtgtctatttgtgtttcttgatcctgaatactgctgccctagtgttctaatctgaccagagtcagcattgcactctgatactatttttgtcattcttgactcatccattcacttgtagctcagaatactcaatttttattctcttttatcagcttttcccttactgaggtcttctattctctattgttcttactgattcaaattttctctcctcaatagcctcattattcctccactcgcctaatttcattgatttttgataggaagtgcccagttatgtcagagttcagaaagactctcgtgtacccactggagggtaggggtaattgtggcatcacttcagcatgcggatctctgttgtactctggatggtgtgtgagaaactggtagagtctcccagctgcatccccctgctttggtcatcatgtttgagactttttgtttacttgcctctttcagctactgtcattggattcttgtaacattttgtaattgaggagtggagatggatattgaaggctgtgggtcgggtacagaacccacacaacttttaacacctcattcatatcatgggattaactttataacccaggatcaaactggcttcggtccgctcttgcggtcatcttagacttgtgtttttccttcccttaggaacttcctcagcatgctttttctaaaagcactccagtgtatctgcacaccggcctacttcctggacatgctcgaacacttttctatgcagttagcttcccattcactgcatgtttagcccatcgcccttttatttcagctaaagtgttagcttcataagggcacgggtttgttttgcatgcccgtgtatgttaattcagcttttctaggaatccctgctgcttggtggacattgtttcacctgagcagacattctagaaaggtgcctgtcttaccctcccttcctcttccctctttggggaactacaaaaggagtttaatttcttgagttgaattcttagcctgtcaccaagtctgtgtctcttcccgggggtgactttgatggtttccgtgagtcagtgatagtgatagcctccgacttcctgtctgttgagggcccttgtcggccaatcagaattcttgatagaagtctgtacagtgctttggcattgcagttactggataaatagtcactggtttttttgttttgtttttttttttttcttttttttggtagcaggtgttcctgatagggctgtctctgtgccctttctgcttattctagggtgagccctgccatttccagtcatctgagttctaagaagaaaaagctttgtgccttgttctcccctttaatgtcatgctttattcagatagctggctttggtttttctttgagttctctgtatgattcattgtctgtgttttgctacatttagttcttactaaaaccagatgattgattgaccttcagaaagcagctacattttcatgctagtctgtcaccttttatcaaatattttctgtaaataggttggaacaatgagacatttctaaattataggaaaaattcttccatcatgtaaaacagttataagcgtcctcctcttctaatgttcgtcttttgtgggaaaaggtattttgagaggatctcgttgtcaccaccctgtcccacctttgagcactgagattacatgggtgagccaccaggactgacttattttctcctttgtgtgtgtgtttctgataagaatcttacagtaaaaggagattataaagcaggacgattaggcggctaagaccgtcctccgccacttaacaagtttgagaatgatccaggctatatgaaatcctgattcaaaaggaaaagggaaactataaagaagttataaaggcttttaaagcagtttttattgctttcctttcttctattgaagtctggagatataatatagttcatcttgagataaatagcatagagactcgtctactttttatgtttttggatatttgaatgccttataaagcgcatactatgtatggtatatagtgacatttaatgaaaatatttcaaagactttgaaacaatttcttattcttaaaattaaactcatctttacagtaattaacattagagactggccgcaattcataataaaatgctccattcaaaataactttgaggctagagggagtcagaaggtaaaaatgcttgttatacaagtctgactacctgagtttgctctctggaatccaggatgggaagagagacttggcttccatacgcagccttctgaccttcctcagcatccctgctttctcctcctccagtaatagaaagtgaacaaaatttagagactttcaaatggctgcttgaagaatatcatttcagttttattgagccatctatcttaaaggtatcttaggatgtgtaacaaagtttgggggttcacttttactaggcagtttagacaacgcaaattatgattttatcatttacaaatggaatagggattagtatgttcagtacactgtgttgtgaaaggctttggtataggctatttctaaaatcaaatcattttagtttatctattaatatatttctagaatcaaaacaaaggcttctgtttggtagtaaaattacaaattttcactgatgtccaattagactcaacacttacacacttttctcttgtttcgtatttatccaggatagctggccatgtaaggatagctggccatgtaaggtagtttcattgtgaagtgaaaagaaaaaaaaaaatctattatatttacaggtaccttttagctaatgaaaacttagagcttaaatcttacaaagtagtcctatgtttatagcaccatgtaatttttatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttacatttccaatgctataccaaagtcccccatacccacccacccccactcccctacccgcccactccccctttttggccctggcgttcctctctttccagtgatggccgactaggccaataagataatatcttgacagctttgagtttgtctattgagtttgttttaaaaaaatcaaataatggaaaaattttaaaaaataaaaatttgggaaaaaaaatcaaataatgcagttcatataagggctgccctggaaaagcaaaccaggaagtagttgaagagaggaaaaagtgcccacctgtgtggctagcagtgatgatgctgtgttagatatcatttctacatcttgtacccgtgagcactgcaccgtaatcctagggtgttacagcgtgactgatagataataaatcagtgtaaattggatcttggtgtgtgtggggcgggggggggggttcttattcttcgcatacaaagtatacacacacgtaaacaaacctaaggcatatcaatgagactcaagattctactaggtagaggttgaatagggaaaagctaaaaatggtttctaggagtaatgaaaataggaaaaagggttggaaagcactgctttcaaggtttaggctagaatacagaaatcacgctgtagagttcaatagcctgccctttttcacagtacacatgatggggttctaagtttgctgttgtatttttctttgtttttgtgttttgtccctcactgttattcccctgcatgtagagacattctataaatgcatcaaattcgtttgcccgcccttagtctgcaggatctagcagtgtggtcttgtctgtttatttgatcctctctggagggggtggagagcagtctgcaaactgagcatttcacttttactgttccagaggaagaaaaccacatcaggttcttaaacacgtctatgataaactgagtagtaaatctagtttatatcccattgctgactaatagagtctcctctttctgtgtgggattggcctgggctggtccagtaagcgcttttagggtacttttttagatcgatgataaaaacaaaggccggattgttttagtctccgaagaagagatggcccagggtgggatgtgttccacttttagcttaacaggaaatgaagtaatttttgggtcatagttcagtacttttgtttatttgtagcagttttgcgtttccatgggtgcagatgctttagacagtgataaaatgcttgcagggaaagaagcctgcagggaggctctcccaacctcaggcacacgtacttttgacccacagggcctaggatttactgagtttaagaagactgttaaccttagataacttgcttcttacctgggtgcttctgggtgctttttgtttaagtcttttctcctgttgtttttatttttatttttattttttcagttctgcagtgctaataaagttgttagttgtcctacaggcttgctggcttgtgaaacactttgtcaagatttagtgatctatttttctgtgtgatacttaaacaacagtagtgttttgagtataactaccagttcctggtgcctgtttgccatgtgctttgtgtggtgcctgctgatattttcaatacttctgtaaggttgatggtatcattttatggtcagagaaaggcttcaaggctgggtgtgtgttaggatgaccacacctttctgcaagagaacttggcacacaaatctactgtttccttcattattccctgtagattacttggtgggtaacagatccttcagacctcatacttatgttctgttttcattgtaaacaaaattgacactgcagggtcctaaaatgcacttaaacttaggactttctcccctcaacagtttctgggaattttgtttctttctgaatcctataggatagcttcttttagaaattgagtaaaatttcagtacttttcctttaaaaaagaaatagctctgcttatgttcctcttgttaccaggaaattgagtggaaacaaaaacaccatggaaactagttgaaaattgttgctattgcacttccctactacaacttctgtttttattgtattaaatttgctataatttcccatcctgtctttgtactgtagctttagactaaggcagacataagattaatattcctcctcctccagccgtaatctgtctagagcaagcttacagtgagtcttacctgtgcttctacactgagaccagttttattcctagatgtatattacacaaccctagttttaaacaatggtaaccnnnnnnnnnnnnnnnnnnnnnnnnnnnnnnnnnnnnnnnnnnnnnnnnnnnnnnnnnnnnnnnnnnnngaggcagagagagctgactggcaatgccatgggtttttgaaacctcaaagccaccccagtgacacgcatcctccaataaggccacattttctaaatctttctcaaacagttccaccaactgaagaccacttattcaatcatatgagcttatgtggacctttctcattcaaaccaccacatttcactttctggccttaatatgcttctaactatatcataaagcaaaatgcactataagtccacagaatttttcacagtgtcactatcatttcaaaatctaaagtctcttctgaaactcaaggcagacgcagtgtgggtacatacacactaccaccatgaccaccacgaccatcatcccaaaagctgagcacggtggcacagtgaggaaaaagtggaccaaagcaagactgaaacgcaaaagggcaaactcttaaatccttgtagtttagtctctgatgtcaagggtggcatccacccttccagctttattgtctgtaacacacttctctcagggtggttctacttcctgtatgcaacttttcctggcaggcatcccgtggctctggcacttccaacatcctgacatctttgatgtaattcaggcttcattttcctagctccattcagcggtctcttagggtctccatacaggacctcccttgccagatgcctaagtctttgggggccttccttcacggtggaagaacatcccacagatcttttactcctgtcttcatcttgactctaaagctatggctaatgttcccaagtttgtctgcctgcttgggatggaacctagatgcctcttagagttacatttgttgttgcttttaaggaacaggtaatgttttatgccttttcttgtttcacgttggaagcttagctgggacccagtcttgcttcaagcgaacccctctctttattccatttcatggcaggcctttccttatcttttcagcataagccttggttccaacaatacatttcctagtgcccctttcttcttggaatgcatattttgtattttctttttttttttttttttttttttttttttggtttttcgagtcagggtttctctgtagccctggctgtcctcgaactcactttgtagaccaggctggcctcaaaagcagaaatccgcctgcctctgcctctgcctcccaagtgctaggcgtgcgccaccacgcccggtgctattttgtatttctttttgtctgctgtgacatttttgttatagacctgcttaagagaggttgctaataccacacagcaaggcaatactgaaatcttgaaatctcttctgccagtgaaatcagctggaaacctccagattctagaaagagtacaaaaagaagctacattctttgccaacatatcacaaaaatggtatctagcccagttaattcatattgttctcctgaaacctcttgggctgggccttcatagcttacaacactctcatcactatgttcttccaacttactctttttatgtatctggggggggagatctctctctctctctctctctctctctctctctctctctctctctcataggagcaacatataaccctagctagttgagaactgcatttgaaaaactgagaaaaaatagtgaatagtttgttaaatacaatctccttgttggaaatacttaattctgaaaggctaggaaactgcgcagaagaaagtgttgttctgtaaggacactaacagagctttgtgttgttcagtctttaaagttagtctgtagtgcagcattcagtggcatgtagctgctagtctcaggtcacgtggtgcctgctgagccgtatggtggggagcacagtctgcttcatgtgtgcatttttctgagtggggcttgtaaccacagcatcgcatcatctttatttgaaccaggtggtttgattgacaggcttattgccttagtggttgggacaggtaaaaggtacctgggagcaactgttctgtaacattgaccttggcttgctcaaagcatgaaaggttttccttttgactattctacattctttgatttactgtatggtggtacagagctatctgggccactcctgccgttccccatttctcctgttgttaatgtggatctaactctactgagtaagccttagagtatctattgcatgctggaccttagaggatcctagagctttcattctgtaatttgttcagatgtaacagcactagtttttacagcctgttctttgttacatactgttactggaatggtataaaagctggggttcatatttgttagcagtttgttaaagatatcactcatatttgcaaataataattagaaaaccaaaaatagaattttaagaaatcaggagaggaagattttcttttagaaggagaaatcttatgtactatttaaaaagctgaaaggactcacttgggttctttcatcaataagttcaactttctttgctgcctgtgctttctttaggtcacgactgctgtgagacagtgaaggtgctgctctgtgcttccagagagggccttcctgtgtttgtagtcgctgaagaagacttccatttcgtccaggatgaggcgtatgatgcagctcagttcctggcaaccagtgctggaaatcagcaggctctgaacttcacacggttcctcgatcgatcaggacctccttctagagatgtgaactctctcgatgagaaggtggcactggcattcagacacctgaagctgcctgcagaatggaacgtgttagggacagatcacactttgcatggtgagaagccacagacttacaagctgccttggaatacctctgctttcccttttaaacaaccactgtggttcaagcctcctcggtggctgagtaaactagaattcctacgcagtattttcttcttccaggtgcatagcctaagtagactggcacatctctgtgcatctggattgactgctcaagccaggcgggtggttgacggttcatgagagtagcagagtgatcttttgctgtttcctcacaaaagtatacctataggtgtttttgtatgtgcggttctgtagaagtactgtggagttgttggaagcagtcgtagaggagtgcgtcagggaagcatgagctcaagataaacattagacactcggcagttcttagaccagggtattgactctatgatgccatataaaagttcttacaggatcgcattaaaaaaataaaaacaaccctgctataaacaacacttatgttaaatccttctaatcagacaaggatttcaccatatggttactcttacagcaaatgatatctaaatgttataactacaaatatgtatagttttaataaaatagtcctgattcataaataacatcctgtttctgtccttagagcaaatacaattgagaaaaatgtgtaaataaatatcccacatagcacacaaattatctagtactgccaagacattaggatctaaatatgtgacgtttagagcctcagtacctattcagagtacttactgatggctcctgattgttcctaattctgccatttctgtgtcagatgtgggaacaattgcaattacacttttattctgtcttacttaaagagtatagcctagagtgtgtactggtttgcaggctagttgtttaaatataccacgacaactagctcatcatcttttcaaggtacaaaacattgataagcctttgcaggtcagtaacaagtctcatgaaaggataaaacggttcagtcctcaaaggaagggtctgcggagagcagtggagttgctttgctctgctcttacttttgctgaagatagtcttaacttttgagcaaggagaaatttgtttttcatcctttaaaagattgtgttattcatttactcattcattcgtttgagatagcacctcactgtgtagtcctggctgtcctagagatcagactagcttcgactaaaattcatagagatccacctgctcctgtctccatagtgctagtattaaaggcttcacttatttttattttatgatataggtattttgcttgagtgtgtatgtttgcaccatatgtgtgccccgtgtctaccatggcctgaaaaaggtatcagatcccctggaatggggttgcagatgctgccctatgggttctgggaactgaacctgggttctctgcaagagtagcaagtgctcttcaccactgagccacctctgcaactcttgtccgttttatttcttccacacgttccttgatctcgagtttatataaggaaatctccacactatgcattttgcaggaggctcctttgagtgcaggtaatgaaggttcatctgggtggaaggtgagttatgcaacacaggacactccccccccaccacacccccacccaactccaccacattttaaggcctcatttagttgccttagttcttcagtgactctatggttagggagagtggtaagttgagtggtttctcctggaagaccattgaatagttgcaatcagtttaactctcagatagaataggcccattaaatattggctgtacataaagcaaggagaaacacatcctagtgaataggtccatattgaaaatgagttgtgtctttgagggtggcaaccacacccacagctttggtagagggaatgatgacagacttaagatgaatttcctaaacacaggcactcgttatcactggttgattggttagtagatactcaaccttaaccacatggttgatttagttcccacagcccttttaggatgttccatagctttccatataaagtccgtccttgttatactagtctctgtgtatttttctagctgtcttctttgctaaaatagaaaatgtagacagattgctttggatttttcactgtcttgcaaaggattgataactgtgggcttctatgacagacagtgcctacctacctacctacctacctacctacctacctaccagcagcaaggcttaaactctgaaaggattgctgcctccaaggcctgttgctgtcacagttcttctcattcttcctcagagccctgctctgcctgttaaggacgtttccatctctcatgcagtgtaaagatgactgcttcttgtgggtctgcagatttatttataggccagaagtacacagggtggtgactttggaatctcacagctacaggttcaaacagtgctccgaggtgggcttggtgggttcattggtgggatggaacagaacatacagtccttgattattacactatccaaacactctcacagccgtttattcaggaaacatcactcgaaaaagattaaaatcttctaacagaccccttgtggttgaatgccttttgggtacttcagctttcttgcagctctgggcagctctatgaaagtgcctccaccatgaaagcagacagcagttggagcttacagccctttctgctctcctcctctgtagtttaaccaagccacgatagtgtggttggtaccatttgaatctagactgctctacattttttgagtgatatttttaaggttatggaacctgcaggagcttggacctggctggtaggagaggtcaccaggggcaggttgttggagttgatacctcctccttccagcccagttctaaactgctgctctgggtggtgccatgtgaataagctttggctacatccttgcactgctgttttcccctgctgtcattgaatggaatttctgataccaagagcaaaacagagccttccttccttccttagttgtttctgtcaggtattttgatcacaactttgggagaaataactaatacagcagtcaaaaagaaactcaaccaaaacttggggccctaagtgtacctgcaggagaaacaactaggaggacaaaaacaaaaaggaagctgctggaaatggcacacgaacgtgctgattcccttgatacagttacatccctgttgtgatgaaggacccagatgacaatgtaggaaatatagctaacaacctaaaagaaagttgacgctgaggaggtggtttggggtaaaaatgttgctgtacaagcatggcaatctaagtttgggtccccgcaccctgtaaaaagccaagtgtagtggcttccatttcaaacaccagtgctgggtggtggagacagaccctgggagctccctggtcaccactcccacaagcgcctccaacctaccccacaaaagtttgataactctccaagtacagaagaacaccaagaatcatgggctggggaaccagcaaatggaaattatgaattctgaaacttgagaggaggaggaggagcagtctgggaggtagaggttaatggcagagctccatgctgtgagagcaaagcagcctgggtaaaagtccacttacattgctaactttgccctcttttgaacctaattcacatgactttaatttacatgaagacacagtaaaatatgaaaaagtgtggatggttatttaaccaatctgagatataaatacgaagtggttttactcaaaaataaaatggaacaccacatgacagctgtattgtaaatctcagaaaagatgaaagtagccttatgtagcatttcacttatatgaacttttcaaataggcaaaaagcatgaaaaactcaaagtagtggttggctttagtaatgaagccctgaccagaaaagggcataaaggaactttgtgtgatgttcataatgttctacattttgatgggagtttgacaatccaggtgtcaaatgggctagaggtggtggtacttgcctttaatcccagcacacgacaagcagaagcagccagatctctctgagtttcaaggccagactggtctttatagtgagttctaggacaggcagaactacatagtgagaccttgtctcaaaagagtatcaaatgttatacttgtattttcctgtatcttagtcatttaattcccatattgaattctagttgatggtacccatcaagttagtctggtgtcttcagctccctttgaatgagtaaatacttgaagaataaatacttgataaagcaaatacattgatagaatatttattgtaggacataagttgttgaatatctgatgaatgcattgttcttccaaattacatgtgctttaaatgctaatagaagatggggagtggggctgaaagcagccgcattgggctttgggctttatggtaactcgccttatggtgactcagaacaaaggaacttaaaagagtagaggctggaaaggaagctactttaaggacataatacctgataaggctggacttaaccagctctggaaaaaacatacccacatatttcctggtctgtaagtgcttagcactttggtgttttgataaggttgtcaggatgtttgtgagaggcataaagcacaagtcagaagtatttaatactgatgagagttttttctgccttttctctaagtcttgccacttcttcagaggctatatttattaaagctttatgattggaaacataattatttcttcaaggacattattttctctggtttcttgtgggagtaaggtttagttcttaagaatcctgagaatcaaacccagcccccatgtttgctcagcaagtgttctgttcttgagcagtcccctgcacccctgccccatccctgaagcattgattttagtctccatttgtgcttgaacacatagcaaatcttgagttgatccatgcataaataggatttgggagagaaacatgaaagaccatttgcttttaatgaaatttatattggtcacaggcaagtgacattaggaaacagtgagttcgggactggataaatatctccgtgattaagaactggtagaggacctgcgttcagttcccaacactcaagtcaaggtgctcacagctccctggaactccagctccctcttctctcagatactgcactgtcgtgaaaagtcccccagccccaaagaaatgaaatctctttttaaaaattatttttaaaaaatgcacctcattgttcactcctgttgtgatattcacatatagaagaatctgacaaaaggaaaacactaggttcatccaagaagtctagaatgctttggccctaggacctgccctcacacaagacaatgagctaggaaaagggtgttgctagtgaagttagcatgtacttcgaagcccaagaacagggccagaggcagagaaagggtgaaggaccctacagccaggcgttagtctagcatttcacctacccttctctgttacagcagctctcagtgaggggatggtggcttgctcacgggaatatgaaagtgaagctctgagaagcaagtgagccatgcctagtcacttctatgattaaggccaggcctggacccacttttgcctgatctgaagccctttcttgtcctacccacactcttagtgacccagtatgccaagaaggatccctcatttctagtgaactcagcccaagcacttgttttctcgccgaaagttattagtgtagtcttacagttcatcccattgtacctgaagattcatttcgttttctcattaagcaaacacaaggttggtagtgccagaaattcgatatgcccttagtgtgagggactaaagacctgtgtgtacttaacaagtctaacctgtttgtagtgtttaactagccaattcctgtctgagcgttctttaaaaagtaattatacccttcagattatacccatttgagtcctgaaaactgttcaccttagatccaaggaactgcatttacttctattattgttgtcgtttttttgtttttgttttgtttttggttttgtttgtttgtttgtttgtttgttttttaatggaaggagcatagtggggacacctgtattaacctctctgaaaaagcacagctatggcttggttctctatgtgcgtatttgtctgctgttgaagattttgtgtcacaatttttttctagctttatttttgcctttacttgaaaggcgatttttacctggaataaagttgttggctgcatgttacagatgaccttcacggtgctagatacttgaaggcaacagtgtgtctgcctagactggtcttctattgccagtggggtttggctctttgttggtggtggttgttacaggctttaattttcatgctcttcccccgttcacagacggtggccctcgggaaaccctgatgcactttgctgtgcggctgggactgctgcggttgacatggttcctgttacagaagccaggtggccgtggagctctcagcatccacaacaaggaaggggcaacgcctgtgagcctggcactggagcgaggttatcacgaacttcaccagcttctgactgagtgagtgtctcttcccggtcccctcttgtcagtctccaccccacatttcagagcagtacagcccactggctctgcacctcgcctgtgctgcaggagggctggaagcttgctcctgccaactgcttcgttgtaggagccccgcgtgagtcatgttaccacttttctttctcttgtctctgttttcactgcttcttgccactgtcttttattgagaacgcaatggcatcttgtccgtggaggtagtgtaatgttactaatgtatagattatatgaccgagtagaggaagaaacaagttttcctgtgatacgttttgtttttttcctgtaatgtcttcaggacatgaacaagataattagaagttaatagttaggtattgtaattgtatataaaatatggtaaaagttgaattttggtttgaatgcgatttctgtgcataaagttaagagaagtagtttcttatgagtacagttaaaagcagttacattgttgtagaagtatgcagtaggaaatcctgtttgtctttggggtcagttctgtgtttctttaaagcctcctgtggaggaagactactagtcaaaacattgaagaatgtgtttttcctttataaataaaggaataaatgcttgacagtagccaatgcttcttcgttggaatattttcttgcttagtatatttttactagttttatgatcatgatttttctatcatgtgagccaaaactgtattggttccctgtttctcctattgagggatccttgtaaactcaggcagtatttccagagtcccacatattatcctttgcttgagtcaaacttcatgtagttggatatccatgtcattgttaatcacatgtgaacaaggtaatcaggaaggaccaggacgaggactctagaatttaagacagcttacagttatataagcggaactctttttttgttgttgttgctcctgttgtttgttgcacttgctgggcttatagctttcccagtcaagccaggcagaaacgtcgttgcagacagctttgcagtgagaggtgctgagatgcaacagtggaaagaagagcactcttcatctaggatgagctttggacacctgagctctcacattccagaatgtagtctattctgttcctccatgcttaccttctggcctgtgatcagtttcattctgtggtttgcctcatggtttcagagagggctgcattgttctaaaaattaaaacaattaactcagaacagctattactattttcaaaggcagttcctccggatttgatgttacagctgggtgtttgctgggaagtggagcttgttatggactgccgtccaaatggggaaataaggtggttgcaacagcttcattatatgtttagacctgggtgtcacaagatggttattgtagcatgatttgaaatttgggatataattattcttggagatttttactttaaaactgaaggtcactaatgattcatcttacaggggaaggtgaggggaagtccagccgagagatgaagtagaggatggtgttgagagcatgcgcgcttactgcaggtgcctctgccttagtgaattcctctgggtagtcactggtttaaagccaaggaaagtgctgagtcacagctgcccagagaaaaagtagatgtggttctccttattctctgtcgtagttgaataccagtaggctttgctagaatttagccatgatggtagaaatcatttttttctctgtgttgtgggactcattctgtctgtctgtctgtctgtctgtctgtctgtcaatctgtctctgtgtctctcttgtattgtactcttttggccaaatttggttacataactcacagtgttatataactatcactactatcgatttctagaacctaccatgaactcacataggaaccctgtacccatgaaacactagctctgtattcactctgtccccaccccctggtaacctctgttcttctttctttctccaagaatccccattctgaatacctcacataagcagaaggtagaacatttatccttccacacctagtttctttaatatcatgtaatatccttaagattcaactgtcaggtgagcatggtagcacacaaattgaattccagcacttgggaggcagtggatctctatgagtttgaggcaccctggtctatataggttgctctagaatagccagggctatgtagagagaccctagctcaaaaccaaaaatgattcagctgtgttatcagaataatgttatatattttaagattccaaaagagatttaaatgttctcataatggataagatgatgggtatgttaagggggttgatttatactgtatatacctgtcaaaataatcacaccataagtatgcagggttgtttttttgttttgttttgtttttaatgtcagttttttaaaggcccaaataaagttaaaaggcagaagagaagtaacctgaattttggtcaacagatgaataaacaaagtgtgtacattagagaggaatcaggcaaattaactggactatggtaagaggtggtaagtctgaaatgagtgacaaatctcttaacagactgttcattgctctttctgcttgtggggtccttgtgggagtctgagggggagatctgtactctttcaaatacagagaacgtacggactttcctgaggaaagggttttttttagaagactcattcgtaaaagtttttttgaaagttaagaactgccgactcacatctctccagtatgtactaaaatcattagatattggatgacttgcctgtctttccctcacattttaattttcttcctcataggtctgattcatgctgtctccttctctgtccctcattctttttctttccccttccttttgtggtactgaggggctgagcccagggctttaggaatggtccacttgtaccttttactactgagctgcactcttagctctttggggcatatatgtagaatacttaccaatggagggcagaggccaacacagggtgacttcctctattgctccacctgaaaggtttttgttttgtcctaaaacaagagcattgtttggttggttggttggttgaatggttggttggttttagctagactgcctgagcagcaccctgattctcttgtctccaccccctagcactagggcgatgtgtctagtctaccatggctaacattttatgtgggtgctagaaataggaactcggatcttttgcttgcacaagtacatgactgaaacatctctcagccaaagcctacctctttcatcacatctctgaggaggggttatgcacctacgagaaaaaaaccaaacaactaaatagctatttaccttctagtctatgatggttactgtaattgtcagcttgacagactctcctatcacctccagatgggtttctgggcatgtctaggtaagattatcttgactgaatttattgaggtaggaaggacgcccactgtaggtggccccgctccctggctgggtcttaaactgtgtaagtggagaaacgaagctctgtttcctgatcgtgaatatagtatgatcagctagttgatgcttcttcttcctttacttcctggccaagatgggctgaaatctgtgagccagaataaatccttacgttgtttttgtttgtttgtttgtttgtttttggttttggtttttttttttaaagcaacaggaaaatagattgtaaaggattctttacaaatatcttctgaacaaaagtaaaggtataacaatgaccaccaagatagtaccatcccaaacatccttcccttaatgatggacaatggatggcctgggtgatgttgtttgcaattatatcattcatagaggcctaagggcacacaatggccacatgacatcattttgtacttgcaaatcatttcacatttcaggtcagttcccatatcgcaactcattcttaatagaatttttgtgttcattcaatcagttttatatcttaaatttttaaattatttcttaaagatttattttatgtgtattaatgttttgcttttatgtatctatgtgctactgcatacctggtgcccatggagttgagaagagggcaccagatccccctgaaaatggagttttaaatggttgtaagtcaccatgttaattttgggaactgaacctgggtcctctggaagagcaacaagtactctaaatctttgagccatctctttagaccttgagttctataccttcctgggataattcatttgcagataagagaaagtatacccaagttcttcatgccatacattcacacatagcctcccagtcattatacgctgtccagtttctttacgataatggagtaagtcacatcaggaccatgaagatgagaggttctgcatggagatgactacatccttgtgcatctttcccttcatctcctcagggttcagcttcagagtaaggccctagctctgcctcactagcttgtagctgctgagccttgctgtcactacagagtcactattaagagtatttttgtaagttttctctttcttctgctgctgcttatttatttatttatttatttatttattttattattatttttttttatttcgtagtccatggccattaactttcacttagtatacttacaaggaaggaaaagtttattgacttgttactctcattttgaacttattctattactgagtatatttatgatctgaaattttatcttcacaaaaatgttaccagtcttgtgagaaatcttcgccccagaggagttcatgtagtcctgttccagcttcaggtagatcatagtcatttcttccagtttgcagtttctaccaggatctcacgtgttggtgatggaccaagtaggtacagaactctggctggcaggttcgaggcttattgaatgctaagaggtgatgaccataggtgaccttggaacggtctgaggaagaaaaacttgaacagattgttgcctcacacatcccaaagcaggagttttagaacctgcatcctttgtgcagatggtactgagagcaaagtagcacctaggagtgcaagcctggtagcattttggctccaccactctggagcatgtcacttcgattgcattaagctgcttttcctctctcagttttgctttcttcatctgataaaggatgataatgtctcgtcatccccaagtgatagctagaaacctacagtatgtagtgcaaaaatgatggcttcgtgggcagattccagagattgtaaaataaataaaggggcatcagtattggagtttgcaaagacactgtgttgtgtgttggctgctgaagagcttcagtaaagccttaacttcctcgcttgcgtccgtgactccaagccgctcgttaggtctttggtaaatacaattgtcccacctctgtggctgctcttcctcggtcatgtggtggtttgaaccagttgacatgtgtgcaggtgctttgataaactacatggtgatctcctgggaagtctcataaaattgtgcgtaaaaatgtcagtaaacctaaggccactccactgtaaactcaaattctggttggttgggctgctgagaactctttttttgtaatatatatcatgcctttctgaaagttaaaattagtagagaaatggaaacattttcaggactatcacaggttgatttaaaaatgacttacagtgcctctgtctttagaagaaaagaatttcttttaagatggtaaacactcgagtatgtacataaagagctgagatatttcaattgctattaagagccagtttatgagtatttatcttctaagctttatctgatttttagaattgattcaacaaatagttatgtgttgaatacttatgttgcagtagaatccatacttaacacactgcagatatcattttaaccctacaatgacctttctgaagtaaatgttatgtatgatttgtggatgaaaaatggttgttgagacaactaaaataactaggatacataaaaagtggtttgacacaaacgtcagtggaaatacaaggccaacattcttcctatgtagaaatttgatagagaaagaagaaattcagggagagagtgctagagtggagaatatgacagcacttaagtacaggagggtgtcctgcttcccattagcccctgcctctggatgacgaaataagatcctcactgtaataactttacagttttaatactcatggggatatttaaagtacgattggttacacttaaactattcccttagatttcgagtctcataaaagcccaatgagtggatagaataaatgctattatctctttcttatagttgtagaaactgaggcaaaggaaatgaagtctcttgcctgttgtcacggtcccataaagtaacaaagcttagcctcaattctccagatttgtaaatgtgcaggacacagacccagccttctaagtaatgggcactccgtcacggtttagtgtagtcagaagtataaataattctcagggccggtatgtttgtgagtttttgaatcctgctttcaagactctcacatgaaacttgactgcacatctcacagtagaacacaggactgttgttcaagatgtgttgtcaacactgtgattgctttttcagtgtcctcttaaggacttggtaagtgaatcacaatagcttatctgttacaaaacaagtttggagccttcgcttttgcttaagaggtgaaaggataaaatatatatgcaaatgtggctataaaataatagccagggagagcgatctggagcaccttggcgttatgctggcctggctccattcatcttgtctgttacccctcttggcagtctgcgacctgggtctttgtggcttataaagatagattagtagaagtagatggaggtgagagatggtgaagacactagtatttatcaaatgcagatggccaccttgccttgtacacggtgctgctttgcagcttttcatctcatctcatttaaaacaactcagcagacatgaggtgtagttcctgcagtatctaagtaactagcccaaggctatattcacaagcctgacttttaaaaaacaacaaaaaaagtatatttggtagcagtatcaggtttttaatgagctaatttaattgcttatttgtagatctagtttgcagtgttttttctcattaacagctttaagaatttctatattttatttttaaggtatttaagctaatcacctcaggattgctttatttggcaatgtgctggaaaattgcaaagtacatgtcttttctgaaaatgatgaacttttataaaacagtaattccagttatcatatactaggcattttctgtctgactgactgactgactgtctgtctgtctgtccgtccgtccgtccgtccgtccgtccatccatccatccatccatccatccatccatccatccatcctctctgcaatcttttggggatgaagacattaatctttattgcacacagacacaaataacagtaaagtgggtagtagaacaagggtttgtacagctccaaaagttgagctttagcattgctttaagaattctaaatgccaggcctttaatcccagcacttgggaggcagaggcaggtggatttctgagttcgaggacagcctggtctgcagagtgagttctaggacagccagggctacccagaaaaaccctgtctcaaaagagagagagagagagagagagagagagagagagagagagagagagagagagagaaatgaaatattattctgtacacttattgcagtttagtagttagacttttgccagcttgttcttaaagtagaaggacgtctccctattatcctgcattagatcatccttcagttacttaactgtgaatgtgttttttcaggctatatcaataatgtctataattagttggattataaacaattgagatatgaaaatttttagtgatatgttttcttgaaagcatttgtgttaacattcttacttaaaccagtaacaaaactcctttagctgcctaagttgtataacaatcattttgacaaggttttgtttaaatgtttagtgtccacagacacagagaaggatttgtattccttaaaaactttaattaaggctttattttgatactagttagtgaagtcaatgaattaggtgcctaattttttttcaccagacacatttattgcttatgttttatttgtggatcgggaatggtttatcctagttaacattttcttttctataaaatctggagatggcagtgtggttattcttttcatcttttctataaaacacaatgtataaaagaacattctatttaatgccaaatgacttaaatagaatgagataactataattttagaattcttttacagttttttttattttattaaaaaatggttaattttatttatttaatatactatattcatgtctacattggtatgtgttggtgtatatgcctatgtatacacatttaaaggcctgaacttgactcctagctaagttctccaccttagtttttgagagaatatctcattgaaccaggaaattctcagttggcagatcagcttactagtgaggttccaggatcttcctgatcctgatccagaccccgcccccacctctgcggttactggctcatgccccaccctggcctttcgtgtggggctggagagctgaacaaattagtcggtgcttgcacagtagccacgtgcccctctaagcatctcccagcatacctagacctttggaatgttaataagtgctattttgaaagtttataaaaatctaatatttatagttcttgcctatacctttaaattttatagacatttggcttaagaaaataaaatgttcttcctaagttacctggcaccagtacattttctccatactgatattgtaaaactagttgtcttgttcttaggaaaattggtagtagttctgcaattaacagtttttataatcactgattattgtaggacttcttttatattaaatgaatattttatgctgtagccagtagaacttgtgtattaaaaagcatataagaaggtttgtattttgcatgatctaggaagagcttggagaatgcttacttcctgtatcagaagagtgccttcactgataggttgatcattggccacttaagctttgaatagacagacagacatatggtgctaatgatagacagcacttgctcaaattatgtgtcttcttggcttttcttttcctttgtatttcccccatgctggttacttaggggacagaaacaattctgtctccttctatggtttggatagagttttgggctcatgtgttgatcctcagtaatagtggttgtagaatgtgaaacacattagatggccctaaagtctaagaggaccacacttggaagagatgaaagccattcttgtaatcaaaactggttataacagtctaaacctaacccccaagtcattcttcggcttttacctaagtaatatgacccctgtttctatacatggctttggaattcagtgccatctaccatgagacgataaggccaagaagagtctttacagagcctatgctgttaccttaacttttagcctctaaactattctaacagacctcttttcaccctaatgtatttccttagagtaatgaacaagggaccaacacatcccccacttcaacccaaaaaacagagagaaggggaaagccaataaaatttctagtgaatctgcatgcctgtgaacatttatctgacaatacctagctaagatgactgtttcattttgagcaaaatgactcttttgcccttggtctagttgttgctcatctggaatttagactttccagctccatttcagtggcgttgtggttgattttgtaagccccgttgaggtttggcaatgttacagtgatgtggtttcatgaaaggtattgcaggagctctc

SEQ ID NO: 512 - DNA, 725 bp, Mus musculus
ccgtcaccgccgccgccgagggagcggccgcctattgtccttctccgcggccaaggcgcggagctgctccggctcggcccgcgggggagcccggggagccgcacgtgtcctgggtcatgaaacttagtccacaacaagctccattatatggcgattgtgttgttacagtattgcttgctgaagaggacaaagttgaagatgatgctattttttacttgatattttctggctctaccctctatcactgcacaagtacccggaaagtcagttctgatacgttggagacaattgctcctggtcacgactgctgtgagacagtgaaggtgctgctctgtgcttccagagagggccttcctgtgtttgtagtcgctgaagaagacttccatttcgtccaggatgaggcgtatgatgcagctcagttcctggcaaccagtgctggaaatcagcaggctctgaacttcacacggttcctcgatcgatcaggacctccttctagagatgtgaactctctcgatgagaaggtggcactggcattcagacacctgaagctgcctgcagaatggaacgtgttagggacagatcacactttgcatgacggtggccctcgggaaaccctgatgcactttgctgtgcggctgggactgctgcggttgacatggttcctgttacagaagccaggtggccgtggagctctcagcatccacaacaaggaaggggcaacgcct

SEQ ID NO: 513 - protein, 241 aa, Mus musculus
VTAAAEGAAAYCPSPRPRRGAAPARPAGEPGEPHVSWVMKLSPQQAPLYGDCVVTVLLAEEDKVEDDAIFYLIFSGSTLYHCTSTRKVSSDTLETIAPGHDCCETVKVLLCASREGLPVFVVAEEDFHFVQDEAYDAAQFLATSAGNQQALNFTRFLDRSGPPSRDVNSLDEKVALAFRHLKLPAEWNVLGTDHTLHDGGPRETLMHFAVRLGLLRLTWFLLQKPGGRGALSIHNKEGATP

SEQ ID NO: 514 - DNA, 74183 bp, Homo sapiens
  misc_feature (1)...(74183): n = A,T,C or G
cagcttgccctgttacctacctgttggatatagaataagtacaaatatctatcctgtctaccctgctgatacatgaaacttaagattcaaagcctcatcatcttatcacaaattattcccacaagccactagttttccttagagatacccctttttctcttaattctgcttgaggcttactatcttccagtcccatccagtcacttgtcatatttcatcaaattattattattgttaatttgagagacaaggtcttgccctgtcccaggctggagtgcagtggtgtgatcatagctcacttagtctgcatctcctggctcaagagatcctcccaccttggcctccccaggggctgggagtacaggcatgagccactgcgcctggcccaaattatttttaacagaatttttttctcacatttattatttttttagattggtagatcttgctaccatggcagttaagcacttttaactttctcacattgtgtttttgtattattttctccaaatggtttctttgtctctattctttttccttcttaggacgtgactgtgagagaaatctttctggaatatttgctgcctttaacaccccctcaccccccatttttctttcagtatataccacataagactgtctttttttttttcttcgtcgcctacacaggttcaagtatgaatcttttggcttgccattaatattcggcataagctcatctctgccatctttatttactcagttatggaacaacttcctaatgctagatgggccttgtgtgaagtttcaaaaagacagtttttgctttccataagcctcaggtggtgaagagaaacatgtacagcgcagtgcacataattgcacatctctctgactttgtcacacgtttggacccaagcaacacgtttgggtttgggtttaccgtgagtgtaagcagacctcttgcttctcctcccttctccacctccagactcttccatctttcttgttctcagcaccctctttctcctataccctgtagtccttcgatgcctgcgacttgcttgctatgtaacatgttccttctatcaacaatgatctctttacacgtatctcttttttccccacacctaactgtgtctcctcttaacttcaaggtcaggatatagaggaaagaatacagacttaggaatcctacttggatttgaattcccgcttgaccccttctagctttttaaaggcaagatttaaaaaatactctcggctacagctttctcatctctaaaatggagataaagataccttgcagtatttgcaaagcacctcagtcagcccctcacctgcagtaggcattcagaaaatgcagtagtatgtgctgactcatcttcctttctcacctttaccatgctcctacagtgttgactatttttatgtatgtatgtatgtatgtatgtatgtatgtatgtatgtatgtttttgaggtggagtctcgctctgtagcccaggctggagtgcagtggtgtgatctcggctcactgcaagctctgcctcctgggttcacgccattctcctgcctcagcctcccgagtagctgggactacaggcacccaccaccatgcccggctaatttttttgtatttttagtagatgctcctgcctcagcctcccaaagtgctgggattacaggcgtgagccaccgttcccggcccagtgttgactatttttgtaattttagtttagtgataaaaacgtctgtggtgttgtattatttatttttcctgggtcctcgggtaaaaggcgcttgtgtgagcatggacaggctccatgctctcagtgtgaggctgaaggaacttctacatttgctgttaatgatagagctttcttcacatctgtattgatagggcttcccacaaccccagcccttaatttattttaaagcctttttacagttttttgtgggaagccttggaggttttacaattttttatttttatgtttttaaaacttttaatgtggacataattccaaaatattaaaaatattaaaaaataattttataaagagttttccaaaagtagtacaaagaatactcatatattctttactcagggcaacacctgttgttaacatcttacgccatttgctgtatcattttcactctagcgatttacctgtaggctgacaatttttttccttaattatctgtcagtaagttacatgtatcctggctgtttatttcaaaaatgcttcagtatgtatttcctaaaatagggatattctcctttgtaatcacagcagggtagatactgctctttagttgtcatgtctcttagccttctttaatgtggaacacgtccacaccctttctttatcttctgtcttttccgattttgaagaatacagtgccctctcctcttgcttaatagactgtttctcattgtccgacgtttccttgtgattaggttgagggcttgcatgcttggtcagagcactgcataggtaaccttgtgtctttctcagtgtgtgactctggagacacatctgtcatctgtctttattgagatctttattttgattaacctgttcagtgtattggcagatttcgctgaatgaattctcctttttttttctttcttataactaataagcagtctttggggagacacttaaagactgtgtaatatgtatgctgttcctcatcagaatctccctctggattgagcattcattgataactttttgccagagtgaatctttaccatatgtttgcgcagtgataattttactattccagcaatctcccctcttttagcagtcagcccgtcattctgtgatactcataggaactcccttctctgctgtataatttatctactgttattaatatggactcatgacttcctatttgttaaaaaaattgtttataatttattgctgttcttgattgtgtagtctttaaattgtcccaggtttgtacagaggaagccacttgagtctggcttctgtgtccttaagacatggccccatcgtttttttgagcacttcattgttttctgtcaaaacaagatattacagtctcatcttatagatactctgacccaggcctggaatcagccaagtctctgaagggactcggttctttttattggagaatggtattagtgaccaatgcctgtacactagataatattcattgctactgagtgttcctctgttgtgtaagcctttaatgaaattgaacactggctgccatgagttgccaagttaaaatgccatgactttgccttttagcctatggaaaagttgtagctacctgtcagtgtttggttgttttagcagagtaactgggcaaagtgttatcaattgcctatcaattgtatgtttaaaggagagaacgaagatagttatgtgaatacaagcagtgttggttaatgagattttgaggggttttttttttttggtactgtaataattgccacctcatggaaaggtaataccctgtaataacactcagtttttatttagtttacttaactctcttgtttcacttttcccaaatttgcagtgggtataaatcctgtcattttgtcagactgggaaataaatttgggaaggcctgtgaaacttttaagattctggattgaaaggtagtttttgttataatttcacaattcttggagcctacaagaatgtctttacataaaatatgtgactgcaagatataaaaaataaactcaggaatctaaattttataccttttaacttcaaatatttgattataaattatttgagcagatatttcttggaaactattctgaaataatttcaagtttatagaaaagctgtaaggatagaacagatattacatcttataaactttatgcccctattttccaactgttgacattttgccatatttgcttaatcattctgtctcttatcatttctttcctgaaccattggagagtaaattttaggtctcacgtccctttactccaaacgctttgttgtgtggtttctgagaacaaaggtgttctttcataaccacggcacaataccaaaaccaggaattttaacattggttccatgttaatctgtaaacctcattcagattttgcaagttgtcccgataatatccttaatagcagcttgtttttattaagtattcactccaaaatcatgtgttgtgtttagttggcaaatctttttagtcttctttactctggaacaggacctcaatctttgtcttttgttaatgacattttctgaagagttacagaccatttttttacatagatgccccttcaattcaagtttgtctgatgttttctcatgactagattgaagttatgcatttttgttaggaacactgtaagtgatgctgtgtccttagtgcatgctatgtgaaatgtgatgttagcttatttctctatggttatttttccttttttttttaaatcatttgattcaggtgttatctgccaaagttctgctttcccctttgttatttataagccttaagtgagcatttctccaacatctttgttgtgtttttaacaacttctttaacattttaaacatcttttctgttgtccaatttttaacaacaaagatgttaaaaatcagaaaactcagaaaagcacgtggtgtattaaaattccacctaggaataactgccattaaagttttggtgtctccctttctgtctcttcagatgcaacttactagtctagacaaagcaggtttctcagtgaataaaacatgctctaatggggtgtacatcctggcacattataatagtagtcatttattgaatattatgtgccaggcacttgatataggtgctttccttttatcaatcacttaattcttcaaaacgaccttatgagataaggttgatgattcttgtcctccattatggcataaggaagttaaacaacataccccaagttaaacagatgtaaagtgatataccatactgtgataaagacacaggcaggttggtgtcagagatcatcttcttaatcacggtgatacactaacaagttataaactaacaagttaacttaaagtggtgataatactgaactgctgtgaggagaactatgatgacactgttacctataacctgtgatggtttgtacttgactagggttttgtcttatagcaagacctccattctttccgtaagtggtgatgtctcttaaatgggcctgccacggccttccttggtcctccctgtggaaattctccccttttcccctctccttcccttctgctgacctgttctcagtggtgtgctggttaaaaagaaaaaaagaaagccctcatttatatcatttgccaatttcagtggtgtaaatactcccataatggttgatttcaggtatccacaccacattacgaatacagatttgacaagagatgtgagttgtgaagacacgcagcaggacaccattatgtggaatttctgctgtctggatacaatagatacaaactttcagggcatggagaatagtatgttgtggtaaataattagaaagtgataagttttgagtatttatgacatttgtttttaatgcagtttacttagttataagcctatatcatgtaatttttaataatggctgagtttaacagctgtcttgcagaattcctgaaaatttaacaatgagcactcatgagcctacacaagccagctccagtataccactgtgatttctttgctgctgactgggcccacctttgaaaatctatggctgacacttccttactatctaagatgacatcagtgccatcctgtctttcactcttcctcctacagggctttctatctcattctcctaatccatatctactaccttccctgttcaaagcccatttctttccattcatccctgcactgtaatttgactcttcccatcccccaaatacgtttccctttcccatcacactttttttttttccccccatcaagttacttttcccagttaaaggaaagcctcagaccactagtatcttgggacatggagagtctcccagcaagatgttgggtcttatgaagtgaggaaatctttggtctagaaaaggaaaatacgttcttagaattccagggttgaaatctaggtgaaaagatttttttaaacttaatatataaaggaagttacagtgccattattatagtatgtagctactctaagaattacttcaggatggggaaaagtgagaccatggctaccatttaaaaccccattttaaagtaactgttttataaaaacctgtttttatttgcaaataagtgatttgataggtgatattttagaacacagtttatttatatgggggtggggggagctaacctatatttacagaataaggcctagtatagaggtcttttccattagtttttgtgtcatctgtcagcaaaactaattaggaccctgaaaaaattgtcagttgcagggatacatttctcactaatgaagaaacatggaaaatatctgtgtaaggggatcacgctgtttcttaagttcagattattggaagagggtggtgatgtaggtgtgtactcttcctgaggttgggtcaaactaaaatgataattgagaatgtcttgaatattgcccttgttaataagttgatctattttattttatttagaaacatggcagacttgttcactgtgtagccagactgatgtgtctatttattcttgtaggctggtctttcccaggcacagcagaataatttattaataccagggtattctttaaggatggtaggattaaagcatcatgacaaaaattgttacctagatctgtttttccttgttattttttcatcaccattctactcatttaatctttaaaagccatctcaagtaatagtaggtacctggttctactggagtaaaatgggagttagtggctgaaatgcagtttgttatttgctgtcagtgactttatcagtgtgcagagaatactccttcaaggaaaacaggtaattttaattccaggtgccttcggaatctaaatttcaagaggctttgaaatgaatggagcttctgtgttctcttctcttgaatattttgggcataaggtagtgtgacttaatattaaaaacaaacaaacaaacaaaacaacaaaaaaactacagaccaggtgcagtggctcatgcctgtaatctcaacatttttggcaggccaaggctggaggattgcttgagttcaggagtttgagaccatcctgggcaacatagggatacctgatctctacaaaaatttaaaaagccagaagtggtggcgcatgcctgtcgtcccagctacttgggaggcagctgggggaggatcacttgagtcctggaactgcaggctgtggtgagccctgattgtgccactgcactccagcctgggaaactaagtgagaacctgtctcaaacaacaacaaaaacccaattaaaggtatgaaagcaatttaaaacttacttgtaaaaagaggttcatattgaaagcattgctaaaaggatttcatctgcctataattagccacctcctctgtccccaaaggaaggcccagacttcactagtatcttggggcacagagagtctcccagcaagatgttgggtctcatatgaggacaaaattcttgatctggaaaaggaagatatattcttagaataccaggttagaaatcaaagtgaattttttttttttcctgtaaaagtccagatagtaaataatttaggctgtgggctaagttctcacgtaatcattaccttttatggcccattgtagtgcaaaactagccatggatggtgggtaaatgaatgggttgggttcaattaaacctttatttattgacagtgaaatttgaatttcatgtaattttcacattaaaaggattaaaaggccttctttcttccctaaccctaacccccacacccgcccccacaaaatgtaaaacaggggatggtgggaggctggaattgacttgtgggtcatagtttgtcaacctagtcatagtttgtcaacctgtgctgcaaaggatggaactttttatttgtacttttttcaggctgtgaggatatttcagtaccttgagaaatggactcttctcatacacgctgcaaaaacatctttttaactggttgcatcatgccaaagaagattacacattttaccaggctaagcttttcaaaaatgtttccaagagagagtcttataaacaagacagaagtctaattctgagtagtaactgaagtcagtgataattctgttttaccagctgtgatattccttggattaggatactgttgaatgctccactgtggtagtcgtagtagtcatggacccactggagcattgtttgttaatagacctggttcctaggtttgacttgatgatttttgctttttagtgtttagtaaaaaactaccttctgctcagttatgctgctgggcttagtaaattgtgaccacagggtggtatgtttctcttgttggctttaactgttgctaaaatcgaaaggaaaaatattctgtacataatgagaatttactcccctaattatgatgctaaaatggcccagccttctctagattgatttttctatagtgcattattaagatttatatagtattaaatctcagtgctttaaaccttgatgctttgtaatcttttgttatggttacaacaggaattatatagttcgtaattgggagaatgctaataattaggactgtatttcatagaatatatttagccactggccttgatttaaaaaaaaaaatcaatatataaaaactactaaagagtatttgcggctgggtacggtggcttactcctgtaatcctagcactttgggaggctgagacgggtggatcatctgaggtcaggattcgagaccaacctggccaacacggcgaaaccttgtctctactaaaaatacaaaaaaatttagctgggcgtggtggtgggtgcctgtaatcccagctactcaggaggctgagacatgaggatcgcttgaacctaggagttggaggttgcagtgagctgaggtcacgccactgcactccagcctgggcaacaagagggaaactccgtctcaaaaaaaaaaaaaaaaaaaaaaaagcaactgaaagacaaagatgtcttaccttctagtagttgcaaagtcatagacaaagttattggctcaagatttttgtctgattttatgggattaatgtaggggtggataaagaagagtaggaatgtcagatggtcaggaaatacaaattattagaaaagcagcctcctattgaaataggttaaaaatattatagaccgagagttgaacatgttccaggagctttcctatacagtcatgtgttgtttaaactatggggatacgttctgagaaatgtggtattaggtgattttgtttgttgtgcaaacatcatagcatatacttaacacaaacttggatgttgtagcctgctgtgcacttaagctggagcccaagctgatcttctttgcactctaccctttccaggcaagcctgttgctggagaatgtatggacttggtaatgatttatgggatatagaatttagagaattattgtcaactggaacacaggagttaaggagcattctgagtataaggatgtgatcatttattataccccctccatcctctctgccttatttttggattttcttctatgtctccccctgcccctcccctttttaacccattcatcaagtaaagttttccttcatcttgttgattaacttacttgtctaatgacctccactaaaatgtaagtttaaagaagagagagcgatcttattttcaggttcattctgtattgtgaatgcctagatgattgcctggtgtataagtgctcaatctttatacttgtttcagcttaccagaatgggggcatggtttagatgataaatttgattttcccttaaatatgatgtttgataaagataggctgcgaagaggaaccttactaatgtaaacttgctatattgtttcctttcctagggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtaagtatttgaatgggatccttactagcttttcctagttcttaaacccttttattcgatgtttatgagtatagagtgacaggaagagtgaagtgtagacagtataaaaaaatttattagtttataaagcagtttgaatatctggtcctgctggtattggagcagattgccagttttttattgctgtgccattttatgtatattactgttatgtcggccacctaccaaattctgtaaattataacttatttaagaactgggattatgacagttgaaagctgtatttatcctcctacttggcaaaaatgatgttgaaaattcaaggatttaaagattctagagagtctctaggtatattattgccaaatttttatggacagggaataaaagaaggtagtcagcatagataccgatttcttttctgaagagtattagatatccttccttgtaacccacagctccagtcatcttgtttcctgtgatgtatatcatatcagaaaggcttttctggaacttgaggtctgctctctagcaggtaccatccagtatcaccattgctgaacatttattatgtgttggtgatggggagaaacagcttcttaacctaggtataatcgatcagtccgtgactcagttctcattaggaaaggaattgaggtaatttttataaacataatacttcctataataggaacactttagggttaaagttcgagggctgtgtgtttatatacctgtgtgtgcatatatatccagaaagggcatataagtagatacaaggagactgcaagcagatataagggaaaaggcaaatacaaaaagcatggcctgtgtcctaactgtgatcctcagtcacaaatcccaacaaagtctgttctattggtggagagggatgtacctggaagcccttatgcctttactggtaaggtccttaaattaggatgggcagcaggcaattactttctcagagtcactgaacttgtatgacagcctggagctctaagtttgtaccagatccttgtacattgtcctcagcctccctttctgagctctagttcacatttcttcccttgactttgattctagtaccactttatatatgtctatgtaagtacccttgccctgcctacccaagccaagcagaatgggtattagactctgctcctttcctctaatttggtccgaatcctcagaaatcattcctgacccctttgctttggccctgtagtcctacctagtacctggcttttcttctgttttctgctaatcatctcttctcttagccacatttcactatttttccatcatgcttatgaggtcagataccagccacccgcaactctgctactctcctcatgaagagcatgtcactttctacacttgagagatcaaatctgaaatccagacccacaggaaggtgacgtgccactctccttgggtaatccctagggtcatttcgctgcaacaacatgcttaacagctcaattgaagaacctagaagagatgccattgaggccactttcctacagtaatgctaagatttacgcagcctctgtggaagacctgaatatgatgaccatagaaaagnnnnnnnnnnnnnnnnnnnnctcaccccctccccccgtcgcccccatcccattggcctgaatgttctgcttcccacctgaatttagtcaggcagctgatatgaggtgcctcatcacagcagaggtaacagaaggattagagtccttgaaagacctttttttacttctggaaggccaaatgcagagtaaggcaacactttaacgtgtgagcctttgatatgtgtgcaagggtaccagtgagatccttagttggtatagtagaaactctgttaactaagcaaaggagattcctgaccggaccctattgctctgcttatcacatatgagatttttctggttacttgtctttttcagctactgtcatttggcttagtttggtaatttattgtggaggggtagagatagaggcattttgggggttaacttgttttgcatttcttgtttataacatggggtaaattctttagcctggacctaaacttctttaaatctgcctttgtggacttagacttgtgtgttcccttccttcaggcccttactcagtatcacctcctcagtgaggcctttcggtccagctcataaaaatacacagctgcctcctctccacattccctatccccctttcctgctttatgtttctccattgcacttttcaacttctcacatatattttacttatttatcttatttattttctatctgccccaactaaagtgtcagctttatgaggacaaggatctttgtttggtttcttcactggtatctgctaagaaggctgttctaggaaactgtcacttgatagaacaacatttcacacatccagcttcccagaagctgctcttctagaaagatgtgtatgtatgtgaatacacccacactcgcactcacacgtaacccccctccccgcccccctttttttgttttttaataaattcaaaagagtctctggcttcttgagttgcatttttagcttggagaaggaatacgatgatttttgtgtaccagttagctgcattgatagcctcagatttcctgtttgctgagggcagtgttagattagtcaagaatctgcatggaaagtccagtcttcgtggaaagtccatgcagtgcactgtgcatcccagttcctggataaatgtgcatggtctgtttgttgcagcagctactgcctacagggatgtctctgcactctttgtgcttacgtgtgggactagctctgcaatttctagtcattttggctaagagaagaaaaagagctttgtgccttgttcttgtcccccaccccccaccccaagaaggagtcttgctctgttgcccaggctggaatgcaatggcacgatcttggctcactgcaacctccatctcctgggttcaagcagttctcctgcctcagcctcctgagcagctgggattacaggcgtaccaccacacttggctaaattttgtatttttagtagagatggggtttcaccatgttggccaggctggtcttgaactcctgacctcgtgatctgcccacctcggcctcccaaagtgctgggattacagacgtgagccaccgtgcccagcctcttcttgcttttattattatttttttatttttcatgtttcatccagattgctggctctgatttttctttgagttctctgtatgtttcactgtgtgttttgtaacattttagtttttcctaaaaccaaaggattgattaaccttcaaaaggcagcactttttgatgttagtctgtaaccttttatcaaatccatatttccctaaatagagttgacacacagacattctaaattatctcctaataaattgttttgactttggatattgaaattgcaggcccatctccccacccatctcagttttctctcttttttttgtgtgttttgtaataagtcctacaatgaagtgtgtgtgtgtctgtctgtctgtccctccctcctgccccctctttccccattcccctgtgtgtgtgtgtgtgtgtgtgtgtgtgtctgtgtgtaattacaaagaagttgtaaaggccttttaaagtagttatgatgtgatttcccctcctttttaaaaataaagtattttaagcgtaaatagtaacatcttagagggcaggtacgtggagactttgactttctattttatctatctttaaatttttttttttttttttttgagatggagtctcgctctgtggtccaggctggagtgcagtggcgcgatctcggctcactgcaagctccgcctcttgggttcacgccatcctcctgcctcagcctccaagtagctgggactacaggtgcccaccaccacacctggctaatttttttgtatttttagtagagacagggtttcaccgtgttagccaggatggtctcgatctcctgacctcgtgatccacctgccttggcctcccaaagtgctgggattacagttgtgagccaccgtgcccagcctgaattgtttaaatgtttacagtgagcatgttatttttatgatacatagtaatttttgatgaaaacattctgaaggctgaaaagaatgtcctgtcttttgaaaataaatccatctttgtgctgattaacactggaggctaaccaaagcgttataataaaatattacatttaaaacacctatgaaagtggctagttcaagaatataatttgccttgaaacatagcttgagatggaagtatacttctagtaatgaaagatcttgccttagtaataaatgaaagtaaaatattccattattgtcccttcatagaaaacaaatacaaccctaaatgacattttaattaactagtgattttcctctaaagctgagatttgtttttttaagacctatgtaggattggcaaatagtgtacaaaatctggacatcctttgaagataattgttggggtgggatgggggcatagagtactgttttattgtgttcatttttattaatgaaactgtgaatttagaccaagcagtgatttcatagtggaagatggaacaggatgtttagtgggttttgtatactatttttgtaaaaggctttggtgcagaatctttcataaaatgaaatctattttcagcatgtctgttatttatttttagaattcacagcaagggttcttgtttgaagaactacaaacctttattgactccaaatttgactcagctctgttatattttccttttctttttcactgataagggagggtactttataaagtagatttgtcattaaaaaagaataatacatttacctgatcagaagttcttttgggtttaaagaaaaaaattgcagcccagattgcaacaaatggtctgagttataatatgttatgtctttctttttctttctctctttttttttgttttgttttgagacagagtctcactcttttgtccaggctgaagtgcagtggcacaatcacagatcattgcaggcttgacttcccaggctgaagttattcttatacctcagcctcccaagtagcactcaccatcgtaagtggcacgtgtgtgtgtccatcataagtggctggcacgtgtgtgtgtgtgtagatggtgtctccctgtgttgcccaagctggtctcaaacttctggtctaagtgatccttctgcctccacctagcaaagtgttgggattacaggcgtgacccaccatacctggcctctttcatttctcgtcaaccaagaattactttctagcagcaggtgtccagtattaccaaatggaatagcatatttgaaaagaagttgtagacttttaatttaatgggcttcattagagaattctgacaccccccatcccccagcctggccctgcccctggcaacgcctgtcaaggtaatcagttatttttattggactttttctaacagtctccctattctgaaatactctcaagctatctctagacagatgagattttatattctacaaaacttaaattactgtcctaatgctagttagtacatatagtggttatactggaaaaacagagtgagaactagttgaagaggaaaaaaatctgttgtctactgtccttagttgtaatttttttttttttttttgagagggtgtctcgctctgtcgcccaggctggagtgcagtggcgcgatctctgctcactgcaagctccgcctcctgggttcaggccattctcctgcctcagcctcccgagttcccgagtagctgggactacaggcgcccgccaccacgcccggctaagtttttgtgttttttagtagagacggggtttcaccgtgttagccaggatggtcttgatctcctgacctcgtgatccgcccgccttggcctcccacagtgctgggattacaagcgtgagccaccgcacccggccctgttgtaatgttaggaggaaattatatatttcataactttggaaccatgaacacagcactggaatcctagggcatacaatattaagggagtgatatcctcccaagggggtgaaaattgccttttgggaccaaaaaaaacttacagtgatatataaaacacagttacacaaatttgtggtatatctgtggtattgaagtttcatgaagtgaggagtgagtagagaataatgtctgaaaaggctctttgggatatgataatggaagaaaaggctgagaaacactgccttagaggtgtgggctggaatatagcggagcacatttttagcattaaatctctccttcctcctctaaaatgctcatggtgaaattcctgtgcctactctttgttctcttctgattaaatactcctgtacacatagagacattttacacatataccaaatttgcacactactattaggtccccaaaacccagcagtgggtgtatacttctgcacataatcctatttcctattagagtctgaatctgaagactgaaaatttgtttcctttaaccctatcatagacacttcataaggaagaaaaagacaccagatttttagagactttgatgcgaaactgaagtaataaagatattatttttatattttccatcattttttctcttagaaggtgacatctgtgtgggactgggcttggctggcccagcaaacacttttagggtttctttttggatagctgatgaaacaaagttcctattgtttcatcctcaaaagagagggcccagatgggatgcattccacttttagcttaataggaaatgaagtaattcttgggctgtgcttcagcagttttgtttatcagtagcaatatttcgtttccatgggtgcggtgctccatatagtgagaaggagcctgcaggagagctctcccaacctcgcacacacacacctcctgacctgccagcataaaaaaggtgcagattaggtgattttaagagggtcatcagtagttaagtttttgtttctcacctaggtgctccttgtgtttttgtttattctttccctcctcacttaatttttttagttctatagtgccaatggcaagctttgttgggccatgctggagaagctctttgtagagtattagggatctgttttccttgagtttcctaaacagaagcattttaatagctaataataaaaactaccagttttagttgcccattttatgccagatactttgtgcacagctctaatgtttttaacaatccgtaaggttgatggtgttctcattttgtgtacaaggaaaacaggcttcaaggttgaatgactttctcaggataaccaaatctgttgcagtggagctggagttcaaacctaatattttctacttgacagctaattgccagcatacttgatgaggatccctacagtttactcagctgggagcagacttctcccaccccataatttatatttgtcttgtaagtggacttgatagtgtgagaagttcagaaattaattcctaatttaaaatacggaattaaagtttgggctgtgtttcttccaatagtttctctctctccttcccctctctaaatcctctagagtagctgccttcataagttcagtaaaattttcagaacttccctttttaaaaaaagattgggatttttattttcctttcttgttaccaggaaatttaatcaaaggaaaaacaccatggaactaactgaaaatcctgctattgttcttcctactgcagcttctgtttttatgcagaaagttagattgtggttattatatcaaattggatacagtttctcatccccatgtctttgcagtgtaattgtagacattgttaataaccctgcagttggccaggcacggtgtaaggtgtaatcccagcattttgggaggccaaggcgggcggattatgaggtcaggaggtcgagaccatcctggctaacgcaatgaaaccccatctctacaaaaatacaaaaaaattagcggggcatggtggcgggtgcctgtagtcccagctactcaggaggctgaggcagaagaatggtgtgaacccgggacgcagagcttgcagtgagccgagatcgtgccactgcactccagcctgggagacagagcgagactccgtctcaaaataaataaataaataaaataaccctgcagtctttatgtacaaaggtagtcatatgactaatgaccctgttgcaaatagtcatgtctctagcgctaatttatgatagtaagaggtttggtgtaggcatacgcggtgtaaaattattgagtctgtattatgtaactttttaaaaaatgctgatttaccccccaggtgctttatcagaaaggttataggaattaaaaaataatcttgagagccacttgaacctaatggaaaacattaatgtgagagagtaggcctgccaaactggtgtggttgatttccggacagtagggtgaggtactttattcttgatcagtagtaacgcttccaatgtactcttaagtttaataaagactaatccaggaaaccctgagttccccactcatcttttaaccctcaggttttcttttgaaaaagaagcctctaatcgtaccaaacaaattccagatttatggcatattttacttatgatgattcatagtttcttcttcagattttgaattcgtgtctgaagggaaaatattggattaacaattggacagtttctcaggtatctctttcatggctatttctgacattctgccttctcggttatacagtttgattttagttatacacagagctgacagtagctcacacatccatccattcacctgctaacaaactctgctaatgcagcagaaagagataagcatactgttgttgccaagcacaacccccgccccccaacacacacccatcccgcgttgttctgtttctctccctgtcgttcgccctcatcccattctgcctgagtaaacagtcattttagcaattcgggacaaatttctgtgctgatacttactttggcacttcacagttttgggtaaggtagcattgcttcaccatggctctttgctgtgtgaatggtgtttacttttagtggtattgtgactccctttctgattcaagggttcaggtttctcatctttgcataggcctgaggaaggagatcaataagaaaggaaaaggactggttaaatggatagggctgtggatattctgttttacatagtgtaatctctcttctaaggcactgtaaatttaaggtttgaaggcataattcaatttggatctcagattacttgcatcatcatcatcattgaattgtgaaattttgacatttattgacatttattcatatctacctcaaaggactttcagaagtttacagattagcttaattttggataaatgggacaatgctatatattgattctgttgacgaaccacagcatttcttctttaaagcagttctcctgactgacatacgtatcactccatccatccatcgttcatcatccatccaccatcagtttatttggaaattaagtgaggctatatatggtgttttgggtgataataataaagaatttaggaggccccttctagattttatttatttatttagagacagggtctctgtctcccaggctagagtccagtggcatgatcttggctcatggcaacctctgcctcccaggttcaagtgattctcctgcctcagcctccctagtagctgggactacagatgcccggctaatttttatttttagtacagacagagtcttgccatgttggccaggctggtctcgaactcctggcctcaagtgatctgcctgcctcggcctccgaaagtgctgggattacagcgtgagtcatcgcgcctggcctaagtccttcttaattgccatctcctttgtgaaatcttcctgcttttgcccacatatggaatgcaccactcctctccccagattgcactgtatttagatatttaggtattttagataggaaagttcttgtagaactcctctcattttgacttcattgcagttatctgcaacttgattctctgttatgaaccgtaaatctctggggagttgagactccttactttactcatcttcaccttctgatcatagtgcctggacttgatggatgtctagcttttagctcttgaacaaaactgagtcagatgttagagaatattttaaaagaaacattttctgctagaaaaatagacaaatcttactaactgaatcatttggcttgtttctgctaacattgatgtctgtgtagttaggctggctgcccttcaaagaaatattgcttttttcccctaattctctttcatatattaaatgcataaataccgcatatacattattataaagtgtgcatgcatgtgcacgtgctcgcacttgcacacacacaccaggcagcggatgcttcagcttgctacagccttcttagaaagaattcgacttggaaggcagtgggagtatcgtgtggattcagtgttcatgtgaagacttatcttcatggttcatgaaccaattattcttgcttaaaagttaaactagcccatcattccaagtgttaggctcctcttaggcagggacttagctcttagccttcttcctcttcaaacacattgccctgtttataggcaatgtgatacaaaacccttgcatcctgatataatagaccatgtcctttggcatcagcctcgactctgaataatgaattctgcaccttaatatctgtgtaacatggggcaagttacttctttaagtctcagtttctcatctataaattgagaacaatacatgcctcataaaattgttgtggagagatgactgtcagatgcctggcgtgtgctaggtacttgcttggtaaatgtttcctaccaccctaaaattacacagcagtgagagatttctcttgccacaggatgagggcttcaggaggcccttgggaaaaaagcatgtggaaaattaacttacttattattctgattacatggaagaaacattgtctctttcaaagacagcagaaagcttagttcattccaagtctgaaacctctgttggcctgtgcccgtggtatggaaattcagtcgcagggaccatgtagagggtttccctccatgcccttagctgtagaagagcagtctgaatgtgttagagattcagggaagtggcacgtgcatgggtgcccatgattaatcaggcagagcacaaagtggcattacccaaacaaaaacattaactctactttcttttctgtcatcagaaagataatgggagaaggatggtgataggagcatagttctggctatttgagatcagtgtgtgaaaacaggggaaatagtgttcattgtgatgagtatattctgaatattggaaatatttaattctgtgaggctaaaatttcaaaagaaagcccaattgtccaagaaggtcttacccatagacacgtggtgttaaatcttgctgacctgtctgcagccgaactctttggagtggcatgcagttttctgcctccaatcatcactcctgaggtgcctgccagtctgtacactgggcaccatggagtccttggcatgtttgcgtttcctgaactgggctcccagccacagcattgcattatcctcatgcaaaccaggtaatttcattgaagtcctcattacattagtggttgagatgggaaataatgtgtatctgagaacaaaaatcattacttattttttaggccttggattgctcatagtagtaaaataaaatcaagtaattatgtacttttccaagtgcttcatcatgtgagcctttgtatcgtgataataaagcaagtgctagtgaatctgtaaaattcttgctatataacttgtatgagtgatattttttcctgttatgttttcagatctaatttagttcagtagctattggactttccatcatatgctatgccttgaaggtccttcagctttcattcttaaatatgttcaaattgaatagcccttgttgacattcagagcctgttcggttccagataccatgttataggcatggtgaaagctgggatacaaagttttttgttttttgttaagggaattcatatttgcaaataatgttaaaagctgaaaatggagttttaagaagtttggaaaaatgctgtcagagctcaagaggaaggagggggtgttttttaggaggagaaatttgtatgtcgtgaaataagagctaagaggatccactagcgtcctttcagcagtgaggctctaatactgttttatttgctgcctgtgtttcctttaggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatggtgagaatttatatgatctacaaacacactttaagtttgtgatatttctactttttttttaatggggctacttttctatggtcatcatattcaggtcttccacagaggctgcgtaaatcttagaattactgtaggaaagtggcctcaatggcatctcttctaggttcttcaattgagctgttaagcatgttgttgcagcgaaatgaccctagggattacccaaggagagtggcacgtcaccttcctgtgggtctggatttcagatttgatctctcaagtgtagaaagtgacacgctcttcatgaggagagtagcagagttactttttggtgtttaatgatcaaagacatggttttcattattgtattctgaagttctctaaagatagcctggaagtgaaggagaggaaagattgggcagtgagtgggaggagcatgagaacagggtgtgctctgagaaaccacacacttccttaaccaggttagtgtcactcttactgactttatctgttggccctccctatgagagttcactgaagaaaggactttttgtttgttttttgtttttttttgagaacgggctttcactcttgtagtccaggctggagtgcagtggcatgatctcggctcactgcagcctccacctcctgggttcaggtgattctgctgcctcagcctcccaaatagctgggattacaggcatgtaccaccatgcctagcaaatttttttttttttttaattagagacagggtttcaccgtgttagtcaggctggtctcgaactcctgacctcaggtaatctacccacctcggcctcccaaagtgctgggattataggcatgagccactgcgcccggccagaactccactttttcaaaaatatttacatagtaagtcctcttactcaaacaagggttttcccacataattctagtagccaatgacatctacttgatgtcataattgtatagatattttttaatgaaacataatgtgtacctggagttcaataagtaacatccagtttcccttctgagttcaagtccaattgaacgatttgggagtcctgagatagaaaccaaaatgtttattactgatgaaatctagattggaagcctgatgttagagctcctgccagaagggtctgcttgtactttctatgtcttcaatgaaagagctggtcagtcacaccattgccctgtagagtccacccagccttgagtattgaattattttgggtaagcagaccacaagtcactctccccacaggtgagcagttcctgaggagaaatacccagaggggcctgagccatagcatagttagtttctacactcagatgaattttgtcttcttccatggaagaatggtaaagaggtctttgccagctttgattctcttaaatctacactaaatttaacagttaaacctgtggtcagccgtcagaacggtgtcccatactgtcaggtgcatactgtcagattctacctggatagtcctgcccaggtaaaacctgaaaggaagtatcaaatcaaggaagaaaggatttatccttttcttcttctttttttaagtatagtgtccaagaaacttctgtcttgctaatatttagagatcagaatatttgacattctgaaaaggcactcatgccttatataaacctggtgatgggccttaatacctctagctcctcctatttctgtattgatacaggaatgtttattctggctgcctttcacaaatcagtgtcaagatagtactgcattagttatttgtggggcttatggtgttttatggttttgttttgtcttgtttaaagaggggcccaggagttggatagttttatgttgccatgattaaaaacaactattagaaaaagcaaacatctgaaactttggacatatcacttcctctttctctctcttttttttttttttttttgagatagagtcttgctctgtcgcccaggctggagtgcaatggtgcaatctcggctcactgcaacctgcatctcctgggttgaagcgattctcctgccttagcctcccaagtagctgggaatacaggcacatgccaccacaccctgctgcttttttgtgtgttttagtagagacggggtttcaccatgttgcccaggctggtcttgaactcctgagctcaggcaatccacccgcctcagcctcccaaagtgctaggattacaggcgtgagccactgtgcccggccacttcctctctttgggccttaacttccttgtctttaataggagggaattggccagctttaatttttttttgtactgtcagtgtactggtaaattttctgttgcacaaaattgctcaagcagtgctaacaaaggccaaaccaaatttgaacacttgaggaaggaaatacatattaaaaccacaatgagatatcattacacatttatcataatggctaagatgaagaataccaagtgctggcaaagatgaagaacatatcatatgttgcttgtaggaatgcaaaatgtataaccactctagaaatatttggcagtttcttgtaaagttaaacatacacttagcgtatgacccagtaatcccacttttgggtgtttatcctagagaaatgaaaatctgtagtcaccaaaaagtctgtgcacagacgtgctcatagtaatgttattcataatcttcaaaaactggaaataacccagatttccctcactgagtgaatacagaagcacactataatatatccatacagtggaatactactcagcaataaaaagaagcaaactgttgacatgtgcaacaacttggatgtgttttaaatgcattatgcgggaaaatgaagtcagtttccaaaggttccatactatgtgattctatttatatgatattctggaagatgcaaaattatagaaaaagagaacagatgagtagttgctaggggctgggagtgggggaagtctgactggaaagaggtatcatgagggaattctttgggttgttggagttgttttgtcttgttcgtggtggtggctgtaagaatctatgcatgtgttaaaactcataggagtgtacatcccctaaaggtgaattttattgtacatatatttaaaataataaaataacaaaagaaattgtgtaagttgtatactttgcaaggtgaaatgcatgcaagtgacttgatagaagtgtctttaagtcaacaactgggatgaggaatctgattttctgtgctcaattcacattctgcagtttaaattgttctattaattgatgattagaatctgggaacactgggtacagtaaggggagagaagcatcagttaagagttcatcacgcctgctgttgagggacaaatgtaatggaatagtctgttcacatcaatgagttgcacatcaaatacttttaaataggtatttaaaggagaaaggtacaaagtaaccatgatgcctgaggtaatacaggtaaataaggcaccttgttacataacaggacttcttgctgttgaaagctaggatgtttagagttattctagcctaatacttagacaaagtagtttatgtaagatttatggctaatcctcctactgttttaattgtttagttgcagtgctttttagctttcttcaggtcagtgactcctttggaaattgctcagatttctcctcagaaaaaaatgtttataggtgcctacgtgcacacatttacatatgataaatttcttaagtctccctgaacttcaggcatgagcataaagttaagaattctgggtttaactttgctcttacaaagtgggaaaagcaggggcattggagtcagtttgtttgcatcctggcttcattgcaagagtttgtgcaaaatacttaatctctctgttacttaatttcctcatctgtgaaatgggggaaagtgtattctgataatgtgtgctagtttataagctattcattttgaatgtaccatttggagacacaaaacattgatgttttacttgttacaaaaattaatcttcactttaaatatgaacaggagggagtttgtccttttaaatcttccaaatgttctctcatccctaattatataaacaagcttctacacattgtactgtttgccacagttctgccttaaatgcaggtgataaggattcatctgggtgtggcgtgaatggtggggtaaggacatttttttctctgagttttccaagtctcacttagtttctcagctcggtggttagtgaaaatggtaagctaggggggtgttttccctgagagacccttgtgcagtagccgtcagcataactcccaggtaatgtagggtgggcccactgcagacttgctctagaggaagcagggagaaacatcctgggggaatcttcattcttatttactcatgatattgtataaccaagtgaaaaagagatctgatcatctttgggggcaagaattctcccctcaaagagaaatttgggtggagaggtggaagacaggtttaggaaaaactgcagtaagaacagcctgtgtattcccaattctatacatctgatattggttaataggtcgcccaccataatcatttgatgattcagttcccacctcctttcagagtgtttgatagcttttctttctttttttttttttttttgagacggagtctcgctctgtcgcccaggctggagtgcagtggtgtgatctcagctcactgcaagctccgcctcccaggttcacgccattctcctgcctcagcctcccgagtagccgggactacagacgcccgccaccacgcccagctaattttttatatttttagtagagacggggtttcactgtgttagccaggatggtctcgatctcctgacctcgtgatcctcccgcctcggcctcccaaagtgctgggattacaggcttgagccaccgcgcccggccttgatagcttttcataaatattttttcgtagctacattagtgtttgtgtattttttttttttgagggagtcttgctctgtcccccaggctagagtgcagtggtgcgatctcagctcactgcaagctccgcctcccaggttcacaccattctcctgcctcagcctcttgagtagctgggactacaggtgcccgccaccacgccaggctaattttttgtattttttggtagagacggggtttcaccatgttagccaggatggtctcgatctcctgatctcatgatcctcccgcctcggcctcccaaagtgctgggttacaggcatgagccactgtgcctggcctgtgtttgtgtattttttcagctgtcatcactgctgaaaagaaaataacaacatattttaaaactgctagtggtttttttttccccttggcagaagattaatatttattgatcccaagactagtagtggtaggacttgagctccaaaaggttttgttgcctctgaaaccttgtttttgttacaaggttacaggtctcatttttccacaactgcattttctcacagtggcctgttctccttcctttcacatgcagctgagaattcctgcatcatgtgggactttaggttttttaagaggtagtccagaatagtacaaagaatggtgattttggaatcataggtatagattcaaagagtactgtaagctgggcttgctggggggattgatggggtaggaaagtagtccttgattattgtactgatctcagaacttagaacattttacttagagaatctgaccatttataaaagatacaaccctctagcaggctcatcatgcttgaatgcctactaggcacatcaacttttttgcagatctgagggaaggtgtgtgacaggtgtgtccagcatataagtaaatagaaagcaggatgtgagacattttctgccttccttctctgtgggtagaggctaagcctacagagatctttccaattaagtatggttaaacaggataaccagccaacatggggtctatggaataacattacagcataaagaaaagggaaaagtatcataagtattcagatggaagattttctgagtatgctttctgtaagaaacaaaaaaatgtagatgatatttcccatttgccctttaaagagctcaataaaatcaggtttattatgaaattagagaaggagacagcaaggagaaaagtaggttttatgagtcagtgttcaagtagagaagcagaaccactaagagaaataatatgttgagatttattacaaggaatggcgcctttgattgtgagggctaataagtccaaaatttgtagggcaggagggggagggaagatcatgggcaaaagtcagtccaccaacatgggccaaaatatcacgtgaggaagggaagatcgtgggcaggatggagctccacaggcacaggctagtgctgtcctccacaggtggaatggaatcccttctctccaggggaaatctaagacctgctttcagagccttccagttgatgcagtgggattatcctgcccacataatccaggataacctcccttattagatcaactggttaggggctttaattacatctgcggcaaagctattattatgacgacaaggatggaaggggagtgagttggcaaaaatgatgcagccatccacaatcctaaagcacagttaattcacactggggacaaaggactcagttgacactgtaggaaaggccattagtgatctaaaaaaatgaagttgagtaactcagattacagaggagtactgatgcagagaaaagggaacagagattgatcctaaatgattgagctctgcagtttaaacacaaaaggaagaaagcagtgatggaagctttcatgctcttaaaacaacacagactaaaggaaactaaattcatatattcgtttatccctttgcaccttggcctcttctacaaacctaattcacatgacccctgaatcaaataaaaatgtgtgagaaattaatgggagaatacctaaaactgggggtatatgcatgcggtggactactcagcagtaaaagagaatgtactactgctacatgcagcaatgtagatgaatctcaaacatgctcatcgaagaagccttacacaagagtgtatattctataatttcatctatatggagttgtagaacaggcaaaactaatgtaggtgaaaaattcagaacaatggttaactctgaatgaggaggagaggattaactggaaagtggcacaaaagaacttttttggatattggtaattttctatatgttggtacagatttgggttcacgtgtatatgcatttgtcaaaatttatcaaatgggtatactataccatatgtatttcattgtatataaatcacctaaaattgtaactacatattgaatgctagttaattatatgcatgctgaagtattttggggtgaagtggactgatatcttcaagttattttgaaatgcataaaaataaggtggatcgatggggaaatagaaggaagaatcgttggatatatatgtgataaggcaaatatagaaaaacattaattgtaggatctaggttgttgagtgagtgtctggctatttgctgtgtgattctttgaactatgtgtatgttggaaaagttaataaaatgttggaagaaaacataaaaaggtgctttttaaaccacattagtttagcttgcttgtatgattgcttgtttttgtatttgtggttttatttcctagcaaaaagaaacagggtggagtaatggaaaaggttttttgtttgtttgtttgtttaatgcaagacagaagaacttttgattttaaatcctgatctgactgtgggcaagctattaattctatgaatctgccttcatttgcacaatgaagataaccagacctcatagggttactgagaagatagaatggaaaaagttgacataaactgcctagcccagtgcatggtgcatagcactacattgttttctcctaatctgttatcctcagaaagggtctacacaaaagcagatgtggtaccagttgctaagactttcagaaattgagagaggatgtagtgcagaagtcagggcatcagcttctgagcaggcgtgtggctgtagtattgggatttctactgaaatgctgagctgactcagaacaaataacaaatcagaagagtggttgtgggagggtggtaaagagacagctgcttcaaggttggaaataactagcctctaaagaatcaggtatttcctagttagtgcctcattagctctttgttcttgataaggatgtcagaacaactgtaaggcaaaagttagatggtgctatttgatcttttgtgaggattctatttgtccttttgtctggccttgccatctgcgcagaggtgttgattattaaaatttgtacctgcacatgtagttgttgcttctggggcataatctttccagccatgtgcctctggttaaacaccctttaaatcctgaattggtctatgcgtatacagttctgtagggaaaatatacaatatgaaaaattgtgcttccaaggaaatttaccttggaaatagggataccagactaatacacagatgacatttggaaacagtgtaattcagtgtaaaatcacagcttcaaaaatctgttcattcctttgtgatattcacgtatagaagcatttgaggacttcacagtaaggagaaaaccactggggtccaaaaagtccgagtgctcagtgaagaagtttagacccgtgggaagccatgaagaaagagatgatagctaagctgaggcaggcacaacttcagggtgccattcccagctccctggagttaagtgtagtacagccttgtggggctatatgtggcatccctgcaaagacctcagctcctgtcatcctaggttgggcactgaggactgctgaaggaagagagtattgctagtgaaccttgaatgtaatttgatgtccaagaggacagtgaagagagccgggaaacagagaggaactgggatttaatgaatgtctactacagccagtcataatactagcatttcatctacctcttctcatttgttacacctctgtgagtgaggtgttggtatctcactttagggatgaagaaagtgaagttcagagatgttacatgaatcacgcttggtcacacagatggtaaatgccagattcgaaccctgatttgtctaactacaagcccttcctcattctgtcactttcagagtgactcactttactaagagggagcctttatttcaagttaaataaacgttttcctttctgcagttattagtggattgtcttagagttagtcttccttattgtgccaggagatgcatttcttcctctcattaaacaaataaataaagctggcagtgccagaaatttgatttgcccttattgtgtaggaataaaaagacccatgtgtactgaacaagcagaacctgtttttagtgtttaactagccaactcctgtctgggtgttcttttaaaaagtaattataccatttatgatacacccatttaagtcccaacagctattccctcttggacctcatgttgtggggctgcatttgcttctgttattattatttgagtaaaagaacgtgtgtatgggtcgcctttatatgcctgcctgtgaaattggttgaacaaacactgtgtattaagtcagaatatagaaatgtcctgattctcttttgcaggactgtgttcgattgaagattttgcttcctatactttctatgcttttgtagctttgttttgcctttacttgagggctgattctacctggccacaataaagctgttcacactgtatgttgtagcttaactttacaatcttaggcacttggaggcagtggtgtttacataacttgtctttatgtttgtttgttttttgtttttatattttcctcacttacgttcattttctcccccatttacagatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgagtaagtgctccttctgccttatttctctcctctcatccccagccccacccccgattcataggagtaccacccacttggcatctcattgtgtgtttgccgcaaattaaaacctcagctctgtaccttgccttctgctggaggtttgtaagcttgctcctgctaaccacttcattgtctgagagagaaacgtaagtcgtgttaaccattttctctctcgtctgcctgcctgccttcttcaattcttatctcttatattttactattttactcaaaagtcagaatgagccttgtctgtggaggtagcataacattaccaatgtatacagtttatcctggtttagtacaagaggaaacagatttcctatatcatatatttttttctggtatgtctttaagacttgaaagagttaattagaaaccagtacttccatattataattgcatacagaaaatattgtaaacaattaagttttggattgaatgtaatttctgtgaataaaatttgagagcagtggtttcttcatatgaacagcaataaaaagcaactgaattgtcctggaaatgtgcagtaggaaatcctgtctgtttttgggctcaattattatatgtcctgactctttaaagagttctctagaggaaggttgttagtcaaaacatttgaagagcgctcttttattcttgtataaataaagaaataaacacactaaagcagccaaaagtttttattggaatgtttatataaagaagtttcaagaatagtttctgttgtttaatacatttttattagttttgtggttatcatcattatcttttccaccacattatctgaacaagtataaacccattggatctatgttctttagcaattgagggacctgtgcaaattgagtcagtattagcaaattctcagatattttgctcatgccagatttaatttagttgtgctttatgttttaccatttttaactgtgtatatagtctggaaggaccaaaaagagacctcagaatgtagtgctacttacggttatgtaaacagctttttcttgattcacttgccaggcttatacctttccccatcacgctagacagacagttctttgcagaaagctttctgatgggtgctacagatacagtggtggtaggaggggcacttatatcaaatgagctttggatacctgagctctcctaagacagtattccagggagtgatacattctactccttcacacttcccatctggccactgattggattcattctacggttagcctcatggcctcaggaagagaggccttgtttcagaagttgaaacagttaactctgcataactattgtgaagttcaaatgcatttcctctaaatttgatttttgctgggaagcagagttggttaaggactgccatccaaatggggaaataaagtgattacaacagcttcattatatccttggaggggatgtcacaagactgttattgcagcacagctttaaggaaactagagtgtgtttgttctttgacttttttttgcttactttaaaagtactacttctgttacatgtgggaaagccacttacctccttttgaagggagattggtaagggaaaaccaacctgagaaatcaccaatagaggaccctgataggagaggatgagcaccttgctgcagatctagctcttaacttgaattctgggatgttactgttgtgaagcttagaaaaagttctgagtcataattagcgattaaaaaatggaaagggggcgattgtcccaaatcactcagtgtgagagtgattctagtagaatttggtagaatttcagttgttaaagaatcaagaatgatcattttgttattggttttcttttctcctttccttcccctttcttttcctatatacataacgtaaaaatggttaaaatagtaaattttagggacagcattcagtagcattcagtaccatcacaacactcacagagttacgtaaccatcaccactattatttccagaactttgtcatcacccaaactgaacttccttttctccagcccctgataacctctgttctcctttctgtctctaagaatttgcccattctaggtacctcatataagtgaaatcatgcaacatttgtctttctgtgtctgtcttttacatagctaatgtcctcaaggttcacccatgttgtaacgtgtcagaaaaacaatatgtacttcaaaattgctaaaaaagaatgtatttctcaccacaaaaaaataagtagctgagatgatggatatgttacttaggttgattttatctttctatggtatatacatagattaaaacatcacactgtaccccataaataaatttatataattgttgttaccaaacacacacacacacacacacacacacacacacacacacacacacacacagccaaaagtgtaaacaacctagatgtccatcacagataaatggacaatgtggtatattcatataacggaatactacagccttaaaaagaaaagatcatctttaacagatgaaactgagatccagagagacaaagtggttggatgaagataacaaggtggtatgaccagaaatagaagccaaaagctgtccagagctctttccttccactcctgggattcttaaaaagtggcccaagaatagacttcatggggtctgtatctcttgaaattataaaggtttatgcacatgtttttctgaataaagcatttgttggtgagattcacgaaggggtttgtagaaagttaagaatcgccacaatgtatgatgctatctttcttttttttttttttttcttttctttgagatggagtcttgctctgtagcccaggctggagtgcagtggcacgatcttgtctcactgcagcctctgcctcccaggctcaagcaattcttctgcctcagcctcctgagtagctgggattacaggcatgcgccaccatgtccggctaatttttgtatttttagtagagacggggtttcaccatgttggtcaggctggtctcgaacttctaacctcgtgatccacccacctcggcctcccaaagtgctgggattacaggcgtgagccaccgcgcccagccatgatgctatctttctaatagtttgggtatcttcttccccaccctgctttttaaaaatgaaattgtccacatataagccggcctcttttattgcctcttttcagttagtatgaaattgaagtatggctatgtatattttacatttattgaataactagttgcattctacactttactgaaaagtcaagcttatttaaccccatttatagcccttcccaagtacatttgttgttttaattccttggtgctttaccttgttttttgctttttaatttttaagtggggtgtggggagccttgtgctggttagggcccaagttctttttgtgtttctttgttcaaggcttattttgattgccagtctattttgataaagcaagtcttacttctgcgaaaattatgattagccattcttggacatataaggattctctaagacctatccctttagaaaacacttgaactttattttaaatcctaccagatagtaataactactcaggacattttttttacagtttcccttttttgtaacccatgattgttaactttcactttgttcagtgttagggaaggcagagcttttgttgacttgctgtttcactttagcttatatttagatcttacattatgaatatgaatgcatttgtgatctgaaaattcatcttaaatacattgtatttaagtttcactctaagtaaatgaaagaattcatgtagggagcataactcagtgattgacatatatgttatctcttatttccctttctttaattttctgtcttgcctgagaaatcttagccccagaagagtacccaaaacatgtaggcctacttttcctttagttggacaatcatctcctctgatttgaagaccccacccatggtcacctaactagttagtgatggagagaataggtaaagaccccagtttgcaggctcttggtgtcatgaatgctaggaagtgacaatatcagatgagcgtggcattgtagttatctaagaagaaaatattagagccagatgttattggatctggctgatctcttactcacacatctcaaagtagaaatcttgggacttggatcacccatgttgggggtatgagggagcttgagagtaagaggaggctccagctagtgactaggtgtgcaaacttggaagtcaaacctaggtttgcattttggctctgccatttgcaaactttccttgctaagccttgatttcttcatctcataaataaaggatattgctatttacttcctggatgataacccagcctttagtgtatgcaatatgaaaaattagggcttatttgtcatacagattctggttatttttgtggagcaaataaaggtgcataaatatttcttcttggagaaagatggtagtatagtatggtagaactgcttacggattaaaagcttaataaaaatctaagcttgcctacttagtagttagtgtgacttggaaaatgtcacctatccactgagtctcatgtttcccctctcttaatgataatacctgttctgcctacatcacaaggttattttaactaaaaaaagattggtgcaaatactttgttaaactctaagatactctatttgaacatttcttatatattaataataataatgacatcagtaaaattagagttaactgatcaatgaaactcaaattccagttgatcggtctaccagatatcttgttttgtaatatttcttgtagttctctgtgaattaaagttagtagagagattggagaattgtagttagactggctggttttgaatccagggtctacttctgtgaaactgtattatttatcttgggtgattcacttaacctctccaaacctcagtgccttttttttttttttttttggtctcacaagaagaagaagaggactgtcttcaatgggttgctttgagaaataaacaattcatgtagagagcataactcagtgattgacataaatgttacccccatttccctttctttaattttcttttccttctaatgcctatgtcagtttttcatacttcagggaaattttaccagaatcttgaagtattttaagcatcatttgaatgtccctgcttgatgtaggacttgatgtagggacttgatgtaggttggaaattattccctagtgtaatagatactactttaaataaaattagtttggccctttgatacatgctgtgatgttgatgcctgtagattaatggaacaaggaattctagatggataaaaaatcatttacagtccttccacccttataagaagagtatttattttaagaatttcaactctggagtggtggcatacaagtgctgaaatatttcagttgccataagagccagtttaaacatatttgtcctcataaatgtcatcttatttttagtatcagctgaacaaatcttcatttattgaatgcctatactgcactagaaaccatggttggtacattacagatattgtttcatttcaaccttatatcaacctcgtgaaataggcattatctgtgttttgcgggagaaatatggaggctcagataattaaagtaactagtccaaggctatatagaaaattgtagagctactgttacacagacagctgtggaatgccaaggcccatattcttccctctacaaaaatttggcagagagaaagaagagactcaggacgaggctactagggtacagtattaaatgactcttaaatgtaaagggttatatggtttctagtctatatgttttttgaggaaaacaaggttcttactataataactgtacatttatattacccattatatgacttttaaagtatggttgattacatttaagctaccattttacatatggtaagtattgtcatctctgattgattgattgattgagacagactattgctgtcacccaggctggagtgcagtggcatgattccggctcactgcagcctccacctcccaggttcaagtgattctcctgccttagcctcccgagtatctgggattacaggtgcacgccaccacgcccggcttatttttgaatttttagtagagacggggtttcaccgtgtcggtcaggctggtctcgatttcgtgacctcgtgatccgcctgccttggcctcccaaagtgctgggattacagacgtgagccactgcacctggccatctctgttttataattgaggaaactgaggccagagaggtaaagtgacttgcccaaggtctcggttcacaaggttgcaaagtaacagaacctaaagtgcaccgatctgtccagattgaggggacacatgtgaatgttgaacacagacccagcctgacaagctctaggtactcagtcatgatttactgtagtgggcactattggcccctctcaaagggtttgtgcctgtaagctctcaagtccttcttacaagacaattgtgcttgaaacctaggtgtagggttaggtggtggagtgactactcaagaatacatatttcacaatggaaccaagtgctattgagcaagatgttctgccaacatagtaattttgcccttttagattcctcttcaggtacttgacaagtgggtcctcagtagcccatctggtgcaaaacaagtttggagactttgcttttgcatagtaaagcaaaagatgaaacaaatgtacagacataccttaaaaataataaccagagaggcaggatttgggataacttgacatctggccaaattcccattcatcagtctgtccatccctttgtatctgacttcctttgtcattgtgtgatctaggtctttgtgtcttggtaaagataaggttgtagaactgagtggaaactagagaatgggggaggagactaacatttattgaatattgaatacctgctttgtattatgcacagtactaccttggtgctttacttgcgttttcatttaaaacccctcagcaaaccttggggaggctaaagcagcttgtccaaggccgtatagttagtcgctcttttcacaacctgtctttaggttgtatttggatttattcatagaattttgtgaggaggcatgtttggtagcattttcaggcttttaacctaattaatttatgatggttaataactctggttctcagtgcctttttttccccctaagttttcagctggacaactttaagcattttgacattttgtattttttaaaccatttaactagtaatctcaggattgcctatctggcaacatgctagaaaattgcaaaatgtactttctgaagataatattgtacttatagagcaatttattgtattcgttgctaggtattttgtgtaaattctcatatctttatcctctccccagccctttgaaggtgggcgttttatctccattgcacaaggaaatgtaatagccatagctggtaagtgatggaggaataatttgaaccaggttgtaactccaagtcctgtgaacttttacaaactcccttgggctttctaagaagatgggtaggaatttaaagttggttggaatcacagagccattccaagcatcttgtgtttctataaacttcttttctctccctgcagaatgacacatatgtactgagcaaggtatgtgtttgttcttggttgccgtataacatttagacttcagagtggtcagagttgtgaaattacactacttgatctgtggtaacaaattatctatggcaacagcatgtgatttgtttctgacttcacttcaggcttaagtggaagaaaatacagacctggagtatagggcttgatagtcaggtgtgagaaaatgaaggatcagttgatagcaccttctgctcttaaaagctacatgtgatttttacttggtcaattctaaagttttcttaaacgcataccaatagaaagaatgacttgaacattttacctgcatttattattggcagaaatagaagtgattggggaaacaaggaaagtgattagagaaacaagaaaaaaactaggtgtgttgaataaacattttcactaaaaccattatttggctggagcagaatatcaccagcatagaatgaagttacgcgatacaagaataaatatgaggtagtaaaaaaatacaaccaatcctatgcatttattaatatctgcctgttctgttttgaaagtttaaccttatagtaggagaacagtttctcagcattaccaacttctagattgttcttgattcattaaacagcatatacaacttgtcctggcacatcagtaagacctctatctagttgaactacagacagttataattcagggaagtttttcagtaacatgttctagaaggaattttgtgttaggattctggatttaatgaatcacaaaaatcttttagctgctgaaattggttatcattgtataataatcattttgacaaggttttgtttaaatctttaatgtccatagacataaataaggcgcagtattcttaagtattcttcttaaagcctattttgttttattaatgaaaacaaaatgtatttgaggtacctgatatttttcctaacacttttaaaaatacatttatatcaggattgaggataatttatcatcgtttttttggccttttttttttttttttttgagacggagtctcgttctgtcacccaggctgaagtgcagtggtgcgatctcagctcactgcaacctccgcctcccgggttcaagtgattcttttgcctcagcctcctgagtggctggaactacaggcgtgtgccaccatgcccggctaatttttttgtatgttttttcaccgtgttagccaggatggatttatcatagtttttatacatgattttggccattttttcttacaaaatttggagatggcaatgttgacattctgctcttaattttattcttatgtgaatgattttcaaattgaacttaccctagaaagacacatggcctaaatggaatatctacaatttaaaaaattgttttatttaatgtttagtgttctgaacactagttaataaaaagttaaatctagagttttaatataatctaacatctgtaattcttttttttttttttttttttggagacggagtttcgctctttttgcccaatttggagtgcaatggcacgatctcagctcactgcagcctccacctcccagatgcaaacaattctcctgccttggcctcctgagtagctgggattacgggcactcgccaccatgcccagccaattttttgtagttttagtagaaacagggtttcaccatattaaccaggctggtcttgaactcctgacctcaggtgatccgcctgcctcggcctcccaaagtgctgggattacaggcatgagccaccgtgcctggcctaacatctgtaattcttataccatttaaattttaataaatatttgttggcttaataaagataaaatgttcttcctaaggttatctagccggtgcactatctcttaatattcattttaactgtcaaactatttatccatttgaaaactctttagttgtttttgcatatgacattaacagtttctatagtcactgattattgtaccattttattcttatagtacatattttatgctttaactggccaatagaatttctgcataaaaagcacataaggagatttgtactttaaatcaggggtccccaccgcctaggctacagactggtactggtccatggactgttaggacccaggttgcacagcaagaggtgagtgtcaggcgggcgagcgagcattaccacctgagcttgcctactgtccagtcagtggtgacattagattctcataggagtggaaaccgtatcgtgaactgcatatgtgagggatctaggttgcatgcttcttatgagaatctaatgcctgatgatctgaggtggaacagtttcatcccagaaccattccataccccgccccctcatctgtggaaaaattgccttccgtgaaactggtccttggtgcgaaaaatgctggggaccgctggtttagattatgtagagaatgcttacatagtactctttattttaatagtatttcttgtattggtggtgctgcctcactgatagtgatggtagccctgtaatcacttaatccttgttcagcaggcatccatctctttggccttaaaaatggcaaagctgaacttggtgtgtccctattgtttaacatctcttataggcctcagtttcttcatctacaaaatagggaaaaataatatgtacctcatagatctgttaggattaaacaagaacatgtttataaagttcttaggagcttagatatctctttatttggagagctaggaaggacaattcattggaaatatttcaggtgcgtatgaatatgatatctcttttaaccaccattcagtttctgacttactgtttcctagtcagcctcaccccacaattgtaactatctcttaacctagtggggaaaccaagccccattttccttacagaattttggagggtaaattgtggtaggtgttgtaggggtagttgcttgacacttaccccacaagcaggcttcccttacttttttttcttttttttttaagtctaatactcagaagttgccttcttttttggttcattagaattataccagccctctagcataccacacagtcacaatatatcaatcgtttcgggtgtccagacagctaacattttgaattcacattcatttaatcctcatgacagatttagtattttcactttacagatgaggaaattgaagcgcagagaaatttaagtagtccaagatcacaaagatggtaaggtgagagtaaggaatcaaaccaactctgtctgactttccagcttatgctctaacaattaccttataaaactttttttgtttaaaagcacaaaatttagagcaaattactcatagacagtagttgcttcaaggatgtgccttctttttctttgcactctccttatgctaattattaaggcgagagtggcagttctatgttccctcccccccaaaaaaaggaaggaaaagaggaaaactaagtttcagtgctaaaatatcttgtggccctgggtatgcaggattgcatatctgaccataactagcctagcagcgagttccctacggatagctaaaatacatcattttgaggtggattagctaccccccaccccctacccctttctggcatttagcttctccagctccatttgagtagagttgtggttgggtttgtagaactcattaaggttggacactattatggtgatgtggttttgagaagatattgcaatagccctcagaaaaggaactagatgctgcagttccttgtcagaagtaaacttggagcgaaacacgcctttaggaggggtaaccaggctgctttcctctatttttaaagctgtagtatgaagccaaaactaaaagaggatgggcttgcgatattcggggtgcttgggcagccatgtgtgagtatcagcttccagaccaatgctttgttaatcttcattgtttattctctgacattttctctggctttttgctgtaactcaacctgaagcatcattgaacttccctgaaggacttgtgttgttaggatcagaaaagtgttcttctctgcagttaagttaatttgactgggttttctatgtatgttagcataaaaccccattgttttcttgcgcatgctaggcaaggtaagaaggcagagactgattggttgttgattattgcatggcaggtagaatgctagaaaattagttgaaactcatcctgggcttattgaattttgttgtatcatatacataaactgtggacacttggtttggatgctgtaaccttatctctgagaaatggcttctaatttgtgttattttgcatttgaaaaacttgctatggattttataaaacttataacaaaaaccctaatatactttattagcttctgataaatattacatcagacatccagttagtataatttgaatgtggtttgaaacttttttagaggtaggtttcgttgtgggtagtggaaggaggcacataagttttagagttagctctgagtacagattgtggccgtttcacttacagctgtgaattcttggggaaattattcattaagtctcagtttccacacatgcaacatggaaatacactgatacctgcctcagagtttttgtgaggattaaaagtaaataataaaccaacaacatagtcattttattatcgctatcaaatatgtaccgtacataattttatgtgctatacttttatatgactggcagcacagtaggtttgctttcaccagtatcactgcagatatgcagtgcattacaacattatgacagccgtaacatcattgagtgataggaattttccagctgcattataatcttactggaccatcattccatatatggtctatcatagactgaaacatggctaagtggcacatgactgtagtaaatattgttagcatccttcttttgttttgtcatttttgccttcctccccctagtgttttctcacccctccaagaataaaatcctagttcctaccaggactcacaaagctctgtgaaatctgaacctggtgcaactcttgagacttcatttcataacatttttctcattcccatagctctgtctgcacagctacactggctgtaacctccctggccagctcattgccacctcaggatctttgtacttgctgtacacattgcctgatgttcttgttccctaactctgcatgctggctctttcataccactcaggtcagttgttaggtcacctcctcagaaagctcttcagaagaagccgccatttccagtcgaagacattttctaccataagcacctgttttattttccttaagtgaagatttggatttgcgttttagaatacatacagagtaaataaaaattctctacacaattttgctgtaaacgtcttctgggatttttgtgtatacacttccttttagagaatatgtgcatttgaagtggttttgttgtttaaggtgtgagtgttcagtcgaatacctcttagtgccattttaaaatgtgatctaaagaaacattttgcttttatcttttctttctgctcattaatccacataaattactacactaaattgatttagaatagacagattgcttggaattaattttaaaatttattttttagccctcatttcagcccttagctctgtgaagccttggttgatttgcctaaacgctatctatctgcagaaccttggccttgttacttggaagattaaataagatatttatgatgaaaatgctctgaaaaactgaatacagctttttacaatcgttttatatttattatgtactgtgatttgttcctgatatttcacatttgattcagggaaatcatttcaacaaattatagagcttcttttgttgtcgtttttgttaggtgtggttttttttgtgttttgttgtttgttttgagataaggtctcattctgttgcccaggttggagtgcagtggcccagtcatggctcactgtagcctcgacatcctacctcaacttccgcagtagctgagactacaggcacgcaccaccactaactaacgcacctggctaacttttgaaaattttgtgtagagatgaggtcttgtatgttgcccaggctgatctcaaactcctggactcaagtgatttgcctgcctcagcctcctaaaatgctggattacaggcatgagcccccatgcccacacgacagaacctctttagaacatgactgttaaagctgatatttggatacttttgattttaatagcaataacaacaataataaagactgggtgggactgaacttttaaaatactcttgctattgttcagttggttttcagctttgctcaggcctatatgaagtttacctttgggagaaaatgaaaccttgtccaatgggtctatagcttataccacatgccgtattcctatctatgctatgcctcttatctcttctgccagtagtttttctccccagaatctgtgcacattaaatttcatttttccagtagttcatttttagaatctttgcttcagtgatgaattgaaaagttaaaaaaaatctgatcgcttgtaagtaatttgagaagttctctgacccaccttacctgtttattgtgcagtgctattatgagggagagtaaatcaatgttatatgtttctgcaaaagcagcaaattacaggagaaacatgagaaaagtcacatctagtttgtccaaaagacattatctctttatgaggacctattttattaatgtaactgtttttaaataggattaatcaactttaattataacttatgaaaagtgccgaatcaggtcagtgggctatataaaaatacgcaaggtcattagaagcttattggacttgttgagtatgggttcttttcttgaattttagtgatgataacctcacacatagttaagtgaacttcgtgcctgaagatgggggtcctgcctagacaaatgagcaaaaatgtgtcttttttcctgaactggaaaagctagtttacagagtgatgacttctttgtgattaaagttaccagtttctgtaagtatggaacacatcgcttctccattaagttggaagcttgttaatcagctgattttaacgttcaccattacactggagttttgggttcatatttagttcttaatctttctatcatgttttagtttctcatgatcttcagaaataaaactggaagaaatggatgtgcattcctttctctcctgattctgttatttaaattggtaatcctacagggtttctgtttgattttgttttgtgtttttgccccacgagaaagctaaagaaactttttgacattttaaagatgagtgtgtactcctcccttccctttcccctccctcctcctcctccctccctttgccgtcccctccccctcatttcttggaaatttgacttttttttctgtcatcggtttgaaattactttattcagttatatcattctttccaagtttcagcttattttgtaagcaattctcttttttcctgttctcattaccactgttgttgatcttggtcaacagtggtaatgttctcgctttgaaaataattttcaggggcctgtgtttctcagcctcactaagtggcgtgaagcactggttaaacagaagacagttaagtagctagtaagccaataactgtcatggaatagacagagacaacacaagttctgacatagatcaacctagtttgtgtataaatacaaatttaaataatatttaaatagaaatctctatttcagtggtccccaattttttttggcaccagggactggttttgtggaagacagttttttcatggacctgtgggaggaggggatgtgatggttgaggggatgattcaagcgcattacatttatcatgcactttatttctgttattactgcactgtaatatataatgaaataattatacaactcaccataatgtagagttagtgggagccctgagcttgttttcctgcagctaaacagtcccatcagggggtgatgggagacagtgacagatcatcaaacattagattcacataaggagcctagatccctcacatacgcagttcacgatagggttcacgctcctgtgagaatctagtgccaccgttgatccgacaggaggcggaattcaggtggtaatgcaagcagtggggagcagctgtaaatacagatgaagcttcactctctagcctgcacttacttcctactgtgtggcctaacacgccatagactggtactggtttgtggcatgggagttggggacccctgctttatttaatcacttataacttataatcacttagatgctctaagtcatctggggggtgagaaggttggaaaagaaaaagtacattagtgagtgagtaaagattatctgggattgtttcttagatgaggatctatttgatgttggtgttggtctactgtgaactaaatataactgcattggagcctaagcgcagatgtctgcgtcatggtttattactcctgtgttcgtttcaaggagctcctgtgatacctgctgtctccacctaaaaaaaaaaaaaaaaaaaaaaaaaaacagtaaaaataaaataatcaattaattcttcctcttgctggtctgtcactcagtctagagtgctgtggtgagaccatagctcactgcagccttgaccactcgcctcagcctcccatgtagctaggactacaggtgtgcaccaccaggccgggctaatttttttttgcagagagtgggggtggtctccctgttttgcccagcctggtcttgaactcttagcctcaagcaatcttctcacctcagcctcccaaagtgctgggaacacaggtgtgagtcactgcacccagcctatttatttatttttaataattaagttgtacataataatattcatgatgcacctgcataagacaggtttattttattatcagatattacctcccatattgtatggaatttttaataacagttgtagctgatgctccattttgtagtctgatagtttcactttgtcatatttttatctatttctatggtctttataaatatttttgaggccctcttttattatgagtaaattattcaactaatattgaatatcaatttctgatttttaaaaaaattaaaactagtgagtgctagagtgagccttatcttttacctactgattttttgcttctgttaaattatttccttaggctaaatttcaaggaattgtataattaggtcaaaggaaatgatgtttgcaactcccatattcattgcaatgtggccagtattaactctgcttttcttttttaagtaactgccacctgtaggttactttaatgcagtgttttacaaccttggctgcacattaaagtctctgcaggagctttaaaaaacactcatgcctgaggaccacctctagagattttgatttgatagatgtgatatgccatctggatgtaaggatttttttttttttttttttttttttaagacggagtttgactcgccgcccaggctggagtgcaacggcgcaatctcggctcactgcaacctccgccccccaggttcaagtgattctcctgcctcagcctcccaagtagctgggattacaggcgcccgccaccacacctggctaatttttgtatttttagtagagacggggtttcaccgcattggccaggctggtctcgaactcctgacctcaggtgatccacctgccttggcctcccaaagtgctgggattacaggcgtgagccaccatgcccagcctctggacataaggatttttaaaagctctccaggcaatttcaaagtgcagctaaggttaaaaggttactttagtgagattgagcttaacattgcatctgaaaattgatttatttgttgaatcaggttggtggcttaaatctgattcagtaagaggaaccaactaaatactttgatcacatcaataaatttatacgtctgtctagtataaaattgatttaactttaatttttactaatcttgtgaatgttggtatattagatatcgatgcatctataactaatacagtggcagtatgctgaaaatcacttttttcgagatcttgaaaccagtacagtaaggtaggactaaaaaatacaactttggctattggagtgatgtagtattccagaagttatggactcattgagaaagggagtgaagtagcccctcaggatgaaaagcaagagaaaaatgaccatagacgccatggactactaacttctgtacccatatccatagtacgcaatgatctagaacttgcacactagtctctcaaaatgtgtatttttaaaattatttatatttttagtttcgtctgtctgcattctctgctacaaaataggcagcagaggtaggtttgtgttttggtttagattgttgatccaaatgctggctggctccattacttagtagctgttaggcaagttactacatttctcacaacttcagtttcctgacctgcaaattacggtaataatattctccttcacagaatgattacgagagtaaatgagatgatgtgtaccaaatgcacagttcaatatctgatacattgttaagcagttgataaatattaacaataaaaggaagtggttatgttgtggaaatagaaaccagtatttaatgagtacttactagtagtatgcatattaagaatatatattctcggccgggcgtggtggctcacacctgtaatcccagcagtttgggaggccgaggcgtgcggatcacctgaggtcaggagtttgagaccagtctggccaacatggcgaaaccccgtctctactaaaaatacaaaaattagctgggcgtggtggcaagcgcctgtaatcccagctacttgggaggctgaggtgggagaatcgcttgtacctggaaggtggtggttgcagtgagctgagatcgtgccactgcactccatcctgggtgacagagtaaaaatctgcctcaaaaacaacaatatatatatatatatatatatatatatatatctctgtccttatatcttaatccttgagcctctgtaagaaaactgctgttatcccactttccttttctttcttttcttttcttttctttttttttttttttttttttgagactgaatttccctcttgttgcccacgctggagtgcaatggcgcgacctcggctcactccaacctctgcctcctgggttcaagcgattctcctgcctcagcctcctgagtagctgggattacaggcatgcgccaccacgcccagcaggttttttttgttttttttttttttgtatttttagtagagatagggtttcaccatattggccaggctggtctcaaactcctgacctcaggtgatccacctgcttcggtctcccaaggtgctgggattacacgtgtgagccactgcacctggcccccacttttctttaaacagataaaaaactctggctcatagaagcgaaataatttgtcttagatcagaccatggtataaatgggattctactcagactttagcacctgtacttttcccataccacactatgatttagcctctagggaagtctcagttgaacataattagatgaatttgtagtgaattggtatttttttcctcgtaggaaaaggtaggttggtgtcaattttgtgaacaatatggtgagcaatgtgggcatgccattttccagcctgtcggaatcaatattgtccttcatttgagtagaatgtgcttgtttttttttttttttttttttttttaaagacggagaatgagaatttgggctaggcagtttgtccaacattttgtcagtctcttcaacgctcactattctgttgatcaatgtagcagatggtggactttggaactttttatcagagaatgtgtgttgagaaatgttctacttggaaggaacattcctttgactcataaaaaaatttttctcttaaagacctctttgctccttgttgccttcaaattaccctgaatacttcctgctgtgggcaccgcatgaactgttcctacaaaagccagccctttccacttaaagtagtgcagcattatataagggggagagcacaggctttgggagcagcccaacctggattcaaatctattacttgttagcaatgtgctaagtaagagggtgctaatatttattgactgcctactgtgtgccaggcattattaaataatttatttactatcctcattaatttccacaacaactttctttgctttttcacagcaaccttttaaaaggactgttacattttttataggtcaagatgcatgctcaaagaggttaagtatctagctcaagttctcacttcttgtaagtggtaaagtttgattttgaactgaggtttatcaaactgctaatgtatgtggtataccttgaacaaatatgttaatatttctgttctcaatttcctcatctctgaaaccggaatactaccactttgaaggactgataagaggattaaattagtgtacttaaaattttctgtcagtatctgtttaagtagatactcaaataatactagtttcttccctacctttagtaagtaataataacagaagaatgaagcaattttcacctctgcctttattaaaatgttttacatttaactttgtattttgaaaaattttgaactcagaaaagatgcaagaaacgtgcaatgaactcctatatatccttcatccaaattctccgattcttaacattggttacatttgctttatctgtgtgtgtatacatatacatatatagaattttactgaagtctttgagagtaagttgcagaatcatgaccttctgttcctaaatatttcagcatatatttcctaagaacaaggacagtcaatacagtaacagtgcatttatcaaaattagtaatttatcattaatacaataatctaatatatagtagtttatattctacttttcaccatctgcttaatagtgttcttttaagtatttttcctcctgatctggatcacacactggatttagttgtcatgtttagtctcctttgccacctgtgccttttgagccattactgccactacattgggttgtattagaattacttccttagattatctgtctcttcagagagtgatgatctcaaaccatcttaaacgttgtgagtaaaagagaagaatatttgtactcttctgccctggagtgaaatcccaacaaatacttgagtaactgtgtatgtcaagagattgtgctgagtggtggagatcagcaggtcaggagatacacggtcctggttctcaatggggcttccagatgagtaagattgttatagtgcagttcagcaagtcttgctgagctcacaagagagactgctcctggaagtgtgctggaaactagatacaattcagggctcccaaaggatgtttaaaaacaatattaattacctcatgacaggaagattgaaaatttcaaggtaatcatattgtcagcttttcatatcttaaagtctgttttgaaatcgggttgaatgtgaaaatctaagagactttaacactgtctgatgtagtagtaatgaaacaatgcctgtactgcatcattgccacaattggtggtaaagtaccatttcgtttattcagggtgatagtttcctcattggaattaaaaaaaaaaatcagaaggcagtagaaatctctatggaccttcctgcagtatttatattcgttcatctacagatctttctttcacttgttttttgtctggttttttaaagtgtcagctgaggctatggtgcctcttaattcaccaactgaaacaaccagaatttctagtgcatttggttatgctttcctgtcctgcaaggcctgatttggttacaatataatctttgttcacatttttcaaggtaaattttagatacccagccatagtcctctttatggcagaaacacaaggctgacggacaacttaattaccaactgtagatgtaggaagggcttccagtcaagagaatgctgagtagttattttacaagtctaaaggagactgaatgtggaagatggatttaaaatggaaatgtggtagtagtacataaagaaattctgtgctagaattgtagagcattcagatacacctaggattctaggtatgggcctcatagttcacctaagaaggagagtggacagagagagagcagggccttgcctttccttccctctactggtcctgtcacacatagccactctatttctgcatatgattttatctgaaaacatgcagctacttagaagtttgaaaactagtgtcttagttgtatttgtgaaattgtaccaagccatggtctctcaggttccttgcagctctgtataaagcctctgagctgctttattcacaggtgtttgctgtccattggttgcatactttgggaacataggtgcatggtaacattggtgcatggtaacattaagttagagcatactgtgaagcagatgatgttggaactaatggttcatgtgaactatttgtactatcactaccagtgctacagagagacaattcactttatttatactctattacagtgtcttcaaatgttcatctcaaatcaggtacattttgatcaatgctgttataccattttatcataatttaatttgcaacagttttttgccttagtggtacataagatgatggtgcctttacaagtaatagcatcttaattttgatgaaatatgctatatttagtgcataagatgccacacatataagggtaaaactcctcatacattctttcctgcttttttgcatctatgaaggtggcaataacttcagtaagccaaactgtggctaacagtaattaatattgagacattaatgttgagacagatgtcatgtatctttgtagctctagcctctagcatagtgcctaccacttaataggtgttcagtaaatgtttcattgaatggtcttttaatattagtttatgaggctagaccattaaaacaaagttttagttgggagtaattagaaaaaagaaaataacttacttttttttttttttttttttaaatggagtctcgctctgttgcccaggctggagtgcagtggtgcagcctcgactcactgcaacctctgcctcttgggttcaagcgattcttctgcctcagacttctgagtagctgggattacaggtgtgtgccaccacacccggctaattttttatattttttgggtggagacggggtttcccagtgttagccaggatggtctcaatctcctgacctcgtgatctgcctgcgtcggcctcccaaagtgctgggattacagacgtgagccactgtgcctgaccggaaatgactgactttattcaagagaaaaataatttgtacaagtaaggcaagtaatcatagtatattacttagatcacctgtgtacaacatttctagatgcatagtaatgtagatactgaatactgatcctaccaaaattgtaacttttaaaatatttgtatatatttaagagatacaagtgcagttttttgtttttttgagatggagtctcgctctgttgccaggctagagtgcaatggtgtgatctcggctcactgcaacctccacctcccgggttcaaacgattctcctgcctcagcctcccgagtagctgggactacaggcgtgtaccaccacacccagctaatttttgtatttttagtagagacggggtttcatcatgttggccaggatggtctggatctcttgaccttgtgatccacccacctcggcctcccaaagtgctgagattgcaggcgtgagccaccacgcccagccacaagtgcggttttgttacatggacatattttgtagtagtggtgactgtaggcttttagtataaccatcacctaaataatgtaccttgtacccattaacaaaattataattattatgaagagaaaaggacaagctgtgtgcatgtgcttttggggaagaggggcagacactaagctaaatactcattttctatgttgagaagtcagtttgtaacctcatcggtctccattcccacattcctcttctgtgtgcatgtccggttctgctttgtgatgctgttgtttggagatgtgtagtttttatgtaacatggcccaaaaatgttaggccaagattttatttgttaactggccaaaaaaaagtgataaagagaaatactttgtttactcgtatttttatattatgtaccaactttggatcttaaaccctcagtaaaatgcaactccagcagacgctgtcccacacctaatatggagcttctgttctagttagagagctgagaaaagtatataaatacctattaaatagcccaaagaggtgtgtgtgtgtgtgtgtgtgtgtgtgtgtgtattttttaaagccagtagagaccaggcgcagtggctcacgcctgtaatcccagcactttgggagactgaggcaggcatattgcttgaggcaggcagattccttaagtccaggagttcacgaccagcctgggcaacatgacaaaaccgtgtctctaggaaaaatccaaaaattagctcgtatggtggtgcgtgcctgtagtctcagctactcagggggctgaagtgggaggatcactggagccccggaggttgaggctgcagtgagctgagattgcaccagcacactccagcatgagtgaccctctatcaaaaaaaaagaaaaaaggaaaaaaaaagtcacaagagagtaatataataaggaggaggggaaagatcctatgtccatagagaaaagaatggaaaagcgatcagtaagccagaccgaaagatgggtgggttttggatagtctggaatccctggatgatgaggtgtctttgaggaatgcacatttacagtttggctgcagaatggggtataagaagattaattgtggctggaaaagaacatcggtgaatacggagaatggtgatggcccggcagaagagttgctggtgtggcatggcctatagaggcactgtggtagagtggaaagagatagtattctggctctgcttattagctgggtgaccttggtcatgaagttctgtggctctttgctttatatatctatacagtagagataggatgcttcgcagaattaagattatgatgaagagagaaagcctaggtgatacaggcacacatgtatttcactctcaatacaaaaagaacaacaaaaacgttgttttgttttgtagaacagagcttttgagcaaaagaatgatgtcactattgctttgaaacagttgtttctgatagattggggggtagtgaaggccctagggtaattgccccataacaagagtggctgtaagagtccaggtaattcagtcaaagtctgaactagaccagtgcctgtaggatttgaaataaggagctgaatgggggaagcattgcaaacacgaagtcaacatgttcagaatgttctgagcaagggaagtggtattgctagggataacagtggtttcataaatggaaataggtttggcattgctgctgcttttgattatggagtaacataaaattgaggtttgaaatttgaaggtgcccattagacaccctggtaaagacattcataaagtagttggaagtgttggtgcagaactaagagagactttgagtcaagagaaagagattgtgggggtgaattggggctgtgggaaaggatagatgaaagaagaggactgaatgcagagaattgatgtgttcacctctaggagatgaggaagaggagccagggaaaacagtagatgtataggatggatttttgtggatggcaaataagaatacattttaaaagaagaatcagatcaacatatttttttcttttctttttttttttttttttttgagacagagtttcactcttgttgcctaggctgcagtgcaatgcatcgatctcggctcactgcaacctctgcctcccgggttcaggcgattctcctgccttagcctcccgagttgctgggattacaggtgcacgccactacacccggctaatttttgtatttttggtagagagggggtttcgccatgttggccaggctggccttgaactcctgacctcaggtgatccaaagtgctgggattacaactgtgagccaccatgcccagccagatcaacatttttaaattctgcaaaactcagggttgacagggataaagaaaggccactgggccgggtgtggtggctcactcgtgtaatcccagcacattgggaggccaaggcaggtggatcacaaggtcaggagatcaagaccatcctggctaacatggtgaaaccccgttgctactaaaaataccaaaaattagccgggcatggtggcgggcgcctgtagtcccagctacttgggaggctgaggcaggagaatggcgtgaacctgggaggcggagcttgcggtgagccgagattgtgccactgcactccagctgggcgacagagcgagactccgtctcaaaaaaaaaaaaaaaaaaaaccactggattttgatatttacttatcactggatacctgtgacaaagctttggtagcattcagagtgagtaggaggccgggtgtggtggctgacgcctgtaatcccagcactttgggaggtagagaaggatggatcacctgagttcaggagttcaagaccagcctggccaacatggcaaaaccccatctctactaaaaatagaaaaattagccaagtgtggtggcacacgccctgtaatccctgctacttgggaggcggaggcaggagaatctcttgaacctgggaggcagaggttgcagttagccgagatcgcgccactgctctccagcctgggtgacagaacgagactctgtctcaaaaaacaaaaaccaaagtgagtaggagccagatcacaaagccttaaaatgttgaaatggctggaaaggaggtagagatggtgagactccctgaaggaaagaggaagaggaagacagaacatgtttcagtgcgttcagcaggatttctcgatgccagcactaccgagtttgggcctgataattctttgttgtagggagcagtcctgtgctttgtaggatcccctcctactcctgagttgtgacaaccaaagatgcctccagttattgtcaaatgtcccctgggggccatattccttgggtgagaactgatcgacagggttgaataaggattcctaccgctggagtggggaaggagctagtccagaagtgggtggaaaaccacaggcagccaggggatgatttactgaagcagggacccaaggagggcaggaagaaacagagcaaaacctcggtctagaagaggtatcctgaagttggagagggtggggaaatgcattgttgttgttgttttttttttttgtaatgacagttgttttggcttacattagatggcctcaagcttatcactgagaaaggagaaaaggtcttttgagaatgaagtaggcaaggttaatgtttggcattagaggaaattatataaactttaatcccagtgggggaagattagtgtacaggtgagtaaaaggattactgagcagcaatgaggcctggctgaatggaacttttgaagcaattattaaaaagattggtaaaatgtatatctcaaccacgctgatactttttatatttgtgcgttttacagactagacttatgtacttttttttttactttttattttgcttatttcacaggactttgtagatttcaatgttattgaacttttatttcagttatttttaatggctacataatagtctatagatctgttctttaatttaccaatcagcgcttcagttactaactggttagattgcttccagtttttaatgaagttgtgccaaaagttgcagtaaacattcttatgcatagagttttgcgagattttactagtggacccagtaaaggttttatacggtggtaacacagagcaggaaatgtattttctgaaatgtcacattaatgaggccacccttgatccaccacatttaaaattgcaaccttcattcctgctttaatctctgtagcacttgctatcttctaggtgttttacttatttatcttgattgctgttgtctcccttgttcgacagaacagggattttggtttgcttcaccagtaccttaaatagtgcctggcacatacatacttgctgaatgaatggatgatgggacttacccagacctgtaggcgaaatgagtttggaagagtgtcagtagcaacagatattcatggaagccagtgggaagatacttgcaatgactgatctttagtatctagagggacaaggaagcaacaaaagtccccagggacatgaattgggagattgaagggttagtacctggaggtaattgtgacaacaaaagcacattcctctggaaggtgagagtgggagaggtagaaggtaagtaggctgtggttagagaaagggatttcccaaggtttagatattagaaatggaacagtttgagaattaaattctcaaatttaattttgagaaggttggtagaatactccatttcatggagaatggactgtatcactttttaattgctcctgccttggcaaacagtgtcctctaatcttgttatatttgggtcatgctcagtggtggtatataaagcaggttttgttttcagagatcttttttgttggaatatggctgtatgtgataatctgattaagcagatatgccactaatgtctgccacacaataaggcatgttagtgactatgtcaatgtaggcttgaaagctacattgatagagaagttgtctccccgctatttgacttcttgagtcgtttctttgaactgtcgagagtattttacaagtgcttttctgtttgaggtcatttcactcagagtatagcaacttagtaaaatatgtaaaacatgtagtatagcatatgccattcttattttaagctgcttttggggagccactcttgggtatggaagttgtaatagtagtttttggagtacactttattattattaccgtcagccagtacatgattttccattgccttatacgttttccactgtagcattaaaaaaaaaattttttttttattattacactgtaagttctgggatgcatgtgtagaacgtgcaggtttattacataggtatacacgtgccgtggaggtttgctgcacccatcaacccatcatctacgttaggtatttctgctaatgctctccctcccctagcccccaaccacctgaccgaccccggtgtgtgatgttccccttcctgtgtccatgtgttcttattgttcaactcccacttatgagtgaaaacatgtggtgtttggttttctgttcctgtgttagtttgctgagaacgatggtttctagcttcatccatttctctacaaaggacatgaactcatccttttttatggctgctactgtagcatatttttagctttaaaattccaattagtctcaggtgaattgttaatgacagacaggtgtgacttagtagaaaaaactggagagacagttgaagtaatctttctcatatttttcagtggctagatagcatgtctgtaatttcttaactctttagtttcttctatttcaaaacatgataatgatctcaaatataaccttcctcccaaaatctcagggatactttaccaatctattgtttgctttggtgggattataataactgtgatataggttgggaggccaaggtgggtggatcacctgaggtcaggagttcgagatcagcctggccaatgtggcaaaacccctgtctctactaaaaatacaaaaaaattagctgggcgtggtgggacgcgcctgtaatcacagctactcaggaggctgaggcaggagaatcgatgaacctgggagttagaggttgcattgagccaagatcgcaccaccgcactccagccttggcgacagagcgggactctgtctcaaaaataaataaataaataaataaataaatatgatatgatatgggatattcaaaggtgttaatgttgtaaggaaaggaaaaataacatttcatataaggaggaaagggttgatggaaagcataatctattattgtgcctgatctttgagctgctaggcaccttatcagaatgctgtttgaggagtgttttcattatgtttaaagctttcagagaaagtaggattttctgatacaagtagaaaaatagaaaaaagtagatatgtttttctacttttaagaagggaaggcttactaggaattatttttaaatgaatgaaagagtagaaggaggaagaataggcagtatccgtgtgtgatttctctgtgtcaaacaccatagatgtagttttttatgcacattttctctaattctcaaaacagtgcttagattataatatctgtgtttgcatattatgaaattaaggctcagaaaagttaagaaatttgtctagcatcatatagttaggagataaaattttgtacccagaaatctctaactctgtataccacactgtgtatcaaactaatgagaaagaatagtgacaccaacggttagggcttcagacatttacatttgtgctgaatgtagaagagggtgcttaacacttgaaatgcgtgctcaagtacaatagttaataatatgagattgtgtggggtatgattgtgtgcctcatccctgtttattgtatgccccaagattctttcatctgctgcaaaaaagcacagtgcagattatgtgtggtatcacagcaggcattacgggcatgggtatgccttctggatgcaagggtggaattggaggtgctgtagcctttagaggagaaacccacttgccttgttcaaatcagttggcgtataatggtggaaagttgttatatttgtttataatgatatgagttgagcaaacttgcttgttttttaaattttacgaattttaactttaagttcttggaaccaagtgctttattccaaataggatatgataattatattgacaagtgttgaacaatatgtcattgtaacagtttttctttgtgtaattgacttcaataatcttgagggtgttttctgcacctattgttagaaaagttggagtgcccttgtaagggttggagtgagtggttcttctcttgccattataattgactgtagttagcatatggtctaatttattttaagagcaccttttaataagccttgattttgttgaaaatcaggctaaaaccatcttccttgcacttcctcattacttggttgttagcataatattaactattattagatcccacatatctctttatcttgatctaaagaacattgttagggctaggagtcctgcagttttcatttaacccatttgtgatctcttgtgaggaggatggagctattggttatatgcctgaatcatttgggaggtatatatactaatttttgctgttgaacctcaaagaacaatcaggttagaaatacgaagtaagacttagaacgttaagcctatgcctgggaggcagaatgtatatatattaaccagagatgcttgcatgtagggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatggtaagtcagaaagcttttatttttaagtatatgcatgtgtatgtgtgtgttttgtatgtgtgtgtccccgccctcctccaatgaaccttgatataattagaacataaaaatgctttcctggtgggaggctgagacgggcggatcacgaggtcaggagatggagaccatcctggctaacacggtgaaaccctgtctctactaaaaatacaaaaaattggccggcctggtggcgggcgcctgtagtcccagctactcggaaggctgaggcaggagaatggcgtgaacccaggaggcggagcttgcagtgagccgagatcacgccattgcactctagcctgggcaacagagcgagactccgtctcaaaaaaaaaaaaactttcctggccaggcacagtggctcatgcctgtaatcccagcactttggaagggccaacacaggtggatcacttgagctcaggagtttgagaccagcctgggcaacatggagaaactctggctctacagaagttagctgggcatggtggcgtacgcctatagtcccagctacttgggggtctgaggcaggcagatcatgtgagcctgggaggcagaggttgcagtgagctgagatgacaccactgtactcctgccggggtgacagagcaagaccttgtctcaaaaacagaaaaagaaggactttccccaaagattctgagacctgtaaagcagtattagcagtattaaatgttaccacttacagatcagagctagcattaaggttgtagccgtagggggactgagaggtttttttcattggttttgggaataatggaagacacacatttcaggtacagaaatatgcaacaactagaactaaatttctggcataaaaggatatttgtctgtgtttggcttagctttacaaaatgaaagaaccaacagtttctgagattgttgccaaagaacaagaaccaaatttaatcaggagtatttttacaactattttagtggcgatgatatgtaccatttaaatatagtgttactatatttaaatcaatagttgtatggtacaaagatagctaaaaaaaacagaaaagattttataatccactcaagtcttcaagataaagttgttgccagacataaaaacattacagactccctgttagcatttattacgaataacataaacgtcatatgtgtacatctctcttgggcataacatctgaaaggctgtgtttaggtaatttttccacccagtttatttcagagctgatttgatttggaaaccactggacagtaatttcatttaaggtcagctcaatgccagaggcttctttgggagcatgcattatttgagaccagcaagccaagaaattccatagggttatgtgatgctcccacttttgtgttttagaattgtgtttgttccagagcacgtgacatttcattttcctctgaatggacttctaggcaatcaggtttttccttagagctctttttactaggtgaatggtagttcacttgaaaatatagttttgcaggtaccaaagctacctgccaagatatggaaatggttggcaggcaaatacgagaaattaaaactgtgggaacatacatgtgctactttctttaggcaacactacttgtttcgccagatttctgttttataatgtttaccatttattaaatttaatgacttcatttcctgatttttaggagactgtcgtactctcagcaggactggaaataagctaattttgaatactcttaaggagcctaacacagaagcttttagtgaaagtccattttgcttgtacactctactagaaagactttaacaagcatgacacattttacacttgtacatataaacttttacaataggctcagtaggtagataggaatggtctgatgatggaaccctgtaagtgcccaatatattcactgagtgagtaggtgaatgagaggatggatggcagtaggtatgcatattattgcagtagatcaggtaatgaatgaatggcgagcaaaccagatgtttggaaaaatagattttaggtgttgagaaaatatttttataagaatttttgaaattttgatataaaggtaaaatcactaaagatcacctgtatttgtttttctccattttaaaccttgctgcatgcacatgggatttttgcatatttataaacttagattaataatttttttctaattgcaatatggtcctcatagttaataatggctagtatttcttccatcagttttatgaaccttgattttcttaatcattcccatgctgttggttatatctgtttatattttttaaatactttaaagttgcaaaatccatttttgagattacatatagtatccataatatactctgacagtatataggtatatgttctcatttattttatatttaatatgttctgattttatcaaaaggtgaaagaatatctgccatgccactgttcctgaaattatgaccccataactcgatggttaagttagattggttggaacatattttggggattaaaggacactgaactcagtaagtatttagggcacaggcacattggctgcaccttgtaatggaaaagagctaggatttgtttttacttgtatatatgaggcagggtgtaagtaggctctgcccttctgaagacaatgaaaaatataggtgggacacagtggtgtaggccctataatcccagcactttgggagaccaaggtaggaggatcccataggctcaggcgttggagaacagcctgggcaacatagtgagaccccgtctctacaaaaaataaaacaattagtcaggtgcaatggtgcacacctgtagtcctagctactcaagaggctgaggcggcagggtcacttgagcccaggagttcaaggctacggtgagctgtgatcacaccactgcacttcagcctggcctcagaatgagagagcccaccttaatgttagcagctcaattgaagatattcactgagctttttaaaaatcaggtttttgagactcttttatttttattttttttaagacggagttttgctcttattgcccaggctggagtgcagtggtgctgtctcggctcactgcaacctccgcctcccgggtacaagcaattctcctgcctcagcctcccaagtagctgagattacaggcatgcaccactacgcccagctaattttgtatttttagtagagacagggtttctccatgttgaggctggtctcgaactcctgacctcaggtgatctgcctgcctcagcctcccaaagtgctgggattacaggcatgagccaccatgcccggcgagactcagttttcatctacttcctaaaataagttcaaaatttagaaaatagatatttcatatatcctaatctattttgaacatcccagtatataggcagatatgaaaggaaagtaatatcagaaataagaggaaatttatttgtattcttttagattcgcttatcatgtgaccttagaagagctagaatagaagtgagttctgtccaacagaatttttgctcagaggtgtcagtgacatcttctcctacaggcagttttttaaaagtgtatttcatttcctcctagaaaacaaacctcaagcagatggacagtcttatgcccttaatgatgacagcacaggatccttccagtgccccagagacagatggccagtttcttccctgtgcaccggagcccacggaccctcagcgactttcttcttctgaagagactgagagcactcagtgctgcccagggagccctgttgcacagactgaaagtccctgtgatttgtcaagcatagttgaggaggagaatacagaccgttcctgtaggaagaaaaataaaggcgtggaaagaaaaggggaagaggtggagccagcacctattgtggactctggaactgtatctgatcaagacagctgccttcagagcttgcctgattgtggagtaaagggcacggaaggcctttcgtcctgtggaaacagaaatgaagaaactggaacaaaatcttctggaatgcccacagaccaggagtccctgagcagtggagatgctgtgcttcagagagacttggtcatggagccaggcacagcccagtattcctctggaggtgaactgggaggcatttcaacaacaaatgtcagtaccccagacactgcaggggaaatggaacatgggctcatgaacccagatgccactgtttggaagaatgtgcttcagggaggggaaagtacaaaggaaagatttgagaactctaatattggcacagctggagcctctgacgtgcacgtcacaagtaagcctgtggataaaatcagtgttccaaactgtgcccctgccgccagttccctggatggtaacaaacctgctgagtcttcacttgcatttagtaatgaagaaacctccactgaaaaaacagcagaaacggaaacttcacgaagtcgtgaggagagtgctgatgctccagtagatcagaattctgtggtgattccagctgctgcaaaagacaagatttcagatggattagaaccttatactctcttagcagcaggcataggtgaggcaatgtcaccctcagatttagcccttcttgggctggaagaagatgtaatgccacaccagaactcagaaacaaattcatctcatgctcaaagccaaaagggcaaatcctcacccatttgttctacaactggagacgataaactttgtgcagactctgcatgtcaacagaacacagtgacttctagtggcgatttggttgcaaaactgtgtgataacatagttagcgagtccgaaagcaccacagcaaggcaacccagctcacaagatccacccgatgcctcccactgtgaagacccacaggctcatacagtcacctctgaccctgtaagggatacccaggaacgtgcggatttttgtcctttcaaagtggtggataacaaaggccaacgaaaagatgtgaaactagataaacctttaacaaatatgcttgaggtggtttcacatccacatccagttgtccctaaaatggagaaagaactggtgccagaccaggcagtaatatcagacagtactttctctctggcaaacagtccaggcagtgaatcagtaaccaaggatgacgcactttcttttgtcccctcccagaaagaaaagggaacagcaactcctgaactacatacagctacagattatagagatggcccagatggaaattcgaatgagcctgatacgcggccactagaagacagggcagtaggcctgtccacatcctccactgctgcagagcttcagcacgggatggggaataccagtctcacaggacttggtggagagcatgagggtcccgcccctccagcaatcccagaagctctgaatatcaaggggaacactgactcttccctgcaaagtgtgggtaaggccactttggctttagattcagttttgactgaagaaggaaaacttctggtggtttcagaaagctctgcagctcaggaacaagataaggataaagcggtgacctgttcctctattaaggaaaatgctctctcttcaggaactttgcaggaagagcagagaacaccacctcctggacaagatactcaacaatttcatgaaaaatcaatctcagctgactgtgccaaggacaaagcacttcagctaagtaattcaccgggtgcatcctctgcctttcttaaggcagaaactgaacataacaaggaagtggccccacaagtctcactgctgactcaaggtggggctgcccagagcctggtgccaccaggagcaagtctggccacagagtcaaggcaggaagccttgggggcagagcacaacagctctgctctgttgccatgtctgttgccagatgggtctgatgggtccgatgctcttaactgcagtcagccttctcctctggatgttggagtgaagaacactcaatcccagggaaaaactagtgcctgtgaggtgagtggagatgtgacggtggatgttacaggggttaatgctctacaaggtatggctgagcccagaagagagaatatatcacacaacacccaagacatcctgattccaaacgtcttgttgagccaagagaagaatgccgttctaggtttgccagtggctctacaggacaaagctgtgactgacccacagggagttggaaccccagagatgatacctcttgattgggagaaagggaagctggagggagcagaccacagctgtaccatgggtgacgctgaggaagcccaaatagacgatgaagcacatcctgtcctactgcagcctgttgccaaggagctccccacagacatggagctctcagcccatgatgatggggccccagctggtgtgagggaagtcatgcgagccccgccttcaggcagggaaaggagcactccctctctaccttgcatggtctctgcccaggacgcacctctgcctaagggggcagacttgatagaggaggctgccagccgtatagtggatgctgtcatcgaacaagtcaaggccgctggagcactgcttactgagggggaggcctgtcacatgtcactgtccagccctgagttgggtcctctcactaaaggactagagagtgcttttacagaaaaagtgagtactttcccacctggggagagcctaccaatgggcagtactcctgaggaagccacggggagccttgcaggatgttttgctggaagggaggagccagagaagatcattttacctgtccaggggcctgagccagcagcaggtaagcaaaacataatacaaaattaacagtctgagaagcagattcccttaagagtcactgtggtgtcctggtaaaaatataggcatctttgttgttttgaggccttgcactcattgggtaggtagccaagttaatagtcaccaccatcaggaggggcacgtcatctcagggttggacagattttgcttcctgtattgtagacttactgcttggttgcttaagcttataaacactcctgtctcattctggagtggttgcaactttgcaaacctagaaaacaatgcctagatcacaggtactctaaagtggtgaaagaatttagcagatgtttttattcacatggcttaatccttttctctagtaccatagaaaacagtgccaaaaagctgtgttttatctacaagcctgaaactcccttcctcccctatcatcctagtctgtattctgagcaaatttagagtcagagtggtttcatgaacagctgtaagtattgttctgagctgacttcccaacatccaaaatggtggtattaggtcattggtggttttttttttgtttgtttttgttttttttgggctaggggtgttgttgacggggaactccttccttttcctgcttggggagtggacctctagttccattgcctgttgcttttgggcagcagtctgagaattcaagaccctgcacagtgcaggggataggatgcaggatttccgcccaagcccagtctgctgagctgctgtcacagggcagaccttgtgtctgctttatcttggtgaagcagctgcactgagcagattgctcacacagcagcctgttccatctgtgggtaaccatgttccgaggcagcaaagagaaaccgctattgctccgtggaaataaactatctgaataaaacttcttaacgggggttgaggctgaagctgaaacgggagtcggacacgatcttggctcctgaagtctttaaaggtcagtttgatgcacacttctataccaccacctgttaccagctgtagacagaagacctatctccatgcttgcccctaggcttttgtaggtaagaagcagcctgttttgtctttattgtttatttttgctgttcttttcaatttttgaaaatccctttacacatatgtattaagaatgtgggggagggttatggagagaaatgaatcaatggagcaaaagaagttgctttggaagaagcgcaatttaaatacagtggttattttccctggtaaagggcttttagccgtttataatctttttcctccccagttgagggatttaaggaatccgaggtagaatttttgatgactttagctttttagttttattaatgttttggattgttagtgatagatacttgctggctgttgtctcaggatttaaatgaggtctctaatttttaaaaaaagccacaacaacaagtctattttgggggccctggcaggttggcatttcagaagaatgggagtggctgtaagctgatgcctggtgatgttcttttcatttcggtgctgcgtccttggccacatgggccggaattatttctctttctggctcagtggtcagaatttgactcaagcaagtgtgaactctgtggggattgtgtctgtagtatcctatgagaaaaagtaaaaaccagggagaatttcagactttgatttttattagcacatatagtaaagatggtgagaaatgacggatgtttaggattttgaggttttgagaaggaagaaaaatgtatggactttcagcagtatatatgggcttgaggttggtaaattttgtgtaggtgagttacttgtcctgttaccaaaaggagtcatactcatggtctcaaactgcagaggaactctgtattgatggtctcagactacagagaaagtagccagtcatgaagaaattggtactttcttcagaaaatggccaggattgggaaaatccctggtcacattactttagagaaaaagcacctgagtgtgatctcagagccaaagggtattttctatcaagtttacattctactcatagatttaatcatactgttttgtgagtgagaagacataggtttaactgctgatttggaaggagccagtttgaaagaaggggatgtggcccttgacccaccaaaagcattgaccacagtgcttaggaaatcagtgatgcatgactgagccacgccagtcctgcagaggctgccgacacccgtcaagtgtcagtaatcactgttttctagtgtgactggttgctgtgccaagatgcatcttttcaaagttgataggtataggaaaggaaggaggtaccaaaaatcacatccccagaggaaagcaaccctctttccccccagaaattactctgactcacttagagatgttttgatcaagggatagttctaaggggattgcttagtcagattttaactttaataacattttatgaaatttaacacagattttggttctttgggcaaggaaacttgtttacccatttttaaactgctggtaagattatataattataaggtcaaagaaggaagaaaagaggttcatctatagaaatgtaactcttacaaatttaaggtagacttttgtacatgtcatgtgctcctagaataaaatcttaatataatttattctttggtgaaagaaacttctgtgctctttagtgtggggagcatttttcttgccagagtagtggcatcactaggttaataaccacagatgcatttccacatgaaatcgagatgacagttccatttgcatttggattattaaggtgaattttgactgttcaatcatgagtcccctttaaagaagtgtcagaagcctaaatttgcctcagacatcatttatcatttccttcctgtatttgcttgaccatgtggtggtcaggtaacaaaaaccaccactgtttttggtctgtcaacatggccagcaagaggacaactatgtaattcttgagaaaacatgcgcagaaacgtttctcttaagaaagggatagctagtctgtgattaggtttcagttttggaagaaataagggttaaaaataagacgtaactgctgagtagttcattcttactggttacagtgatgggtggatcagagtgtgttgtatgttagtgaaagtcatacttgtcccagaggctttttctcattctcagtggctttttcctttttgttttgtacaaatccttgcttttttgatgatggccaaga

SEQ ID NO: 515 - DNA, 840 bp, Homo sapiens
ttcctttcctagggtgattgtgttgttacagtgctgcttgctgaagaggacaaagctgaagatgatgtagtgttttacttggtatttttgggttccaccctccgtcactgtacaagtactcggaaggtcagttctgatacattggagaccattgctcctggtcatgattgttgtgaaacagtgaaggtgcagctctgtgcttccaaagagggccttcccgtgtttgtggtggctgaagaagactttcatttcgtccaggatgaagcgtatgatgcagctcaattcctagcaaccagtgctggaaatcagcaggctttgaactttacccgttttcttgaccagtcaggacccccatctggggatgtgaattcccttgataagaagttggtgctggcattcaggcacctgaagctgcccacggagtggaatgtattggggacagatcagagtttgcatgatgctggcccgcgagagacattgatgcattttgctgtgcggctgggactgctgaggttgacgtggttcctgttgcagaagccaggtggccgcggagctctcagtatccacaaccaggaaggggcgacgcctgtgagcttggccttggagcgaggctatcacaagctgcaccagcttctaaccgaggagaatgctggagaaccagactcctggagcagtttatcctatgaaataccgtatggagactgttctgtgaggcatcatcgagagttggacatctatacattaacctctgagtctgattcacatcatgaacacccatttcctggagacggttgcactggaccaatttttaaacttatgaacatccaacagcaactaatg

SEQ ID NO: 516 - protein, 276 aa, Homo sapiens
GDCVVTVLLAEEDKAEDDVVFYLVFLGSTLRHCTSTRKVSSDTLETIAPGHDCCETVKVQLCASKEGLPVFVVAEEDFHFVQDEAYDAAQFLATSAGNQQALNFTRFLDQSGPPSGDVNSLDKKLVLAFRHLKLPTEWNVLGTDQSLHDAGPRETLMHFAVRLGLLRLTWFLLQKPGGRGALSIHNQEGATPVSLALERGYHKLHQLLTEENAGEPDSWSSLSYEIPYGDCSVRHHRELDIYTLTSESDSHHEHPFPGDGCTGPIFKLMNIQQQLM

SEQ ID NO: 517 - DNA, 43229 bp, Mus musculus
  misc_feature (1)...(43229): n = A,T,C or G
gaaaaggcttagaggtgaggtcactccatccttcttcctgccctcaacgacaacactttaaatcttcccataggtcggtgctgcacttcaattaacaaatcccctagcaatgacaggcctttggaaagcatggccttcttaagtcgcccccatcgtaaatcacactggcctcacagagcttcctctaagataaaggtgcctctgtgtgccacttttatttgtgtcctcctaattaaaatgacaagatgtgtgaggagtgccgggagtccaagaaattgatccctctatagacagactctcaatccccttgcctcctctcatcaaacagataccctctttgaaaaaaacaaaacaaaacacaggaactataagtgtttctgtcaccttttgttgccttcattcactcatccacactggagcctgggtgcaggcatcttcaactatagtaaaaatagtgtctaatgtcatgccactgtcctgttcagagaacctgagacatcaacaagaaaaaagataatttggtccttttaagttgattgggaaaggattttattttttaacttttattattttattataatgttgattattattttagtatggggatctatggatgttcccaccaaagaataacccttaccgaactactgaacacctttgtggaaatccagctatgattggttccaggaagtgctctatcagggatagcagcaggcatagagctgtgttattttcaactagcttttagaatcccaaattcagctgggcgtggtggtgcacacctttaatcccagcacttgggaggcagaggcaggtagatttctgagtttaaggccatcctggtctacagagtgagttccaggacagccagggctacacagagaaaccctgtctctaaaaacaaacaaagaaacaaacaaaaccccaactcctagaggtttatactgattttgctctatgcagtgtttataagaaacccttgtctcacaatgatggaagatgaccaggacatatttatgttttatggaccacgtgaactgaggactcctgtagtgcctgtgtgtgcccatgtaatcacacatgtcatcaacgcaccaaggtttattctcatacccaaactctattctcgacccttccctctctagttagaaaatttgggttattcttgtaactggctttggcaggattactattgtttaaaaataaacttgaaaaaaaaaaagaagtttctcacatcctcaataacttgtaacaatcaatctacttgctagggaccatccctgccattgctgaattattcatgagtgatgattaacctgtgctgccctttccttctccctggagattcctgcagttactataggaacaagcacggggaacaatgcaggcattacattacgtcactcaagaccacactgtattaaaaaaagctcagctcaggagtggatttgttcattttccaggtgactaatgcacttctcaggaagtaagcaagtgaatgattttttttttttttcaagacagggtttctctgtgtagccctgactgtcctggaactcagtctgtagaccaggctggccttgaactcagaaatctgcctgcctctgcctcccgagtgctgggattaaaggcgtgcgccaccagtgcctggccagcaagtgaatgattttaagctaaatacttttcaataattatttcatagtatcttccatggaaaatgaaagcaattggatcaatgttgtattgccatgaagttttgtttaaaaaaatgaaaacaaacaaacaaacaaacaaacaaacaaaaacaagcaacctacagtggcatgtataaatgtaggatttcttaaagttttatttctatttatgtgtgtctgcatgtgtgtctacatgtgtctaggtgtctacatagaccagaagaggccatttagattacttaaatttggagtttcagatggttgaaggccttgcaatctgaatgctggaatttgaacccgggtcctttagaggagcaggaagaggtctcagctgctaggctatctctccagccctataaatgtagttttaaagcaatgcaataatcctaagaaagacaatgagttgacttttaaaggtttaaaggtatcatcccagtcacaaatattgtatttaataactcaactctttgttaattctaatatttgatttaaactgatgtgaaactgggctagaaaagcaccaaaatcatactgaagcgattgaaggtggtagcaattctcctcgggctgccagagtgttctcagtagctccaagccatcttttgatctcaatcatttttggttttgcgacttccacatagatgcagctctccaggtcaatgtgtctgacagtcagaactatcacataaggactgcagcctccaagctacctgagcagctcctgttacagcaagagctttagcggatggtctccaccctggcacatctgctcccttatcttctttaccagcttttctctaaagaaaacacagctggaccaactgaacacgatttccttaggttccacatgcttggcttcgggcatctttcccaggtggaagcatattgtttgcctaacagcctgatagaacaccgtctgtcacgtgttgtcatggctgtctatgcaatgtaccttcattatagcgccacaacaaatttaagccaaagaaggccgtaaaatttacctttttgataacttcccttataactgaaggctttctgtataagcaacaagtatctgttatgactgtaaggaaatggaatttttacaatgctcataggactatctagtaagccttgggctatgaaatagcaattgtcaaaatgtactgatgtgccaggcgtggtgacacactcctttaatcctagcactcaggaggcagaggcagaggaaccctgtctcgaaaaaccaaaaaagaaaaaaaaaaaaaagaaaaaaaaagaaagaaaagaaaagaaaagtactgatgcgcccattaagtaacttccaagactgtggagaaagggattattatagtctgtatactttttagtgaaatatacagtaaaccttgattctagtagtaaattttaagaattcttttttttttttctgtgcagaaagtgaatgtctcaagggaaaatgccttgaaaattgatatttgaggttcccatgaaattaccatcttgccatgtgataagctgagtggttatacaagcacccatatttgtctgatctttagtatcttaagctgaaactgatgtgctcagagaaggtttaacgggtcctggagaacaagtcccacagaaaacagagctcgacaaactagcatagagaagacaaagaacttggaaccgagtcctcatggaaaacaaaagaaatggtcagaaatcggctctcacgtttttaaattaatagaagatgctaactctattaacactcagttatgaaactaaaagatttaggattgtgagaaaaaaaatgctttcttagcaaatagagccacagtagaaatcacagggaacattttgattcagtagacccacagtagaaacagatgtttgagcatgagatgtttgagcatcctttgcagttcccatgcaccaatatttactttcatgtacatccttgatgaccgtaggatttttcatttgtacaagattaagataaaaggtggaggcagaactaagaatttagaatgtaaaaggagatggactggtgtcccagaaaaaaaaaaaattgtaccaagatcttggaaaagttatagatcagagaaagaaaaagtcattcagattatcatcactacacccagggaagagagacagagtggattgagccatctgaaagaaaggctgtggtgtttaaaccatgaaaagaatgggggagcagaggtgggactgggaacagaggttaagaaacccaaagttattgatttatttgtaatgcaccgaccactcggaaggagcaacacatggagtgtctagtgtcttcagcaaagcaaaatacatttgtctgtacttggctaaagcaagagaataaagaaaaaggccagtgagtgtaacaaacaccattaggaacttggacaggcctagtagctttatttgaatgaattaaaaatgggtttgagggcattcttgggtgttttaagcaacatatttcacattccagtcctttccccagtatttagcagctcctagaacaaaccctctttattcaaggactcagctgccagcaccccatgaaaaatccactccatcctgtttaaggtctcctgtttggtcagacagcttttggaggtatttggatttaagttaatcatgtgttctatcttctcaggtggccttggtatttgcttcccggatccaccctgccttgtcttctgacagagttgacctttgccttacactcctatctctgggtcagctatcttcttccctcagagtccacaaggaataattccattctggaaacttccttcataagtatggggatcacacactcctacttgcacctaatgttttcttacagtaaaatgcgaaccaccatgaattctgtattttattgttggtttacttgtctgcttgttttactttaaagaacctgaacccaagggaaggtggaggagactgagagatgaactatatctatttattaatatatggccccatagcaacattgtatatgtagtgaatagcccttacataccagaaattaaatgtgctaagctttttcatatctcttaagtgctaagatcctctttctgctatgtaaaaacataacagaaaaatgagaaaggatcataaatcaggatggcaactccaagaactcaggcttttcctggtcatttgtatggctttctctaaaagtgagcctttggaggaaagaaatttccccttatattaaatttgtagctttgagacggtagctgctacaaaagggcaactatagatttttagtaagtacattgtagagtaaggagtagacaggagacctgatagtcaaagctggaatttcatggtggtggagtgtttgggaaagaggagcttattctgaatgtcatgcattgtacaatgatttcatctttgctgaagaaactctgcatgcagcaaggtaacagaataaatgataatgtccaagaatgagtgagcgattgcttttcacattgatcccagagacctctgaagcagatggtctgtcttgtctattgatttgaggaaaagctgagccactgagccggatgtaaaagtccccaactcctccttagaggtcagccagaccttgggaggattgtctagttttccttttctaataaaagttgattaagagtcatggacctaggtttgaattagaataataattactttcttgaacaataagaacactattaaaaggaaaaatgttgttaaaagaggaactttttattaaggcactactggagagacttttacatgagacagatctgctgagtcagggatgtctaggaaaagcataatcaagaaataggttttttttagatgttagagagtctgaattgtcctctgtacagaaaaataccaaccaatcttatcgttgtgtaaatgtaccaaatagtttccattgtcaaacttccctcttatctccctgccagtggttaaattgtcaaaggctggatcattgtgtaacatgtatctgttactatttatgagaaagctagtgggtgtttttcatagcattcaatgcagacagcagcattttatatccttctttcgtatggtggtttgaatgagactgtctcccatgggcccacatatttgaacacttgctccttagttactgtcactgtttggagagatttaggaggtgtagccgtgttggagagaatatcagaagcaggtgttgagagtttgaagactcatgtcttctctctacttgtaagtccaaggtgtgagctctgggcttgctgctcctagcctgccatggttcctttcctgatggtgatcaacatttatctcctggcaccataagcacaaacaaatcctcccttctataagttgtctttgttgtggtttagcaacagtagaaagcaaatgaatacagtggtatttaaaaatatatgacagctgggtgtggtggcacacgcctttaatcccagcactctggaggcagaggcaggcagatttctgagtttgaggccagcctggtctacaaagtgagttccaggacagccagggctatacagagaaaccctgtctcgaaaaaccaagatagatagatagatagatagatagatagatagatagatagatagatatagatatatctatctatatatgtataaaacaatcaattttaaaagttatagcttatactcataagatgtcatgtattttaagcatgcagtcctagaatgcacacaaataaggtgtcaatcagatctttgtcataaatggtccccctgagctttcatattaatggtacccccactgaaccttgggcaactcctaattagtttctattaaatataactttggcttttgaaataatatcatttggaatcacttactatttagtctttttttaaattatatcttgttacttgaaaaatactgttaaacaaatgaatagacgtacacaggttttgagaaaatactggcaagatacagagccttgaatttagatttattgattcttaaatgaaattggctacttagtaacaaatggtcagccctgaaaacctccacacacaagaaccattacaagaagagcacgaggactccatggcagggtttgtagcaatagcatgaagcatccccacttggctggctccatcttcagtaatgttttctcttttaccgaacaaaacaagacaaagttttgccttttcaaccttcttgctcctctttctctctcattattctggtcacttcccaagaatttgagatgtgaaccaaaggcctaatcataaaatattccattttttaaaaaacatcttaggttctaggagttttagaaaagttttaggcctaggtgaccttgggtctagcgaaatgatgaactgcaaatttggatttatgaaactttaaaacatttatgtccagcctcaagcactatttattatatatttatctctctgtttgaaaagatttttgtatttactactgtatatgtgtgtgcaaatgtgtgcatgtgttgggtgttcacataggctagagcggtaagaactgggagctggagttacagacagttctacctgatgtatgtgctggggatggaaagtctggtcctttgaaagaacagtgcatgctcttatccactgagccatctccccatcgtactacaccacatctgcctcttaaacaataagacttgttatttcaacatcagctcaaaagaaaatcaagttgaaggggtctgcaaccctataggagcaacaacaatatgaactaaccagtacccccctcccccccaaccagagcttgtgtctctagttgcatatgtagcagaggatggcctagtaggctatcaatgggaggagaggcccttggtcttgggaagattatacgccccagtacagcagaatgccagagctgggagtgggttggggagcaggctggggggagggtataggggacttttgggatagcatttgaaatgtaaatgaagaaaatatctaataaaaaaagaaagctaaaaaaataaaataaaattagttgctgaacttaaaaaaaaataaaaacattaaaaaaaaagaaaatcaagttgaaatatactttctttggttgtgttagttcaattatagtggtcaaataggacaggagtaaaacagggtcacattttaaattcttttttttttttttttttttttttcgagacaatggtttctctgtgtagccctggctgtcctggaactcactctgtggaccaggctggcctcgaactcagaaatccacctgcctctgcctcccaagtgctgggattaaaggtgtgcaccaccactcccagctacagggtcacatttatccactgtatcaaactgagcagctatatttgagaaatttaaattaatttaaatttaaggttttaaaatttaaatgacaatgcaaatgagagagagagagagagagagagagagagagagagagagagagagtatcctagatctttgcactttaggggacttcccagtgaaggagaaggagaaatcagaaagaagaaagttcagacataacgatcagcatgcagtcagagctgacttttctccagaaacttctggaagaggagccatcctccagccaatccagggagctgtggttcccttgagctgctgttgacttgctcaaagcgtatgttgagccagggctctgggatgggccttgggtggcttgctgggagagaagctggggtgctgatattgggagttacctgctgggcttctagaccctaggaatttctctagggctcaggtagcctctctctactgtgtgcagcatctacagatggcagaaattcgagactaactatagtttcagtgcaaaggtcattgggaaatatatgtagccagcttttaattttgtggtccataggcttgtacttctgccattgcatctgcggctcatcagagccttttgtattttctctgtggatctctacaagcattaaacagggagccctcattctcctgcactgtagcctgcagcaatcaccattctcggtttctgtatcagagtcaaactcatccaggcaccgtatgtaagcaggctcgtagatggtggttttctttcactttcctgtatctactttgtagtgtgtgctgatttgtttttttttttttttttttatggctgaaaaacattctattgtatattgggtgtggtagtgtgaacctgtaattctaggaatctctatgctcttttctatagtagcagtgccatttactgggtatggaattatgtctcatggttttgatttagagtcaccagattagcagagctgctagccatatggtcacaaatgtctgtaagtcttttctgagggtatttccactctgttctttggcttttttttttttttttttttttgttgcatactttcttgttaaattgtgggattttttttttttttttaagttctggatgttaatctcatttggtatatatgttttccaactacttcctttgcttctttgagttactttaaaaatacaactatttttttctttgacagtttcatatatgtatgtcatatattttgattatattcatcccattgccttctcctatcctctccctgctctcactgagccccttctttcaaaaacaaaacaaaacaaaacaaaacaaaacaaaacaaaacaaaacaaaacaaaacaaaaaagttcgtactcttttcatgcctgtgtgcaggtgtggcctcctgggcttcattagggttgcctaggtgaacatggtgaggattatttactggaactcggggccacttccctgtggctccccactgatgtaagctgatcccctgaagttgcctttgaatcctcttgaattttgacactgactccttctcctggtttctttttggttttactgttcctacttttgtggttcagggccgagaaatgagtgcaaatccacggtcacgacttcttccccatttcttcttaaatttggggctccgaagaacacttagcagtaacctttatgcacagtatgagataaagaaatcacttcttttgcagaaattctatttctccagcactatttaccaaaagctgagagcctcctaagcaaggattccttcagtggatgattccggagccgctggttactgtttcaaaggttaagcaaataatgattaagttgtgcataacttaaggtagattttgacccctcacaagttgaacagtactagagatctaagatcattgacattcttcaggaaggagcaaaataacttaagccttcttggaaagactggaaagttaaagaatattttgctgatcaaagagcaactggctgcaagcagccctcaaattctggactcagctggccagagtggtctccctcttgccggcgaggtgagcgggggagctgcggagcatggcctcacattttctctggggttttgttactttattgatggtacccggattagacggtgaaactggaacaccagagcagaagctacagaaaagaattgctgatctccaccagtaagtataagcgtggcttatttctgctaagggactggagtctatccttgctgtccgtaacaaataacacgagaagtcaaagtttctcaaggaaagtagcgatgttaaaaagcccctggggagaagatttgggctggtataaagaactgttttctgatttacaaatggtctttgttcacttgtgagtgagtcacatctgcgattcctgggaaatatatcattaagaaattctcagagaaataatgatagatgaatagagacggtttggttggattgagtgtgaaatgaggatatgtatagcaagtctatcattattccgcaagaaacttggtttaaaatttaaaactctatgtgctaattactgatgaattctctgctcaaattgtataggcctcggatgactacggaggagggaaacttagtgtttcttacaagctctgcccaaaacattgaatttagaactggttccctggggaaaatcaaattaaatgatgatgaccttggcgaatgtttacaccaggtaatgcactgggaaaacacagctcttgctttgttaatcaatatatactagcttaaattgaccagctcaatattagtcagcaccttgaatcctgagcacagaaaacacaaccataagatcaggtcttaaaaagaagccttatgctggagagatggctcagtggttaagagcactgactgctcttccggaggtcctgagttcaaatcccagcagccacatggtggctcacaaccatctgtaatgagaaaaagaagccttataaagacttcatggtgaggagagaggggtcaatgccagaagaggaggctcattgcttagggacagatttcaccattcagagaagagccagaaagtcagagctcctctaccagagaggaagtaaggaggggaccagagcaggcacagatgcgttctatagggagggaagatgagttctgcatagaaggaataaaggggaaatagagcaggcacagatgtgttctgtgcagtgtgtgtggggcaataaggaggggaccagagcaggcacagatgtgttctgcagggagggaaaagggagaaccagagcaggcacagatgtgttctgtgcattgtgtggggcaataaggaggggaccagagcaggcacagatgtgttctgcagcactattgccacagcagagtagtcagttactctaatactttattgaacgctttccatactcagcattaataacatcacatgctgcggctgggtcatgcacttgtgtgttatattgcttgactctcaggactcccccatgaaagtgttgattattattccacttatgagttacaaagtgggcaaatatttaatgtccaaaaatagacaataagtaattggggcaagatttaaaattcaaaaggtctcattcaaaagcatacatttttgtgttactaggggttgaatggagaaagttttaaattatatcgtagtcaagctctctctcattgagctatagcccaagactaccacacttcttaatatgcactctaaaacgttattacattatgggaaaatacatatacaaaagtcattgtagctctagaagagtcaactgagctttgccacatgttttgaatttataataatgaagctttagtgcttgctcctgtaagatggaaatatttttccatattgttattcttttctttttctttttaaaatattagatccagagaaacaaagatgatattatagatttaaaaaggaatacaactggtcttcctcaaaatatacttagtcaagtccaccaacttaactcgaaggtaaggtcgacatatgcattgcgctcatggtaagagccatgagttcttgtcaatccaactttgtacgtagtgagctcttttgtcgttagctgtttatcgttacattgtgaactttggggtcaagtggcatagctgtaatggaggctagggagtggtagtggcagaaggcagtaagcactacggcaaggctttgttcaagttctgatagcatctcccttgcccaaggcttggctttgttcaagtcttgatagcatcttccttgcgaaccaagggggggttatcactgtctttgtgctgtaatctccttgtgaaggaaacagagagtcagcttatcagtgggctgaacttctttttaaaagacctttaaaaatttacaggtagaaagaaaccccagaagggaagggaataaggagggggaaaataatgaatgaaaaccaaccaagcaaaatgagtccctaaaagagcagcatagcaatgggtaacatcacgtgacagtctctgcgctcggtaattggtgcattttcttccccgctgctacagctcgtggatcttgagagagattttcaaagcttacagcaggtaagttctacggatggatagtcaccgaaaatatgtaagcaacatttctaaggtaaatatggctgttgttcctctgtaaacctagtactcaggagaccgaaccaggagtattgagagtttgaatccagcttaccgtacgtagcaagttacagaccaccttgatatacatagtatgaattaacctaaaataataataataataaatagtagtagtaatataaatgaatcaatagtttcattttaagcggtcaatcaataccaaggacttgattttccattgtttgattcctgctcctgcctccgtccctaggatgtacgagaaaacccagggcagtatgccaccctaaggtcactaagaatgtaggatcttctacacctgagttcacagccctcaagccccaccccttactgtctcctttagccatcctgctgtggctttacttgtgtatgtttggtcagctagtgatcccccagctggcatcaataactgagtctcagaaaaccacatagcctctcctcgctgagctcagaatactggggctgtacagtgttctcggctccttaaaactgcactggctggcagttcagcttaaaacactccccagagcaaatacactctaaccttgctatgtgtaggcaagactgtgttcatttatgcttttcaccttccttgtgggcaaatgactaaaacatcggttgaaaccataacccttctgcccaaagaaatgtatagaatgtaccaatacttatgattctgcaattcccagttaataatatctgctcaaatagttacaactcctttccataacggttgacctcctactgtgggcattaagtttggtgaacaacttcatgttctctgttcatcacttcgagaacacattgtacctcagccttcacatcttcagggaatagctgagcacatgagaacatgtaaagagaactggctgctgtggagcaaagcatcatgggggttttcaaactcctacagtgcttcccagtttcattgctggtcaagaactggagattgcgattaaaatgagcttccgctgtcctctcccctatcgtcggggtcaaggttttaatggtttccaatgtcaatttccttctgctttgtgataggacaaggtcagcagtcactgccaccccctcctcctcttcctcctgactgctaactaattttcgttcctgctagaacccccaaatctatggctttgaactgctttcgttcaccagaaaactcaaaagtttgtggccaatgttcttaataatgtcctttggccctttactggacataactcattgtggttctgacatgaagacaaatcataggagggaagaaagcagaattcacagacacacatgaatgtgtagtcctgggatttataacaaggacagagaaagaatgggctttgcagtaaacagcactggacaagttggagatctcacccttcgtcagctaccggaattttgtccatggaactaagttggttttctctgagcctttgttggtacttatgtatgggtgtaaaaaacactttgtccctgcttgaaacaagatttgactaaggtcaatgcattaaaatgtcttgactgcatcatcacttgccctcggtgaaactgttgcctctgcacccctaaatctttacaaattgtacagaatagtgcccggtagctgacgaagggtgagatccccagtttgtgtggacaaaggtagccctgtttgctgtcctggtctaaaagcagtcaggtgagcagagggcaaaaggtgtatctgctggctccatttcaaacaaaggggcttggagagaaaagagctcagtcatctgagccagtggcaggagggctggtaataaaagatgatccgttttcaaaggcttatctagaggtacctgagataagaccactaggcaagagagtggaaatttccatttcattttcttagtgcaatagcaacattcattcttataccctcatttgaagtcttcttccttccttccttccttccttccttccttccttccttcctccctccctccccctccttccctctctctctctctttctctctctcttttaagatttatttatttaatgtgactacactgtagctgtccttagacacaccagaagagggcatcagatcccgttaccatgtggttgctgggaattgaacccaggacccctggaagagcagtcagggctagaaatctttattcctgtctagtagcacttgtttctcagatgaaccatgctctaaagtatgtagggtgttaaggaaaatgagcatgattgcaatttttacaagagaattgactagaagggggaagagagtcattggaggaattctggaggaagccctcatagatgaggagaaatccacaggctaactgaagcgctcttcactgtgcactgaggacaagcactattctctcactgacttaactgtcctgtcgtttctttcagaatgtggagagaaaagtttgcagtagcaatccctgccacaatggtggcacctgtgtcaacctgcacgactcctttatttgtatctgcccttcacagtggaaggtgagtcactcaggctttcacttaaaaatcagagaacggctggcagggagccagccatggcttcttcggatgcattcagacacacctattatccaccaaagtttctaggattctgtgcctcacgagtcacagtgacttgtgccaaatagcggcagatttaaaccctgggccatgacagttcgttctgttagcactggcttgagtagttcagcactggaaagcatgggctgagtcttggagtgcatatgtgaatattcttgccctcttctctttcggtagcagtgagaatactgcatgcatggacaccaacaaaatcactcagtaaccacccccaagtatagcagccttttgaaataaggactcgtctatgtaaagattctctcttgtgaccacttgaccaatgtactcccgtgaggagcatctcggtcctggtctgatctgagttctagaagaatcttagcccaagattaatattattaatattgtatttgctttcaccaagggcttattgtccacatataagtcattaaatatattgtatgaatactgttctataaacgcccatgtcctatggtgcctgactgggttctttacatctctgcagggtctcttctgctcagaggatgttaacgagtgtgtactttatgctggaacaccctttggctgccagagtggatccacctgtgtgaacactatggggagtttcaggtaacttctttttaaaatgctgtgtgtatttctggaggacaagtagagcaagtcattaaaagtatccaaatgacggtctataatactaggagactaggcacccacaggggctacctgacttttattgaacatattcatagatattttttgctcaaataaatacaaattttcaccccatgaagaagtcattttagcagcatctctgaggaaggagaaggccatcatgactgtcatagagtggtcagaaaacgtggtgcaattgagttgatgcctgagcaagaatcagattcttaaagagcagctatgggatgaagttgtgtggcacaggcacaggccaccatccctgtgccccagtgctatgctaatttcatatattagcaggcttacagttgcaatatgggcacttcattcacactgtgaaagaatgttgaccaaaacaccaaagattgaaagaacattcagagacccagttaagacactgcattctcaattagccataaggtcccagcagccataatgacccatgcagcttgtccccttacagactcattttgatcaaatgatgcactcatggcatcttccaatcacctcatcccacctatagtctttccgaggaaaccgtcccttaaactgaacaagatcccacaaagcctctgtcttcccactggacttcagcagtgttggccagtaaagccagctaatcaagtcaggaagttaatgcttgatcattggcagatttactagtgtatagtttcttaaaataatttttgagaggaacttgacagcatcttttgctatattttggctacctgcctgtgttccgaggccccataaggattaagaagccagttttgctaccgcacaaactcctcattgctcagcagaataatctaacttgattaaagagcggtttatttgctcccttcctcacgcctctggtgtcttgtagcagtgcccggcagaaatgagtgtaataattttgctttaaccctgtcatctcttaacatactttctcaagaaggaaccatagttcctttgttctgagctttaaaactttgattcactctaggttaataaatatgactcaggcaaacttctactaggcatgttttataaattcaattattgtgcacaaccccaaatgaccgcttctcccttatgtctaatactatgttctctgagaggcctggtcatggggcatagtgattggagtcattagtaaaagccatagctttgaaggacaaccagtgaactttttgagggctttattgttcagactttggatctaattgaaaccgtgcccagtgacattgctgccagtcacattctggctccagctgactttcattcccttgaaagcattatcgcatggtttctgtttatggccatttatcaatcagactgtccaactggagatatcagtgacaagtgtcccaaactgactcctagcacatttgattgcttgcctccccagtatctagtaatgtcctggaggttaaatatcattccaatatttctttatctcaccaccttttggtgcattctatgccagtaaatctgtggtggtgtgggtcaaagaggagccgttcatacaagccattgctatttgttttctagcattatttttcatacttaccctataaaagggaaaaaggggtggggacctgtagcattcacaatttacaactcttcattgcatgtcaaggatgtgagatacacacacaagaaaggagaggaagaaggagagagggagagacagtgttgtttttcagagggaggtagcatacccttacaagacaggactgaactcgctcttgttccctacgcacaggaaagctgaaggatttctgctaactcttggctcctggttgtttctagatgctgccctcatagatttactggggggcatttgaaagcagagcattcaactcttaactcttaatttcttggtatgaaaatggtttatgtagccttgagaatccaagttgagtacatcttttttttttttttttttttttttttttttaggtttttggtttttgagacagggtttctctgtagccctggctgtcctggaactcactttgtagaccaggctggcctccaactcagaaatctgcctgcctctgcctcccaagtgctgggattaaaggtgtgcgtcactatgcccagcaagttgaatacatcttaaatacatgaattgaggtatattccaggaacttgtctctatatgtatgttttcctgtattcgtgcatggatgcacatgtatgtagcagccagggaacaacctcagatgtctctcctcaggtgccatctaccttgggttttgtttgttgtttttgttgttgtaatttttattatttttaaaattttatatgtctgagtgctttgcctgcatgcatatctgtgtaccacatgcatgcctagtgctcacataggacagaagaagtgtttacttcctggagttacagatggttgtgagttgccctgtgagtgctgggaaccacacccaggtaccctggaaaggcagcaagtgcctttaactgcctacacatttctagcccctcagcttgtattttagacagtctcccattggcctggtaaagtgccaagtagaccaggctgactggccagccagacccaggggccctcctctccctgacgctccattaccaagattattagcgtaagccacagtgcctagaccttttttccctctctcctttttcaatgggttctgggcattgagctcttgtcttcacacttacaagacaagcaattcactggctaagccattatccaccctcaacatctcgaagggatgaaataaaatatatactgctcatgagcataaaatttagtttttgctttgtgagtctgtatgtaataaaacactgagcatttaaaccattcctggaattctgttaagtctgggaagttaaaatgcttaattacctgtagtttcactgggctcagaagctcctttgtgaaactgaaccatgaatttgataaggaaaccatgagctgctgttgaatgatcttagttagcaatgtgggtatggcaggcaattagaaaattctgtgagtcagcttagttgggggaaatggaattctttcttcacaagtttaacaattcatcattatgaatgtctttgagaagatgaggcatcatgtaagtactagtagttgggatccctgttttattggcaatttcttttcttttggtcccccaccccactttggaaaagtttcttctttagagtgatgggtataggacaggataaactttcacctgtttcaactaattcctgaggttttgcctccagctgccatgagagccaagagaaaggcagttttctcttctcggtattattgtctcctaatcattgtgaacgttgcttctgattgtctcctgacttgctttgtatgtaagctagctcttagggtctggctttgccacccctgggtggtacatgtacttacagtgagaacctacaaggctttctaggaagaaaacaagctgtgtttactcccaggcacacagtgctgacgtggtacatcttatgctatctccatatcattggtggaatttaaagcattgcaaagttgaagtagtgaagataattctgttaggcatttgtgctagttaggtattacattttattaattcttttcagttatccaatgtactgatattgagccatggactctaagacaaattaactaggactatggaaggatatttcagtgtcttctcaattggcaagtgcagtttctgaagaccgaaagcctagtttcattctactaggataaaaccaacaataaaaaggtgactttttgtttgtttgtttgttttaaaaaaacaaaaactagtaaccaagagcttgagagatggatcagcaggtgaatacacttgttgcaaaagctcagtgacctaataggatccctggatcctatggtaggagagagccgactcctgacttaacacacacactgtggtatgaacatagccacacaccaacctacacatcatgcatacacatacacacataataaataaaatttaaaaggaattactatcaaaggcaggaatactactaaggtagtttaaaaaacatatgccttttattattgcttcataaatatttattcctttaaaagccatactgagtcactttgaaaacatatttcacatacaaatgctattatattataaagtccatggaaaattttcatactcactttactcttgagaacagaaatgtaacacagaaaaataacggagctgagtaaagcagacctgggtttctcttcatcttctctcatacattggttctgtggctgtaggcaatcttatttgctgcattcctgtaaaataagatgaaaacatttgcttttgaagatcatagcaagaaaggctatagtttacttgtttgttttcttttctcctcctccttctcttccccctcctcctcactcctcttcctcctcctccatttctccttctccttctcgttgctgttgttgttgttgttgttgttgttgttgttgttgttcttcttcttcttcttcttcttcttcttcttcttcttcttcttcttcttcttcttcttcttcttctccttctccttctccttctccttctccttctccttctccttctccttctccttctccttctccttctcctcttcctcctcctacttcctcctcctcctacnnnnnnnnnnnnnnnnnnnnnnnnnnnnnnnnnnnnnnnnnnnnnnnnnnnnnnnnnnnnnnnnnnctccccctcctcctcctccttcttcttgttgttcttttcctccttcttctgattctggctcttcttgtttttcttcctcctcctcctcctcttcctcttcttcctcctcttcttcttccttttctccttcctttaatatttaaattaagtgaaagaagtctactttgcatattgtttgaaagactataagatttatgtccactcagctccaagtgacaatggctaggaagaagtaagtgagagctaaggagagagggttgccctcagacacttgagcccaatctactctgacatcataagtagttttccagtggttaggtatttagctattagagaaacatacttctgagtacttcctcaagagaaagacctttggatgaggcatcatgagtcagtaccttgtcagaggtgaatgtttagtgcatctgttccggatttacactttcatcactttgtcccagcggttcccaaataccctaatagtccttgcatggaaaatgcatttagaaaaacttgtaataattggttctgagttgttttgttttacatgtcaaacttacagagtaaatatttagcaatgaatcaaatgcttaaatatgtataagaaatgcttaaaaatatgataatcccaaagagtataatttgcttccctggaagaatgagttagtgaagaggagagataacagggcataagggaaagcatggaaaaagatgagtagctattagatagggagcgaacatcaaatctaagtctaattactaattattattaattcatgacctggttttaatgagtaaagaaatcttggaatgctcatagacattatttattaattaaataacttttctataattacatagtagtgctataaattacatgcaacatacttacatatttttaaagtattcatttacctgagatagaaatttaactgtgtcccctgtattctaagttggtaagtctggcagctctaaatggtagtgcatagattgtggttttccatatctgtcctctccatttctggcaatacacattgaactctttttacttggaagtgactctgggtatcaccccagcaattgtttctcaatccagccctgacatgccttgattgtttcaaactcacttcttgcactatcacactttgacatctgtgattattagctgagctcctggtactgaatgcatagtgctacaacaacctttctgctttgtagcgagtcttcctttccaggagcctcaggaagtagctcaaggtccctgacatgagagacaaacatgttctccagatcctccctcgtcctcctctggcattagcactgacattcagttccctttgggatgaatctctgctggggtctaaccatgacctctgtgcttggcttttccactccctaggatgtgctcacacttagtctttgtgagtccttcacccccaccacatctctcaaccttacaagatccctttcctatgctttgcagaaatacagctaagccagcaacttaaaaagtcacaactaaacaaacttcccctatttgatttctgtttacctcacatttctagtggtagtgcatctcttagtatttaggaaccgtatgatgattatattttgttatgcattaaagtatgactgtgaaggaaatgtccccactattgacaacatctcttcctgaaagaatacatatttcctctgtaatagaaaggcccctggcagagaccatcacctgcgcttcttgacaggtgctataggatgaatgcagtgaacttgctgatctcccgtttcccttcttgaatgaactccattacccatgatttacagacacctgacttttgacagtactgtttgatgactgagatcaaaagaatttattgccccagtcctataaaacattgaatcatgattctctgacaattgatttgcaaagataacacaatcactcggtgcactgctcggaggagaactgaggaatttcgttctaaggttgcagctgaccaaactgcttggctggtttattattaacgttattggtttgcactgatggataccttttatggatgccaatggacagagtctggtactaaaactgcaaaccctgagcttgtgctcttgtgtaaccaacagatgtgactgcacgcctgatacgtatggacctcagtgtgcatccaaatataatgactgtgaacagggctctcagcagctctgtaagcatggcatctgcgaggatttacagcgagtttatcatggacaggtgggtcccttcccctcagtgcttcttgtggaaaccagtgttacatgctccccatgctgatgctgactctagaccatcactgtgctgctacaagtgactgtagaggtgaagtcccctccatttcttggtaggacacacacaagcaaatggggagataatttatacagaaaactggattcagaaaactgtgaggcttggcctcctggcctgtatgtttaacaatgacaagacacggaaacattacaggctctgttttgtcaatagcatctcatgtctggatttttcgggccttgagtccctgtgaagggcacactttgtggatctagctctccagtcttcctctcagctctgggtcctagatgggtagggtagtctggctagtttgatgttacaagaattttagttattctgaattaatttttaaagattcttaagagatagaaaacagtcccttctagcagtaggagtgagaggaaggagtggagagaagagatttttaagaaggaaatgattgcccgaagtctgtacctagttgggtgtttaccctttaactacatagctggctgagtccattgactgtaattacagctcttgattactgttactctttcctgggcatctttgggataaattataggatccttttatcctgaaataaagatgttcctttcccatggtctagtctaaatgtttaaatcatatgggaagagaaagagaatccactcaactgacctgatgcaaatgaacgtttgaatgacagtaaagagttcagggtttggtgagatattcagacctttttctctcctcttccccatagcctttattcactttattgttttcctttcagctgagatttaactgtatctgtgatgctgggtggacaacactgccaaatggtatctcctgcacagaggacaaagatgaatgcagcctccagccttcaccttgttcagaacatgcacagtgtttcaatacacaaggttccttctactgtggcgcctgcccaaaaggtactttcttgggggacacatgctaggctttgaataccacacagacaaggtaccagaatcaacttccctctaccactgatcatttttccagaggtgcctaaacctacctgcatgtcctactcaagagcatcttaatgctagaacaggtctccagagttggagatttgctaggcagtgtgccagcatccaactttaggccataattagacgtgggaagagagttattttcattgtaaataggagaagttgaggcttagaaagactaaataacttctccatgtacacaaagcttattcgaggccagatataaatccacatctgcctggccctggatctgaggtgagctgcagagtacgccatgactctgtcaaccaaggcacatgtgcacctagagctgcatttagagacttgtagtttaacgggtgcttgcatggtgttggtttagaactagcaaaggtaaggagaagaaagtcctctcctcttgcatctcaggggcaaaagtcacacgtagctgaattctcaaacgtaatttatgatgccaatccttaaacagtagatatcagataaaacaaatggcttaaattaaagggtgggtagtgtgtgcttgctttttcattttcttatttgaagaaaacaaagagaaacaaaacttaagaattgaaagcaaaaattttcatttttgtctttaatcattctattttttttcctgaatcttaaaggcactatatgtttgttataaatgttaggtaggtattacaagcatatctgtacaaaagcagagcatagtactatgtcttcttactgtgagaaccatcattagggctagagtgcatgtctctcagctccttgtgtatgcaacctaaccatgctcagacatgatcatttccttaagtcagtttatgaaggataccccacttagtcctaacattataagtatgctaaagggtgaagatatgtaaacatgattattattattataatgaatcccgagagtaatactaacattataactggctacaatagaatatttaaaggtttcttttcacctttaatctcatccttcacttttctttacttttaccaatataggcacagttttcagcaagtcattcctgcagattactagtatgactccaactcttcataatgttctataatttgttgtatacacttaaactatgcatgagaaaattctctcaatgtttgtattgtgcaaatgtacgaatgtgcatatgtatgggcatttctaaaattacttttaaaattcagtgccatagatgagtcttgaggcgctcaactgtttttattgtccttataagcaatgcctcggtaggtcttctaatgtattttgtaatatgtggatggttttatctacaaagaacacatttcaagaagtaaaattacttaaaaaggaatttatttttaaaaattaatgaatgttgccagatctcattccaaactggttttaattaacatccaatcaacagtctgcaagtgagccccatttatctaacacttcatcagaattagattctatgtatttaaagtaaattttggactaccagttagagatatctcattttaatctatagttttgtgtattttattcatcagtttgaattattctttaaatttttattttatttatttatttgggttggggagtgcatgccatagcatgcctttagaggtcagaggacaaattggagttagctctctcctaccatgtgagtcccaagcattgaacgtagatgatcatacttagtggaaagcatcattacccactgagccatgttgtcaacccagaatgattttgtgtatgtcttaactacctgtagttcttccttgttaagttgttaagtgctaatcttttaatcaatattttttctaggttggcaaggaaatggttaccaatgccaggatatcaacgaatgtgagatcaacaatggtggctgttcccaggctccactggtcccctgcctgaacactccaggatcattcacctgtgggaactgtccagcaggtactacatcaggcttcctgatgccatcacaaggcaatgcccttgaaatagaatctgtgctcactttaaatattttttccatttttattagatattttctttatttacatttcaaattttatctccttttctcatttcccctccgaaaactccccaacccccctacccctgctcactaacccacctactcccacttccctgtcctggcatttccctacactggggcatcaaggcttcacaaggccaaggtcctctcctcccattgatgttccataaggccatcctctgctacatactcagctgaagccatgagtccctccttgtgtagtctttggttagttgtttagttcctgggagctctgggggtactggttggttcatattgttgtttctctttggctctgcgaaccccttgggtcctttctttagttcctccattggggaccttgtgctcaggctaatggatgactgtgagcctccacttctgtatttgccaggcactggcagagcctctcaggagacagctatatcaggcctctgtcagcaaacatttgttggcatccacaatagtgtctgggtttggtaactgtatatgggatggatccccaggtgggacagtcactggatggcctttccttcagtttctgctccaaactttgtctgtgtatatcctcctatggttattttgatcccccttctaagaaggaccaaaatatccacactgtgtcttccttcttcttgagccttcatgtggtctatgaattgtatcttgggtattctgagcttctgggctaatatccacttatcagtgagtgcatagctgtgtgttcttttgtgattgggttatctcactcagatccaacatgtaataaggacatatgctccattatgttcatagcagccttatttataatagccagaagctggaaagaacccagatgttcttcaatagaggaatggatacagaaaatgtggtacatttacacagtgaagtactactcagctattaaaaattatgaattcatgaaggtcttaggcaaatggatggaactagaaaataccatcctgagtgaggtaacccaatcacaaaatgatttctaaggaaaaaaaaaaaaggaatggtgtaggatgcctaacttacagtgtagattcatcaatgcaataggacggcaaagtaagaaagagacagaaaacagtatcagcagcaaacagcacgaaaacacagacctgggaaatgcttctgtgagaatctttagatccatcactcttttgtgctcatacatgtatattcatttaatatattcacttgtggaccatgtccacagataaggcttacaaacatgatacatgttagtttctttttttcttctggaaagaggtcattctggttgtcctctagttcaaataaaactagtcttcaagaacttcagagagttctaagcaataaatgaatatatatatatttatgtatgcatatatgtatatatacatacatacatacatacacacacatacatatataaaaccaaagggggggtcaatatttttttttttgagacagggtttctctgtgtagccctggctgtcctggaactcactctgtagaccaggctggccttgaactcagaaatcctcctgcctctgcctcccgagtgctgggattaaaggtgtgcaccaccacagcccgactcaggtcaataatttttatacagtatattccaataatgttttctcctccctcaagtcctctgagttattttaataacatgaaaaatggtactttagacatctgtaataaatcacccccaagaacattagtcaatgaaattaaggtgtgtcaatttagagcctgccatttctatgacacctcacacttgcaagcttagaatatgtacacgcacatacatatgtgcacacacacacacatcttcacacatatatgtatgcacacacaaagccaccgtgctgttttatgagttcttttaaccatgtcctgctgattgactctgtggagtttcatatctctatctacttggctcttcagacttggttgcctggtatcttagtcggggtttctattcctgcacaaacatcatgactaagaagcagttggggaggaaagagtttattcagcttacatttctacactgctgttcatcatcaaaggaagtaggactggaattcaagcaggtcaggaagtaggagctgatgcagaggccatggagggatgttacttactggtttgcttccactggcttgctcagcttgctctcttatagaactcaagactaccatcccagggatggcaccatccacaaggggcctttcccccttgatcactaattgagaaaatgccttacagcaggatctcatggaggcatttccccaactgaagctcctttctctgtgataactccagcctgtgtcaagttgacacacaaaatcagccagtacacctggattctaatcttagacagccattgtctttttcccgtattcttgaccttgtttctcaccctctgctgtgctttggttaggtttcagtggtgatgggagagtgtgcacccccttggacatctgctcgatccataatggaggctgccatccagatgcaacctgttcctcctcttctgttctaggtaatggctcaccccccattgatccttggaggtttcattcaaaccctcttttctgtacaatttcatattctaaaaaaggaattattctggaaatttcaggggggggggagtgttgcacagtctcactctgtagccttgaaatcatataagcctcctgcctcagactcccaagtactcgtgttataggcaggagctaccattcataactctcaaaatcgttatcttgatcctcaaaaaaccctaactgatccccaaaacctacatatatttaaattctataatgtagttactcttgaacgatcttctttgactaaaagttgtttccaataataattaagccaaatagtcaataatgactttagcaaacagaatggagaaagggaagaaggacatatcaccttcttttataattcttctttctgtgccattgactagagttgtgcctttggctactgctggcagcagagaacatatagcatttatttcaggcatcacagttccagccggaaaaaaaaaaagtttacttctaggaaaggacaaatgaatgcagggtggtctcactgtgtagttgctgtggtaccacataaacaagctccaggtcatgtgtgcagtaacacatctttccgagcattgtctcattgcaagtcccagtcaacagctcgtgcaatgtttatgtgccccagctctgacaatcacagctactatttttttttgtcttgattggttttatagctaacagttagcttcttagtccttttaaagcctgtgtttttgttgctattgaacaataatgttttcagttgtacttctcagctttctgtttctcatatgcactgctcatttgctttcttttgagtttgtcacctttgattttacagaggaaaccgtcttccccttctgttttgtgtttttgcaacactttgttcgcagcatgtcattctctggattttgtactagtattttctatttagaggtgagagaccaaaatcttttaaattcaaactcagttttagagaacctgacctaagtttgaactcaggtaaattaacaggctggtacgtagcattaatttccaagttatcccccccaacaaaaccagagcctagctccagtctctaggctaaccctcaataggaccagcatctccagattattctctcaacaaacctgtaccccactcccaggttacaagaccaccccctgcctaatgatcaccattgcagagagaagcagaatttaagtttatgatatgactcccagcaccagccaattatgttaaaggcaatagtaacttcccagttagatgcttgtactctcaaccctgattgatgcctactataaaaccttgccctgacagacatttgcccccccccccccccaccaaaaccattcacttgatggtggtgcattggggttaggtcaagctagcttgaatagaataaagaccctgctgtgagttgcatcagatgggctcctgtctgttttttttaaggggtggggatcatcacattggtcatttgtgtaacaaaaagaaacctagatgatttccatccaaatggttagactcaacctcatccattaaataatacaacacattccttgatgtttcaaatttttatttttattaatgcatccttaatgtgcatgcattgatgagaatatattcatgtgcacaggtgtatacttacatggttgtatagatcgcacacatatgagtgaccaaacgatcaggaagtgtttaacagagcagtgatgtggacaagagcagcattcctcagattcctcaaatcccatttgatttctcctttggtctcatcatatgcttcctatctgatgatggtcaagacatccccatgcctctacactccacctctcccttgtgaactctgggcagtagtagcttgagtaatagtcagcttgagagaccaaaatgaaacagacagatatgaacatagctacattttatgcacaggaactggtcgtatattacatggtgtgaagtagcatttcatgttctttaacgatcatcatggcaacccgtgactttgcctgaggaatggcagcagatatccaggcaaagcatagccggtctgagtctccttacaccatttcccttcagtaaatactttaaaagaaatagataaaagaatgcaatcttatgcactcctttatggagaaaagattcctgtatgtcttactttcaaatcttgcaagcactatggccttaaggacataaaaccaccactatccatttatgctacaagtttgtcgttaaataatttattccaattgaatacttcagtgagattttcaatgcattttcatcaatatttgctggtggaggaacgtgtttacattcatcatcatattaattttcatgcattattccagctcttttatagtgataacagcaatgtatttctgcagtgacatggtgaccttcagcaactagggaatctgaaaatctctggatgttgtatttagtggaaattcataaaatattaaaggaggtatttgttctaggcattacaggataaaactgaaaatcctggatgttttagtattatttttagcttctaactcactcgtaattattaatggtactagaagattcaatcatttttgaaaattgaccaacttctttttccaaccccttatttggtctttccttgtattttgtaacatggaagcttagaataaaacattaaagaagcattggtgtttctattttgtttattgtgttactgtgttattttaatctgtagtttcatcacaaaattccttcgaatgcctcaaattcattttttttcagtggaattggacataggtgaaatctgtatgtacccgtgtctggaacatgagacctgcccatttagtgctaatccttgctatcactggtaccacgccttaaagtttctcttgaattttcacattctaactgtgtctccttgggcaggacaatctttgtgtgcttgatttttatctgtaaaggtgtaaatatttatagcagaatccatttatagaattatcaggaggattgagcaatctacctctgtatgtgtagacacaggtctataatgcttgcaacatctgtttatagggttatagataggattgagcaatctctgtatgtgtagacagagatataattgcttgaaacagataccgctgccataaaacttttattctgtactaaagatcccttcctgacgaagaagtgccatttcccatttcatagttccttcttatttgtacataaccttagatcatctgttacatgagaccatgattgcaaacttatataagaaatcagaaccatctaatgctttgttttacaataaaatgggaaagacagagattttaatcatttctcctcttgctttgtcttgactgcccataggagaaaatgcacttgaagttggtggattcttatctggacactagaattgaatttcatgactgcctctgaaccaagaatacctacacttacacatccatttttatttctgaacagggtccttgttgcctgtctgcacctgtcctccgggatatacaggaaatggttacgggtctaatggatgtgtacgcctcagtaatatgtgctcaagacacccgtgtgtaaatggacagtgcattgtgagtcttgctcctcttagggagattaaaaacttgcaaagaaccaatcatagattcaccattttatttcatatgattcttaagttaggtttctttctttctttttttcttttttctttttgcttgttttgttttgtttgggggaggtcctctcctctgctctcccctcctctcccctcccctccccaccccctctctctgaccaggttggcctcaaactcaaagattcacatacccctgccccctgagctctgggattaaaggcatgtatcaccagcacccagccacaagtttaatgataatgattcaagctttatgctaaggtttctgattctcagattagagattggtagtaactttggttcccaggaaaaccaataagccaatcaattgattttttaaaagatttatttataggtttgtatgtatatgtccttgcacagacttgtgtgcaccatctgtatggagatttctgctgagttaagagagtgttgagtatcatacaactagaattataggcagttgcaaactgtcagatatgggtgctggcttctgcatcctggtcctctaaaatgcagcaagcccttcaaaatctgagctctatctttgctccccatttagttgttttgtttgtttaatcaatgattttcaaactagtaagcaaaacctatagttttatggaaataaacatgactatttatactcagtaattgatgattttgtcaattggaaaacacacagtatagttcaattcctgttaaatatataccttacgttgtcacttcttttcatgatttgggttgattctcttatattttctgtccacttgatttgtagtatggcattttcttttcatcttaggaaacagtatcaagttacttctgtaagtgtgactcaggctggtttggacagaactgtacagaaaacattaatgagtgtgtgagcaacccctgtttgaatggagggacctgtattgatggtgtcaacggcttcacctgcgactgcacgagctcctggactggttattactgtcagactccccaggcaggtatggaagacattccttggaccacagatgctcccagcttaggggtatcatcgtccaatagactttttgcgtgtttgacaatgtaatctgatttcttcaccagtttacacactgacaagtagatttctccttgcagaaatagcatagaatccacgaagtggtatttgtaaacctcattttcaacaggaaacatttttcttcaaaaatattgtaaatattttccatgttctgtatattctttcataatgtaccatatactgaggaatttgcctttcagttttcttggagggctgctttcttcatggcaggcatctagtgatcataggaccctaactcatcattctcccacttactgatactttgcctggttaatcgaggtatagactgtcatttattgtcaatgaacagccttcattctatccatatcactatgtatttctctagttccatagcgatattcacacttcagccaggttaaattcctttctcatttgccatccagatgtatctgttccttgggcaccacactcaactcttcatccaagtctactctaccagctgcaagctctctgttcttactcctgttttcagatcagtgcattgattgaggtcttaccacacgcttaggacaatgatagaatataaaagcagaaaacactgcctctacttatctactccccatgtagtctaggaactgagactaccttgaggcagcagaaggtggcattaaatgtcaaaactgatgctgtaattgactcatgtggcgtaaagcctggtctatcatggcagtggccaaggaggatgaagaaatcgattgaagtttggagaaaatgtgttgggagtgaaaatggactgtggatgcagaaaggagggaggaggcttgatgtcagcacaaagggaccagaaaggaggaaagtgtgggctggaggagcctgctctcttcctttcaataatctatgaaaaccacaattcatcttttttatttttgcagcttgtggagggatcctctcagggacacaaggaaccttgcctaccagagcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttctagagtctctccctccaccccccccccactctttcccaccctttgcctagccatcctagccatctcttattgcagttaatgaaggattcccaacattggttgtctagctctaggcccgtagcaaatctgttaaactgtgctgttactgcagatgctgcaaatgtaggatttgaagatgatcattgaccctagtgggttgtcattaagtgggggcaactgatattaagatggcttcctatgtagtatccactctgtgccaggtaccatatgcctcatatacttcagtatactttaaactcaagttaaaaattattttttaatgtgtgtgtaaatggagcctaaattgtttgaaacatttgtccagatatgcgtgctttttaaatggcacgtggttttcaagacaactgactccaaagttcatgactctgagtcactacatgaacaactaaaactaacatctgagcccatgattttttttcatcgttcctgaacttttagatttctaaagtacttgttttccaagcaattctcagacttaaagtggtaggccttaatagttaaaatttcaatgggaaaatagttaaaattttttcccttgaaatcttaacttttcccagcaaactaatgttatagaggacattgtgcaagagtcctctataataataaaaaatattatttcccgtaaagaaggacaaccagttgtagcttggtcattacataatttattctattgtgaataaattccaaaaaagtttcccactgggtctgttgtgtgaatttccttccttccatttagttctagtgaattctatttcctgacattgaaaatttatttttccaaggaaaagatgctgtgaaaaatctttatatgtttattaccattttaaagaaaattcatccttttttttttttttggtgatacaattttacatagtctttttgccataagatataatagaaaacataaacaactaattaacatttattttgatttccatttacaattcttcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttccccacttggtagatactgtggctccacgcccccccagggggtccacagcagtgccaactctctctatttccatctctactcagaatacataaaacgggggagaggctttaccgcacggtgggaagcgaagctaccaggtaagtaggaaatgaagagcaagcagaacgttccatgatgttagggcatgtgtggagactacaaacaatgcaacattttaaatagtcattgtaagaacaaataatttaaaaatgagtttgatttttgaattcaaggacagaaaaaactagggtgcattgcaaagctagaatgcatgagtagtaatggggcccttataaaattactggatagaattggtggattgttttaacacactacttgtattgattgtttcagagcttaatacaatttattttgatttcatttactccctctcttccccctaattcctcccagatccatgcttatctcagtcaacttcatgttgtattttttctcttctggttttgaatacttcaccaagttcaatttgtgctttccacattcctagaggttcaaggacctgtacacaagcttggccagagggacaagctgcctgtgtgcccagtgcttcgcaggcggggaaagcagctcctcagagcgagctagcctaagaaaagccaccaactccaggttcaagtgagaggcctcacctccatctgtaagatggtgtgagactgagaaaggcagctgaagccatcccgcagcctctgcatacacatacactcatgcacgtgacatacacacatgcaacaaaaacaccttttaatgtatgcactgaagtgaagcgttttactctattttattttcatccataggttcaaatgtgtgtttttactagtattcagtttgatatactttcccatctgtatttatgtttctcatgtagtgagaaaaaccatgtattttgtaataattggacatggctgtctatatatgacaatttagtcaatttggttagtagtgctgtgcaaatatgttatttctccagagacttaagacgatgttctccactgatgagaggatggcactgaggtagcaagctatgagtatagactttattaattttgttcagacaactttgcttaatatattttatttaattttcctttcctaattatttcgaatatttattgtcccttttcgttcagtgtatagtgaggatgcataagatctactctcttaatttaagtgagatcagttattggttggttactcctacatgcttggtgccaccattgtcctagcaggcaggacagcactgtaggtcaaagcatttgtggccaggctgacatttacatttctcttttggtagtgtgtacaatgccttcctgtactaaagacacctgaacataggggtatgggctctatgtaggcaccagctcaacttcttccagttcaatttgttgtgtaggtgttgtctctaacaatggggtcttgtttgggagtgtttgggcctcccatgggacctttgaccttcaactcacttagatgtaacccaatcctgcttctacaagcttcattgggtgacaaaaaagatgctcagctgggactgtcttcattccattacttgatttcatttagatctccttcatgtgtgtgtgtgtgtgtgtgtgtgtgtgtgtgtgtgtgtgtgtgtgtgtgtgtgtttaggaagcttctaatgtactaggcgtctatactacccctcaaaaaagcacttaattttagctatctcttcttgcattccctccccatccacctctcatttgctactcctgttccagcctctgcccctcccatcaaccatgctagaactgtctactctatttcccttttgtaaggagatgtacctgtccctagtcccttactctattcctaacctctgtgtttctatgaattgtaacttatcattgatataacagctaatatcatatctatcacggattttatttttctattgaaaacatagagtcaatttttttgtcaaatttcccctctaagtctcactaccgttactatggagtctttgttcggaagccccagtatcagagtatttctggctgtgctcagagtgacttgtttattattgtctactttttccaacttggccttaataactgtatcatgaacagagcatcacagataaggtgttataaggtctctgggttgtattctcaaaacagctttgtagtaacagggagttccgttactgatggattgcttggatccaactgatgctggaattgagaagggtgtgtcaaagttccatgattcctaagaatatggttcttaccgttctagcacaggctttctgaaccttcagtttttttcagaattatcacaaaactcttacccttctcactgggtctatgataacagcaaggttattcattctcttcagccttggcattccctggctccatacctcgtggtggtctctgttaggcattctgtagtcttcctctatgtatcaacagttaaaggttcctctaaatacctgggatcctcctacaaaaatatttggtgctgtctccatgcaactgcttgcttacatagtatgttgctctgcaattttgaatacttgagaagcttcaaattctggggttttgttgacttaagctagcagaagtgttactgtctcctttgtttattttcgtaccatgtgaagttacacatgggaagatttccagaataagcccagggttcagctcataacctttccattgctcaaagagcacagttcagtgttatttgctccttaagacccctcaaagtaacaataagcaatttttctaacgccaagaactaagcattgttgacatttatttgttaaagaaactagttatgtgttctacacatcatccacccttctggattgtgctgtttgcatctcatgtgccctttatcatgttgtaaactggtacttggatcaaaaggtctattaagttatttttttttcttgcttgccaaggtatccactttgggtagcacatcatatcttctttttatctattaatacttctggattgatcagattggtgatcttctcattccaaagcatcccttttgtgctctctgcagtggctttttgtttttagcagctcttagattcataggaacccacaaattaatgagagtataagtgtatcatttactatctatctatctatctatctatctatctatctatctatctatctatcatctatctatcatttgtctgtctatcatctcaggtaatcaaaaggcttataaattcactacatcaggtatttgcttacaggtaggtcctagaggatgtgtcaatttgatgcaaacttgaatcacctggaaaaggaccctcagttgaggaactgcccctttcagagtagcctctatacctacaggctacttatgcttaaatggggcattttcttaattggtaattgaggaagaagggagggcctctcctactgtgggtggtaccactcctaggcagatcatcctatttgtgtaaaacaatctggccgagcaaatcatggagagcaagccagaaagcaacactcctcctgggtctctgatgtttcatttcctgccttcaggttcctgctttgagttcctcccttggtttcttttatgatgactgtcacctgtcacctgtaagccaaataaatccaatctgtcccttggttgttcttgctcagtttttatgagaggaacaggaagcagactaggagagaggaaatgcatgatacatttttaatttgttcccttttctgttggtatttgagttaatgacttgtttccctgggattcttcaaaatgattaatttcattttggtttgtttttcataaattagtatacttgataagagctgatatagattctttaaaaatgttcttttttcgtgttttttttttttttttcctacttagtttctgagtctgtttgcgcagactccagtgacttctgaatgttgatttgctttctggtttgaaaggatgttccaggcccttccacagtttgatggcttcagcagtgcaaaatgctgcttccggagagagctgtcatgtcctatgagaaacggattttaactcctacatctgggtgctacaactgatttctattgctgggtctctgaacagaagtagaaaacatctttttaatattattattaagggagcttaataatgttattattaagaagtaannnnnnnnnnnnnnnnnnnntctgtatgatatgcataacatggccccatctaattagtaatagaaaaaaccccaaaggcatattgttttgagcaggatcacagggttttaaagtcacatgttttcagtattcacgtttaacttttcaattcagtgaaattatttcctcttatttgtgattttagagatcacctcttaaattggttaatacatgtaattttataattgtataagaagtatgcacagtgctaaagccctcttaagaacattatgcatttttaaaatgtctagtttccatttctgactctgctatcttgctatttgctataagtagatggtttgtaaaattagctttacacttataccgccaataatcatataggctaatattttcccttctcagataagaagcagtattccctatgtggaggggtttacttgtcctccctgggcctggggactgcatcaaagcttgaatggagcacagcattacatagatgtgtcctggcctgttaagccatatattgatggcctcgtgacctgtttcctctaccattttggaattctaaattttatggcaacaaatactttgcatgttagccttattccaactttcccactgggcctttggaattgtttggtcaacagcatgcataagatttggtattttatgtgttatatttcttctgcagtgttcagaacaccctgtgtttttataacagtgtgggacagtgactacttcacagccagcctaatagtttgtttttaacattctggactcttgacttcgagagtcaagaaaccttacctcagtggtagcagagatgctggacatctttctatgtgtgcaaaagatgctgggatcttttcagtgtactctctcttcatactactcttctttttttaaattttctatattatggatgataacttagatattacacttccatttgatctttaaaattttacattgattatattattttataaatttaaaagttttatactgataatagacttctaagttaagttttaaaaatgcacttctctctgatcttggatgttccctgctaggttcaatgaaaaccatgaaactgattattttgggttttcctttggtaacaaaaactttggcttagtgtgtgtggttttatgaatatcaaccatatttaaaatgacatcttagttttatttctttcttaaggtatatttaacaaagtcttgattagttggtgtttctgctctttgattctactgtaacctttcttacaaatgaccaaaaattctccactaaataaatgtgaatattaaagggaaacagttcttatagacgtttctagtcactgttcagccacatagggagttgtatagtgcgctgggattggcatctggaagcactggggcccggttcactgctgtacttgcttcattcctggtacagtggcttaattgccatgtacatttacttataaacaagaacaacatatttatttcatagttttgttttgttttggttttggatttttcgagacaaggtttctctgtatagccctggctgtcttggaactcactttgtagaccaggctggcctcgaactcagaaatctgcctgcctctgcctcccggcttattttatagtttttatgctataaaatctacatatgattcatataagactattcagtaattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggccagcctggtttacagagtgagttccatgacagccagggctacacagagaaaccctgtctcaaaccaaaaaaagaaaaaaaagaaatgtatatgtgatccttaactattttaaagtataaagtgttctggtttattgaaagatgtaggggctcacagaagttccagggtttgtttgtttgtttgtttgtttgtttgtttaatttttaaagttgctatataaaaactaatcttttaagggtaagggactgaatctgttctcccattatttatgtcccagaagggtcagctctgtgtcttaaatcacataactgtatgatgctctgaggcatagagttcctacatgggggatttgcttacataccagttggtactaactttatagacatgaaacggggcagcttgaagtactgggtaatttatgagatcctaaagtttgcatagtcatgttaatgaagcttgccttctgacctcagagtctgtgagaatcatgtgactttagcctacatatgaatttagtaattttgtctcttctttcagagtgtggcggcatactgactggtaattatggttctattacatctccggggtaccctggaaactaccccccaggaagagattgtgtctggaaccttctagtcagtcctggctccttgataacatttacctttggcaccttgagcctggagagccacaatgactgcagtaaagactatttggaggtaaaaacaaataaacaaacaacaaaaagaacaactgaaaacccccacgtttcgataggatttgatagagtgtaattagtactcaagacactgtggttaatgacgctcatggatggccctcctgtgttaccaatgcttaggcagctgatgttaaatctctactctactgagtgtggaagagcttgccttgcatccccctgtctcttactggaaattcagactcctggagtaataataaaacctagcaatgcttgtctttttcaatacatattttgatttttagttttccaagacaagccctcaagatatcacaccacttgact

SEQ ID NO: 518 - DNA, 1283 bp, Mus musculus
ctggactcagctggccagagtggtctccctcttgccggcgaggtgagcgggggagctgcggagcatggcctcacattttctctggggttttgttactttattgatggtacccggattagacggtgaaactggaacaccagagcagaagctacagaaaagaattgctgatctccaccagcctcggatgactacggaggagggaaacttagtgtttcttacaagctctgcccaaaacattgaatttagaactggttccctggggaaaatcaaattaaatgatgatgaccttggcgaatgtttacaccagctcgtggatcttgagagagattttcaaagcttacagcagaatgtggagagaaaagtttgcagtagcaatccctgccacaatggtggcacctgtgtcaacctgcacgactcctttatttgtatctgcccttcacagtggaagggtctcttctgctcagaggatgttaacgagtgtgtactttatgctggaacaccctttggctgccagagtggatccacctgtgtgaacactatggggagtttcagatgtgactgcacgcctgatacgtatggacctcagtgtgcatccaaatataatgactgtgaacagggctctcagcagctctgtaagcatggcatctgcgaggatttacagcgagtttatcatggacagctgagatttaactgtatctgtgatgctgggtggacaacactgccaaatggtatctcctgcacagaggacaaagatgaatgcagcctccagccttcaccttgttcagaacatgcacagtgtttcaatacacaaggttccttctactgtggcgcctgcccaaaaggttggcaaggaaatggttaccaatgccaggatatcaacgaatgtgagatcaacaatggtggctgttcccaggctccactggtcccctgcctgaacactccaggatcattcacctgtgggaactgtccagcagggtccttgttgcctgtctgcacctgtcctccgggatatacaggaaatggttacgggtctaatggatgtgtacgcctcagtaatatgtgctcaagacacccgtgtgtaaatggacagtgcattgaaacagtatcaagttacttctgtaagtgtgactcaggctggtttggacagaactgtacagaaaacattaatgagtgtgtgagcaacccctgtttgaatggagggacctgtattgatggtgtcaacggcttcacctgcgactgcacgagctcctggactggttattactgtcagactccccaggcag

SEQ ID NO: 519 - protein, 413 aa, Mus musculus
  VARIANT (1)...(413): Xaa = Any Amino Acid
AGELRSMASHFLWGFVTLLMVPGLDGETGTPEQKLQKRIADLHQPRMTTEEGNLVFLTSSAQNIEFRTGSLGKIKLNDDDLGECLHQLVDLERDFQSLQQNVERKVCSSNPCHNGGTCVNLHDSFICICPSQWKGLFCSEDVNECVLYAGTPFGCQSGSTCVNTMGSFRCDCTPDTYGPQCASKYNDCEQGSQQLCKHGICEDLQRVYHGQLRFNCICDAGWTTLPNGISCTEDKDECSLQPSPCSEHAQCFNTQGSFYCGACPKGWQGNGYQCQDINECEINNGGCSQAPLVPCLNTPGSFTCGNCPAGSLLPVCTCPPGYTGNGYGSNGCVRLSNMCSRHPCVNGQCIETVSSYFCKCDSGWFGQNCTENINECVSNPCLNGGTCIDGVNGFTCDCTSSWTGYYCQTPQAX

SEQ ID NO: 520 - DNA, 275449 bp, Homo sapiens
  misc_feature (1)...(275449): n = A,T,C or G
attgatgacaacaccttaaatcttcccacagatctatgtggcacttcaattaacaaatcccctgggaatgatgcccctttgtaaggcatcagccttgttaaatcactcctctaaccgtaaatcacatccgtaatgcaaagcttcctctcacaagataaagatgcctgtgtgtactgcttctgcgtctatcttcccaattaaaggtacaagaggcagagtctgaagagtgccaggtatccccaaactttgttttctttttcttttttttcattttccttcccagaagagaaccaaactgtttttttcttccccccatcggtggtgacatcctcacctctcttgctctcctcccctaatagaacacaaaatatcatcacaaagatgtactttccccttttcctaagatcagatccaatataagttgtttgcagttatttaccacctacatttcttctgtcattcatgctgaagtctgagtgcaatcagacattttcctttgattatcgtatgaatggtgtctaaatatttaacttcaccgccttgtttggggaattttaggggtcaccaagtagaaaactcattttgtcctttttaggttgatttggaacaggatggcaggagggttcacctatggtaaactccgcttcattgcttcacaccttggaaaccaagcttggattaatccaatggagctgctgaagtccccattccgggagctgttggaggtagagaaagctctgttgatttttttactagcttttggagcctttaatcctagcaattagtatctcctctgctatggctgatccttataatgatgcgagaccctccagtgcatattttatgttttctgtaacatttgcttgagttacaattaggaagctgtgtgtgcacacgtgtgtatacatgtgccacgaacacccctgtgctcctcctccaaagccctattcccctattgcgtttgtccctctggatttgaatttcgttatttttttctcattgtttatgaagggattatattacttaaaaaaaaaaacttgaaaaaagtggaaaagttctccaaactctcaacaatctgctttctcaggaaaagctctgccaaacctcagcaatttaaatgttaatgattaactcataattctttttcattctactcaaagataattgtagtcattgtaataatgagcatggagaacaaatgtctgctttatgtgccttgagccaagaccacactgctttcaaaaagatcagttcatcacagtagtagacttggtaatttcctacatggtaatgcacttcccatgaaatgagcaaaagaatagttttaaatgtaccttgatttccatcattattttatgtaatccttcatggaaaatgaaagaattggaacaatgttatattgccctgaaattttgcagaaaatcacaaaactgacatatgtaaatgtatcttttaagcaatgttacgtccctgaaaaagagaatgaattaagtgtcatgaaggttaaaagatcgttatattcacaaatgtttccattaatgactaaaaaccagattaattctacagtgttctgttttaaactgatatgaaaatgaaaagggactaaaaaaagcacaaaagccagattgaagctataacatgtaatgggagctagcattaggggtgtgagaatcttgccaatttgtccatcctccaacgcacctctgcatctcaaccctctcctcatttttatgactcccacattgatccagtcctccagataaattcagctggcctagcagaaatatcacataaggattattgcactcaagataaaagaacatccccctattaaaaagattaaatcaacattctttaacctgccacttaaggccttctgtcgatgtctcttcctttacccagccactttccttcaaggtcaccctgctggacaagtggaacaacctttttttttttttcttttttttttggcagagtttcgctctgtcacccaggctggagtgcagtggctctcggcttgctgcaacctccacctcctgggttcaagcgattctcctgcctcagcctcgcctcctgagtagctgggactacaggtgtgtgccaccatgcccggctaatttttttgtatttttagtagagacagggtttcaccattttggctggtctcaaattcctgacctcaaatgatcagcccgccttggcctcccaaagtgctgggattacaggtacgaggcactgagcccggccagtggaaccactttctatagtgtgcccatactgggccttggacatctttcctagtttggtacctgctgtttacttaacagcatgctactgtgtatctgtgccatcttgtcacacttgtctttgtaatgttgcctaactctggctctccagatttgtacattacgactttattgtaaatcagagaaggtcaataaatttacttctttcaaatttcccccatggtcaaggacttcgtatgtcttcactaaatgcttattaagcctctaaaacaatggaatttagataaagctggtaggaataaaaagtgaacattggtataaaaaacagcagtgaaatatactaatgtggcaatgagatgctcttcaagaatttggagaaaaatacagaaaataagagggtaagtaaagtctgtacacttagtataaaatctccagtcacctctactagtccaggtagaagactggagaatttttttctgaacgtctccagggcaagatgccttcaaagatgggcatttggggttccccagtgaaattgtcagtttgccattcggttgctctgtggcaaagcctaccagttataatcgccacccatgcacacagagcctaccatccattctgtaatgtgttatttttaaatgtcaatgaacatataaggatccataggtatttgaggaaagcctctagcatgaattagaaagacctaaaccagcaaacaaatgggagaaaaacaacttagagaaaacagagcccatacaggaaacaagaaaacatcaaaaagcaactatctaaaaattactagatgatgttacaactacgaaacaagagcaaaaatcaaaaaaggggttttcaaatttaaaatgatagcaacattttaaaacaaattactagaaaattaaaagataaatactttctcagaaagtataacaaaacaagacaaagaggtggaaaatagaaaattatttaaaaattggagaatcaatctaagaaaaatgtagaaatggaaatgcagacgcaatggcagggaccacttgactctcgtcatgagtgaaggtgtctttgtgctcctaggtcactttaatgagtgtacagataattggcagggaggaggatctttgtaaaatgaagattctaattcagcaggttggcagtagcacctgagattttgcatttctgacacgctcctgagtgacgcctgtgctgggtctgtggaccacacttggagtagcaaggttctagtctacgccatctctacatcttccccactcccatcttagatggttaaaccacttgcagagagtgaggcctgtgaagcagcagagtggttgatattccttagagctctatgtatccaaatctgaactatctttcctccaaaatcttcttcccctgattattctcttactcaattaatgacatctctttccttccaattccaattttccaagcaagaaacctctgttcttttttttttttttttttttttgagacagagtctccctctgttgcccaggctggagtgcagtagtgcatagtgcaatcatggttcactgcagcttccgcctcccaggttcaagtgattctcctgcctcagcctcctgagtagctgggactacaggtgcccgccaccacgcctagctaatttttgtatttttagtagagacagggtttcaccatgttggccaggctgatcttgaactcccgacctcaagtgatctgcctgcctcggcctcccaaagtgtcaggattacagacatgagccactgcacccggccaacttccccctctaatagttctaatgaaatattaactacccaagtatttctgtagcctgttttctgaatatctttctcactgtctcctcatctgactgtccattgccttaaggctccccaggtcacatctctttaagtgtactctaggcgggccgatcatgaggtcaggagttcgaaaccaccctggccaacatggtgaaaccccgtctctaataataatacaaaaattagccgggtgtggtggtgtgtgcctgcaatcccagctactcaggaggtggaggcaggagaattgcctgaacccaggaggcagaggttgcagtaagccgagatcacgccactgcactccagcctgggtgacagagtgagactccatctgcggggggaaacatgtactctaacctccttaccaactctgggtctcagacatggctccacagggttgcttgtaaaatgcaaacatgaccatgttaatctcttccctaagagactctcataattctgcagtattaaaagtaaataaaatctaagctcattaaaatgatatttcaaagtccttcttgatttggcttcctgttcatttttaaaacttcatctcccacatatagacactgctgtagccctgctgagctactttctactgaaaagctttgtatacaccattactctgcctgaaactcctcactctactattctacctgggaactactcagatggactcctgggaagcctgcattccccttccaggcagagttaattctctcctccattgttctccaataaaggtctctctctctctctctctctctctctctccctccccctcccccaacctctgtttttgtccttagccatattctgattaccatgaccccttcttaaccttaaattcccctcatatgaaattctagtatactgggattaactttcatgtatgtttttgatgaccacaggaatttttatttgtgaagtctgtgggaattatttaaaggaggagcaaagaactgagcattcagaatataaagggaggagaagtgaatgtcacagaaggagaaaaggttgcacagagatatcttgaaaaacataaaaaacaggagaaaggagtagttcattctgattcttacaaccaccttcaggtggttttggaaggagggagggagggagagaagggagctaagacttcagtgagaaaggctgtggagccaggatgaggaagaaagagaaaggtgagaccatgcgacaggaccggagcagaagtcagcaggtcatgaattatggatgagcagtacactgaacatttggataccaccctcattccatgtaccatgtatggtatcagcaacaatgcaaaatacatttgcatgtgtcttgctgaagaagtcaaagagagtaaaggctgatgagtggaaatcaacagtacagcagacaccattataaacttaaagtctacaacatccattaatgttatcagtgttctgacctaagggttttatttattttttattattttattttatttttattttttgagacagagtctcactctgtcacccaggctggagggcagtggcatgatctcagctcactgcaagctccgcttcccgggttcaagccattctcctgcctcagcctcctgagtagctggtactacaggcgcccaccaccacgcccagctgattttttgtatttttagtacagacggggtttcaccgtgttagccaggatggtctccatctcctgacctcgtgatccacccgcctcggcctcccaaagtgctgggattacaggtttgagccaccgcgccgggccctaagggttttattttaatgaatgcgtacaaatgtgcataagggttccttaggtaaactctccaactaggtgccctcctccaaacactgagcagcccccagagcagatcctccctgtccgagggctccattgctagcaccccatataaaagcttcctcaccctggttactcagttccactcaaggatgataccgtttcttttggattgcctgctcttcaaaactcttggatttaaatggaatcttgctctccacccaccaatgtggagttgttctgtgcttcctggagtcaccttgccttgttcttagacatcagttacctttgcctcacacctttaactccaggtcagcaatcgtcttcctcactcaaagtccccaattcatctctctgctctgaaatcctcttttataggagaaatgatcagacacccttgcttctccttgtacccaagattataaagacagctgtgaattctttttgtcattttttcttttaaggaatctaaacccaagagaggatacaggagggtgaggattattatatttctttacatgatattgataacagcttatatttaatgaacacttattttgtgccagtaacctaatgtgctaaacattttacataacttcagtgctgttattatctgtctgctgatgaaaaaacaaggttccatggtcagtaagtgatggagtcagactttgaacgcacataaatgagcttcaggcccgtgttcttaaccttcaaccatgtggtcttccctagactggaggcttcagagggaagaatctgcaatttactacatttcgtgttcctatcatcttatagatggctaatatgtaaagggcacatgcagaatattaggggaatgcattctagattagggaagagacaggagttttactagtcaatgaaagatagaatttcaggtctatagaatgtttaccttgggagaggagaagaagagaggttatctaccatatagatctgaaggtcatagattctaaaactactttaattcatctttcctgaagtatttctgaatagagtaagtaaacagaatgagtgccaatcccttggaaacagcaattgatttttatattgcttttcacagagtcaacatatgcagacagtctgacttgcctattgatctgagctagagttgagtgaatgagctggatgtaaaattccctaactcatcactaaaagtcagtcagaccttgaacgacggttactttcttttttttttctaacatgggtgacaatgagcaattgaatgcttagattgggagctgagagattatctttactttgttgagtaataaacacattaattaacaaaacaggaaaatcctgtcaaagaggaagtccttattaagatcatgctggaggccttttctattgcactggaaagattagctgagttcagtggtctttaagaaagtataatcatgaaaatagttacgtccagagctcagagagtttgaattatccttttgattggaagattctagcccagactattttatcctattctaaacttgccaaaaatttcatattgtcaaactttccctccaccccatgccaagttgttaagctttcaaataaacaaatttattatgataaatttcatctctattgatgtaaaggctattggatatcttttcttagcatttagtttaataccaaattaatattttgtatcatcctgatatatgaagacatttacaaatatagaagagaaataattttaatcagttttattgtgctgtaatttacatctgccaaagattatctattttaactatacagctttatgagttttgacaaatttatacagtcatgcaaccacaatcacaatcatgatacagaacattttcatcacccttaaatattccctcatgcctccttgcgatcaatctcctccccaacccctggcctctgatttgttgtctatcagtgtagttttggcttttttagattttcatatggaatcatgtgatatagaatcacttaggaagtagtcttttgtgtcttattgttgtccttgaaaaatatttttaagcaagcaaaatgacttgccacaggttggcagaaaaatatttgcaaaatacatatttgaaaattcttgtatctagaatatatgagctcttacaatcaataaaagacaaacaacaaaattttaaaaaataggcaaaatatctaaacagacagttcaccgaagaagataaacaaatggcaaatatacataaaaagatgcccaacatctttggtcattagggaaatataaattaaaattgtaatgagatacctatgttgacacaaagacctgttcacaaatgttcataacagctttatttataatagtcccaaactggaaataactcaagtgtttatcaactgatgagtagagaagcaaactgtgggatagccatatgatgaaatactactcaataataaaagggaaccaattaatgatatacactacagcacagatgaattacaaaagcattatgttgagtgaaagaagcagatacaagagacatatagaagaaattgggaaggtttaaaaaaaatttttaaaagcagtgactatttgagtatcacaagtaaagtttttttttgttttgttttgtttttgagacggcatctcgctctgtcccccaggctggagtgcagtggcatgatctcagctcactgcaagctccgcctcccgggttcacgccattctcctgcctcagcctcccgagtagctgggactacaggcgcccgccactaagcccggctaattttttgtatttgtagtagagacggggtttcaccacgttagccaggatgttctcgatctcctgacctcgtgatccacccgcctcggcctcccaaagtgctgggattacaggcgtgagccaccgcgcccggcataagtaaagaattataagctatggtacataatgatcctctcctcaaagagcctacataagtaagacacaaaataagtaaaacacaaacaggcttgtcctgaaagagcctgcatgggtattaaccaatgcaatggtaattacctagagatttttcttagaagtgaaatttttacagctctccctcaaattcagttttgtctgtgtgctcatggaaagtctgagtgcatcaatagttgattttacaatcgaaatgtagaatattttcatcactctcagtggtttctgtagtcccagcacagagtgagtggggacatcagtgctccatgtcctcaaaccatatatccagctggaagggtgtatagcgcagtgtggaaagtgggaatggattccacagccgtccataggtcccacagggatgataaaaagtaaaaagtacaaattctttgtacattctggatattaacccattttcatatatatatgatttgcaaatattttcttccattctgggagttgctttttcactctgttgatgtattttttgatgcacaaacgtttttaattttgatgtattccaatttatatcttttggttgtctgtgtgtttttctttttttgcccatgcttttggtatcatactcaagaaatcattgccaaatccaaaatccaaggtcatgaatttttgtcctattcttctgagttttatgttatagtttcagattttttgaaccattgtgagttaattttatagttttagctcttagatttagatctttgaacttttttgagttaatttttgcatatggtatgaggtaagcctcctacttcttttgcatgtggatatctagttttcctagcgctgggtaaaggtggaactcctctgcaagggaggtgaggaaggaggggaacagagaaaggtgtagataatgaccagtttacttttgttgaaacctagttacttcttaagcaaagattgtttaagtggatgttttcaaagctgcttgttactgtttcaaaggtcaaatagataatgattaagttgcgcatcacttaaggtagattttgacctctcacaagttgaagagtactgaagatctaagatcatttacatccctctggaagaaaaaataacatagccttctagggcaaagaagaaaaaactcaacagttacaggatattccatggttcaaagtacacctgcctggtttgctgttctccaaaatcccatgctcagttggttggagtggcctcactcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagtaagtaaacacatgggtcattcctgctcagggactaggctaattcctcaccagttttcccaaatagccagataaacaaaggtgcaatttttcttgaggaaaattatgttgagaagcaaacagggaaaaacatttagactgaggtatgaaattactttcctatgcacaaattattatctgtcattttgcaaataatctgtttgcaattgccaggaggtatctctgagaaatgtgcagagaaaaaagtggcagatgagcaggggcagttgggttgagatgatcaaaaagtgaagatgtatttggcctgtagttattcagtaagaaactttgttattttggtttaaaaattgtacttgctaattactgatgcattctctcgtttgaattatataggcctcgaatggctacagagagaggaaatttggtgtttcttacggggtctgctcaaaacattgagtttagaaccggatccctgggaaaaattaaattaaatgatgaagatctcagtgagtgtttacatcaggtaatacactggaaatatattgaagtcattttgtatatccatatacggtgacttaattgaacaagtctagattaatctgtaccttgaatcttttttaattattattttttattaatacataatttgatacattcctataatgtgtaaagttcaaatcagggtaattgggatatccatcaccttaaatatttaccttttcttcatgctaagaacatatgaattgttctcttctagttattttgaaatgtacaatagattaatgttaactatagtcaccctactggtctatcaaacactaggtcttatttcttctatctaactatatattgtattcattaatcaacctgtcttcagcctccctcccccttcctagtgtaccttgaatctttagcatagagaacataattgggcatcagacatgttcttgtaaaggacgatggcctggggttaatagtgggtagagggagtatgctaaaagatagaagctcattgtgccagacaatgcaccctagtccagagaaggcacggagggtggaactgaaactcctccacaggggatgcgaggaagtaggggaccaaggatatgtggacatgtgaccagtttgcttttgccacagaacagaattggccagttattctcctgccttactgggtgttttcatttcccaataatcactgcatatttcagtcataatgttagaagtcagcattattcagagcttactgtgggccatccactgtgcttagcaccgtatggatgttatctcatttgaccttcacagctgtcctatgaggtggcctttattgtcaccctagttttacaagaggtaaagaaaccctgaagcagttaggtaacttgcccaggacagcaataaatagctgagccaggacttaaaacctaaacagtctgcttccaagccaggtttcttaataagcaccctaaactggtattataggaaaacatacaaatggaaaataccttgatctattgttactgaaaaggataagtggaattatgctgtggctattttagcccagtgtttattacgcatggtgttgttttggtttttataataataggcaagatcttagtgcttaaagtagaatactactcaagtttttaattatgttactgtaaagataaatatgatattttcactagtgctcttcatttcttcttctttttctaaaattagatccagaaaaacaaagaagatattatagagttaaaagggagtgcaattggtctgcctcaaaatatatctagtcaaatctatcagcttaattccaaggtaagtctgacatctacgtcataagaaccgatgagttctccctagttctattgtataagtaaccgttttgtaggggatataccaactttgtgtgctctttagagatttagcatgtaactactcactgtttggttaaatgacacagctgtaatggaggctgtagaagtgatggacagaaggcaggaaatgctgtgcaagcacttgttgcagaagtaggccttgggctgggagcagtggctcactgcaagtgaatggatgattaatataaaaaactgcctgtaatcccagcagtttgggaggccacagagggagggtcgcttgagcctaggagtttgagaccagcctgggccacatagtgagactccgtctctaccaaaaaaaaaaaaaaaaaaaaaaatagctgggcatggtggcatgagcctgtactcacagctacttgggaggctgaagtgggaggatggcttgagccagggaggttgagactgcagtgagctatgatcatgccactgtgctccagcccaggcaacagagtgggaccttgccagaaaaaaaaaaaaaaaaaaagaaagagagagagagagacagaaagagagagagagacagagagagagagagaaagaaagacagagtgaaagaaagagagagagagaaagaaagaaaggaagaaagaaagaaaagaagccttgctgaagttctgagagcaatcttcttattggggaagtggatgcatcactgacatttatgaacatttccatagtcactgcctacagagaagcaatcggtcaacttatcagtgggttgtactttaaaaaaaaacttaaaaaaaccccagaaatctatgtgataggagggaataggaaggaagaaaatcctgaggggagaggaatgaagaggaaaaagggaataaaaggaggaatgaacaaagtgtgtccctagcagagggcattaggacaatatgtcaaggatataacatcacatgtgcaatgcctttgaaccagctaactgaagctttttcttccctattgccagctggtggatcttgagagaaaattccaaggcttgcagcaggtaggtctcatgctactacatacccaaatctttcacagaaaacatactagaatcattaatagagctgctattcttattttgaaggtgaatggatgattaatattaaaaacttgctttttcccataatttaattctcatcccagcatgtgcttcccaggatgcagatgcagagctgagtctaagacagatgaaatgacaaggctgaggtctccgagcctgttagggcttctgaccctgagtttgcagcccacagcccacatcctttaccatcaccctttagctgtgtgtgctgtgcttggtcagctagtgatctcccaacttgctgattctcccatcagggactggggctcggaaagcaagcatcctctctgacgctaagctcggaagtctaggtgtatcacaaaatagtccgaattttcttaaaatgacatttgctggtaattaaacttgaacagtttcttacagaaaacattgtataactgtactacatgcttgtagactgatctatgtaaacttaggcttcttaccccttttgtaggaagctgaccttttaaagactttcatggaagctgtaaccttctatgcagagaaatgtacagaatctcttcatgtttaaaattttgcataaaaatctggggattccagtgtaagaatttctgcaaaaatattcttcatctgttttgctcatgcttcaagcattttcctctacttttaagtttgatctgtcccactgtgaaggacagatacaaaaaaaaggactcatgcagattgaggcaggtcccaccattctggcaaggattgctgctgcaaacctttttgtcatttgatgatcaagttcgtgtattccttttctccacttagataatacattgacccctcagctgtcatttttaagagagtagttaagcgaaagaaaatgagtaaagaatagtgctgtggaccgtgacactgcactcaagttttgtctcctggagggcttcattatattcgctcagccagtcctcctaccctcatccctcaggaggaacgttgaatgattttcaaatgtgaatgctttgtgcctttggatagggcaaatgctctctggccaccacagtccccaccactccctattgtcttcctcctgactcctgatttcattttctactaggcccctgtaggcttttaagattttagtccccagacagtgttgcttttgtctgacagaaaacctttgaatgagtttgtggttaatgttttaaagagcattctatgatggacagagccaattgttgtgctagcacaaagagaaaaatagaataatggaataaaacagggttcataaagagacccccagacgtgtggtcatctaatttatgaccaaagtggagaaggaatgtgctttgcagaaaatggtattgagtcagttggctatcctctggctttctatttcatccataaaatgaaggaaacagacgtaatttttttttatgagtcactgtatatagtatgttgtatttgtatgtgtgtgtgtatgtatgtgcatatatatagacacatatataatatatatgtatgtgtgtgcatacatatatatgaaatgtaatcaacagtttgcccctattttaactttttaaaagcagagaattaggttgggtacggtggctcacgcctgtaatcccagcactttaggaggccgaggcaggtggatcatgtgaggtcgggagtttgagatcagcctggtcaacatggtggaaccctgtctctactaaaaataggaaaattagccaggcgtagtgggacattcctgtagtcccagctactgaggaggctgaggcatgagaatcgcttcaacccaagaggtggaggttgcagtgagccgagatcataccactgcactccagcctgggtgacagaccgaggctccatctcaaaaacaaacaaacaaacaaaacaacgataccaaccaaaacccagacaattggactatgagtgaaattcataaagtggccatcattgcataatcaagtgttccctctaaagaagttttctctggctgggcgcggtggctcacacctgtaatcccagcactttaggaggctgaggcgggcggatcacgaggtcaggagatcgagaccatcctggctaacacggtgaaaccccgtctctactaaaaatacaaaaaattagctgggcgtggtggcgggcgcctgtagtcccagctacttaggaggctgaggcaggagaatggcatggacccgggaggcagagcctgcagtgagcggagatcgcgccactgcactccagcctgggcgacagagcaagactccgtctcaaaaaaaagaaaaaaaaatcaaaaagaaaagaaaaaagaaaaaagaaaaaaaagaagttttctctgcacccaaaggcagtaaaaatcttaacaagattcaaactggtagctgacatagggtcagattccccaggttatgtagatgtagatgtagacaaaggtaggtctgtttgtgatctgggctgaaagcagtcaggtgagcaccagggtgaaagatatgtcttagctggccacatttctaacaaagggacttggagcaggagttcagtcaccttaacccatgggaggaggggcagcagcagcagatgattatatttcaaaggctcacctcgagggaccaaagataagaatcaccggtaaaataaccggaatctccattttattttctttgtgcaatagcaacatccattattatttccacacctgaaacctttactcctgtccactgaggtctctttctcaggtgagaataatacttttccaagacaaagtgagaatcttctcccctcagacttcatcccacccgtggtcaaaagcatgctgagagttaaggaataggaacaagattgataatagaaaatgctttctgttttttcacaagagaggtgatttgaagaagaacataagtaatggctttaaagtgtagaaggagacccccactgattaagagttaaatgtaatcccacgtgcacggtaacatgcgttttgttgctgctgactgcaagtcatctcattgactgtcctgtttttgtttcagactgttgacaaaaaggtttgcagcagcaatccttgccagaatggtggaacctgcctcaatctgcatgattcctttttttgtatctgtcccccacagtggaaggtgagtcatctactctttggttaagaatgatggcaggtcagcatctgtggtttccttggaatcatcaggcatatttaattctccatctaaagtttctaggattctgtggcctcccaaatcaaattgaaatataccaggtatgctaaaacccaaacagtggtgagtatgattgtataacccaccaaatactaaagccattgaaaggagaggttcacttgattggataactgcctggaagaacacaatatttctgttaacattaatttaaattgttcagcattggaaagtaccaaacaaatcttgacatacctatgcaaattttctcattttctttgtttgtttattttttctgataacgatggaaactgtctccagcatgcacataaaaaaaaaagttaagtaagtattcccagatgtagcaccactgtgaactgaggattctattatgtttagataaggattcctctcctgtgactgctgtgatcttatgaagagctcttgtgttctattaggtgaaatctgagttccagaggaagaatagccaggggttaatatcagtattattgtatttgactttatgaggacttatatactgtccacgtataaatccttaaacgtatcatgtgaatgttcgctccagatacctctgtgacctttggcacctgactttgttccttatatgatcacagggtcctctctgctcagctgatgttaacgaatgtgagatttactcaggaacacccttgagctgccagaatggaggcacatgtgttaatacaatgggaagttacaggtaacttttttttttttttttggtaaatatcaggtatatttttgaaggcctaaaacatcccatagttaagagcatcctaaattaactatctgtattccaccaaaagttggtactccatgaggaaatatttagctcttgcttaacgtctacatagctatttttacttaactgaagaaaagctcatgagtcctttactctcaccccgtgaagaaatccttgctctaacatccccaaggaaccggaagaaggctcccgtgattggcacagagagtaagcatggcctggtgcaaaaggagctgaagacttaggaagagccggagcattgaaggggagccactgaatggccttaagtagaaaaggggacaccccaccacaccagtgtccccagctgtactctttccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcctgctcagctcaggcatcactttctgcaggaaactttcccttccctttttaagcagagtgaggcatctcagggcctctatgttcccatcatgctctagggatatccatcgtcaaagctttgctgatgacacacacattgtctttctaaaaacgaagtccaaaaaattaaggcagatcaatgccaaacttacttttgtacagttctttgaagtcaccttttaaactagacagtgtctttccttatagtttggctggtctcttttattttgtgatttttaaaagattaataaataaattctgctatagaatgaacaaatcctttcaatgctctggagtagaatctcactggattgaagagcaattatttgctctcttactggtgtctctgctatcttgttcttcaatttccacataacaatatccattctagtctttccagcaaaaatgagtgcagtaattttgttttttaaaccatcactattttttttaaattttattattattatactttaagttttagggtacatgtgcacaatgttcaggtttgttacttatgtatacatgtgccatgttggtgtgctgcacccattaactcgtcatttagcattaggtatatctcctaatgctatccctccaccctccccccaccccacaacagtccccggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatcatttttttatggctgcatagtattccatgttaaaccatcactattaatgcacacttctaaaaatgcagtcacaaaccttctctttttatttgatacttttgtttttttgatctgatctttaaaacttttactcattccaggttataaactcaaattattcaaacttctactagatatgtctatgagttcaatcattatgcaaaagtaaaattaaccacttctgacttaaatttagtgttatgttattaaagagctttttgattccaggactctgtttctcatttaaatgaagacttttttccctgcctttgttaggcttgggctggaagcaaaatgcagtctagtctctcatttccgtgaacccattatctcctgatttctgtttatgggcatttatcaaggaggattgctacatagaggtattggtggcaaatgtccaggctcctagaacttctgctttctgaccttcctgatatctaggaatgttacagagattagatttcactcctagtcttcctttatcatcactgtcttttggagtcttgtgggccaatagagcgacaagtatgggcaaactgtgatgagatccatagaccaagataaaggctgttgctgttttcagcacgttattttttccccctgcaaaatgaaaaacaaaacaaaaacccttttactatttaccactctgcagcatgtcagaggttagagttctttatccacacacacatatgacagaatgagagctaggaggaaaggaaccatttatttgttgaaagctgcatttctaaatgacagattcaactttgtaagaacagtacgaaattctctcttgcactcttttataaaggagagcaagaatacagaagaactaatgatgtgtggatggctttggaaatgatcttgattcctagactctgcccttcatagatttgctggaggacattagagaacagagcatttaaatcagggttctttctcttgatatgggaatagtttctgaaacctcatgaattccatttcattatctacactttaagtcccgtaattcaggcatatgttggagactttttgagggaataaaagaaaatgaaaaaaggtgcatgagcataagattaaattattgctttgtggaatccacgtgtaatgaaacaagtgaacatttagatactttcttgagttctgttaattatgtgaggttaaatccttgttaatcagggtattcactgaggctagaaaaccctttgggaaatttcagcacacattagctaaaagaaaacttgagcctcagaatcatctggacctgcaaaaatgtagtcatggcatcaaagttcgctttggagtttggacctcattcagtttctttaactctttgagctcttttacttggacggaaaaaggagtctttaactggattaataatttgccattgtaaagacctctgaaaaggtgcagatactcattcatggaaagtcctgtttcatacctgtttcataggtaaacttctggtggaaattcttttttagaacaatgattatagcacaagaaacatcattttctgtttccactgattcttttggcttgaggtctagacccagagcttcagacaactaacacaattacatttcgccacttctccatgctgttactccctctttgttctgaagacgtgattcttgttgtttccctgctcactttgttttgttttgtttgtttttgtttgtttgtttttgagacagagtcttgctcttgtcacccaggctggagtgcaattgctgcaacctctgcatcctgggtacaagcaattctcctacctcagcctcccgagtagctgggattacaggcacctgacaccatacccggctaatttttgtatttttagtagagatggggtttcaccatgttggccaggctggtctcaaactcctgacctcaggtgatctgcccgcttcagccacccaaagtgctgggattacaggcgtgagccaccgtgcccagcctcccctgcttactttggatttaagacagcccttgggatctgagcttgccatgcatggatggtgtgtgttgtacatttagggctcagatctagaaggctttccagaaaaacaaaaagttgagtttctctggttttccagaaacatgatgattagtaaattttatttcacttatttccattcatatcactggtagattttacatcatgcagagtttaaacaatgaggataatctagttttagctcaggtggtagttaggtattaaacttattacctttttcactcagtcagtaaaattagtattgaaccatggactctaacacaagttaaactatgactatccaagtgtgtttaacctcttctcaattgccaaaatgcacttgcagtgttttcaaagaaaagcctagatttgttctgctggaaccaagttggcaataaaaggtcatagaaaagacacttctgctatatcagtaactaataactaaagcaggaatagtagtaagttggttttaaaaatacaatatatggcttttattttcacttagggaggtatataagtaattgttcatttttaaaggccatatcaagacaccttgaaaatatattttgcctgttaaccctgttatgtttaaaaggtacatgaggctgggcacggtggctcacacctgtaatcccagcattttgggaggccgaggtgggtggatcacctgatgtcaggagttcgagaccagccttgctaacatggtgaaaccctgtctctaccaaaaaatgcaatacttagcttacgtgctggcacgcatctgtagtcccagctacttgagaggcagaggtgggaagatcgcttgaacctgggaggcagatgttgcagtgagccgagatcgcaccactgcactccgcctgggcacaagaccctgtctcaaaacaaaacgaaacaaaacaaaacaaaaaggtgcataaaaatgcagcatcttcatataactctacttatcagaatgtaagaatataacatgcaggaacaatggtgcaggagtcgggtagacctaagtgtctatttatcttctgccaattattcattttgtggttttgggaaatgttagtctgtaaaatgggattaataatacttgtctttgaggatcataggaaggaatcctatggtttacttgagtttcttcctccctttctctatcttctcacatcatctaaacttaagtgaaagaagtatactctgtagctatttagagaacagtataggattaatgcctactcatctcccagtgataatagcaaggatgaaggaagagagagataaagagaaaggatttaactgcaggtccatgaaccagaatctcctctcaaatcttatgtcattttgcaatagttaagcacttagtgataaaataaagacaatcttcttagcacttgctacaggggaatgcctgtagactgcaatatgaccataattcacagagattaccactattatttcataagaaattgaggcagagggagttagtacattgtctgggtaaacagttaacaggaaggaccaaaatttaaacctaggcaatcttatcccaggggtttccaaacactcagatctcccagacatagaaaatagaaagctagtaacagttggtttaaagattcttcagcagggtgcggtggctcacgcctgtaatcccaggactttgggaggccgaggtgggcagatcacctgaggtcaagagttcgagaccagcctctacctctagaaaagagacttctgctaaatcagtaactaatcaattggtttcaccacatggtgaaaacccatctctactaaaaaaagaaataaaaaattagccgggtgtggtggcacgcacctgtagtcccagctactcgggaggctgaagcaggagaattgcttgaacctgggaggcggaggttgcagtgagctgagatcatgccactgcagtccagcctgggtgacagagtgagactccatctcaaaaaaaacaaaaacaaaaataaaaaagattcttaaacattgttgggaggtgttgggacaggtggcaaagtaaacttttagtaatgaagtctcctggatcaaatgctcaaatatgtgtatgaactgttttaaagttccataatcctcaagagtctaattaaattctctatacaaatattctatgtaaagatgggaggacaaagaggaaagaaaacaatatgagaaggaaagtagagagagatgcggggaatataaatgtctatgggggggatggataattcaatttctctttaattttaatcatttattgttattttcctatgactttatcttagtgagccgttccaaaggcaactttggaatgctcagaaatgtcatatattaatgaatcagcttttatgtaaatatatactgatgtcgtaaattgcatggaacatatttataccaaaaaatattcatttattggaaactcacatttatttgggcatgctgtatttttatttgctaagtctggcctcccgacttgaatgcatggatggtgctccctgcattcttattctccatttctggccacactcattgctctcctcttccttagaaactgccaaaaagctgccaccccagcaattggttctggggcccaccacaggcaagccgaatcctgtgcctggaggttggttcttgatgcctttcaaacagtcaaatgctaatttcccacaatgtcgttcatacattgtcatccatgaacattactaagctccttgtacctcactgtgtcttgttaaaatagctcttttcctttgtagaatggcatgggagggaggcctggccacgcaggcacgccctgttccttgtctctgacccctggcaccaacagtcatttcccccatgagagcttttcttgccaattctgctcaagtccggcaatcggcaacctctgggcctggccctacctctccatcagatgtgccctggcatgtggggataggcttaggcttctgggactcctctaccctcctcctcccctagctcccatgctcagatcatagaagttcccattaagctgcagagataaggctaaagcagctttaacaatgacaagggcttaaaacaacattgcttatttgattatcattggacttaaatcttctagtaacaaagcacccactgctagcttacgcatagtgtaataattaccacattttgttggaaattcaagtgtggctatgaaagaaatgccactgtattatattatataactacgctttttatggatagaagacatattgccctttgtaagataataataatgatcatagactgtgaggtgtggacactggattgcgtgtggggttatataatcctagagagcattcagagttatcagtgtagcccacgttgcctgtgcttcatggcaggtccaattggacagatgatgaatggatttgctgatctctccctttaccttcttgaactaactccattacctttggcttatacacatctgacctttgaaaatgctgtttgatgacctgataacacaagaatttatagtgctaggcttaccagataataagttgtgattcaccaacattgtatttactcaatccaccacttggagcacagcagagtgattttctcccgagactccagtcagtaaatttgcattgctggctgacgattccaagttaacatcgttgatttgtaatttgaattatttttctcattgatattaagagacaggcactggccccaaagcgcatgccctgacattgtgctcttgtgtaaccaacagttgtcactgcccacctgagacgtacggaccccagtgtgcatccaaatatgacgactgtgaagggggttctgtggcacgctgtgtccatggcatctgtgaggatttaatgcgagagcaagctggagaggtgggtcccttccccaaatgtgcctccttgcagagagccatggttagtagctcctcctcctcctatgcccactgcatacaagcactacctggagcttacagaggtgaagtcacttcctgtctgtaagtaggacataggcgaggaggggagatgaactatgcaggaagtaggacccagagattaagatgtcattatgtaaaataggatttttttttttttttttttttgagatggagcctcactctgtcacccaggctggagtgcagtggcacgatctcagctcactgcaaccttcacctcccaggttcaagcaattctcgtgactcagcctcctgagtagctgggattacaggagcatgccaacatgcctggctaattttggtatttttagtagagacggggttttgccatgttggccaggatggtctcgaactcctgacctcaggtgatccacccgcctcagccccgcaaagcgctgcgattacaggcatgagccaccgtgcccggccgaaatgggaccatttttattatcccgtcatgactctctctgagataagaccttctcttggccttgtaagttttattttaacagtgacaaaacacaggaatataaaaggaccagtcttgttggcaacatgtggtttcaaggagtctgacttttcccggcctgggtctctggaactgctgcagactctaagagcccactccccagaacgaccctccatgccctgcgtcctgatgactttgactcctgaccctcaaggttgtccagtcttggctggcttggctcttcatgagaacttcaattctttatttttagttgtattttttctacccatgtgatggaaaataattcccgtccaatgatggggatggaagggttgaggaggtgggtaggaggaagaactttccaaagaaaaacaaacggaattgattttccaaggtctgtgcctacatgggtgtttttccctctaaaaacatagcaggctgagttgattgactttaattatattgacttacagttcttgattgttgttactctttccctggcatctttgggagaaattatagcttgcttttactctgaaataaagatgtttccctttttgcatggtctggtctaaatgcttaatcatatgggaagaaaaagagaagccagtggattggccttatggaaatgaacgttagaggataaacagttaggggcttgatgaaatgttcaaaggcttttcttgctgattttcatgattgtctttattcacgctgttgtcatcctgccagcccaagtacagctgcgtctgtgatgctgggtggatgtcttcacccaacagccctgcctgcacgctggacagagacgagtgcagcttccagcccgggccttgctccacacttgtgcagtgtttcaacactcaaggctctttctactgtggggcctgtccaacaggtacattctcagggccacaagccaggctctgcatgccaggttggcgaggtgccagaaccaattttctttcactattgatgagtaagaagacaattcttaggaggtgttcaaatccagttttgtgtcctggttctgctcgacgatctcactgctatcacaattccacgtcaaaagggggaggcttgtccaaaactgtgctagagtcagactttggggcaaggttagccatagaatttgtaagttagacactgcattgcagtgaccaccaactgaccagatttgagatcaaaagagatactctagtcccacctttcatactaaccagatgtttgtacacatggggaaattatttgacctctttgcatctccaccacagtctagtagctcttgcctgggtgtgtcattagagtatcttgcggccttgacctaaacagaggtatccagctccattatgccctgcagcaactgaatctccagggatgccatatgttgagtcatggaaaacatgggctccgttagtcaaagactgcctgtgtttgaatccgagggcatcttttgttttatgagatagtcatcatatattccacacattttttttttgtaggatgcctactatgagcaaagcactgtgctgggtgcattggtaggcaattagccagacctcaggttcatctgcgctccagggatgttcttagaaatggagccacaaagataatgtaataatagtagctggttttgttttgttttgttgttgttgttttgagacagagtctctccctgtcacccaggctggagtacagtggcatgatctcagctcactgcaacctccacctcctgggttcaagcgattctcctgcctcaccctcccgagtagctgggattacaggcacacctcaccacacccggctaatttttgtatttttagtagagatggggtttgccatgttggccaggctggtctcaaactcctggcctcaagtgatctgcctgccctggcctccaaaactgctgggattacaggcgtgagccaccacacacggcctggtttttatttttaatcaaagtgttattaaggcattgtataagcaatttttaattcttttaactacaacaaaatcaagacatggtaaaaataagtattactcacattttacaatatgagaacttgagcttaaagaggttgaataacttgcccaagatcgcatagctttacagatagccagaattgaaacccaagtttcttggcaagtttcttctcgccaagaaaccccacacacctattgccccatgtagtgatttttggtttagtggttttctgcgtgtatatatttagatcttgtaaaactggaaagaaatggaaaaaaaaaacctataaagactttttccctcttagttctcaggggcaagcacaatttgcaagcaatcacattttgaaggtaatttatcatggacaatctttaaaaactataaatcagaaaaataaattatttaaattagaagattggcaatgtttttacattcttctttttattgttggagaggaaaaagagaaacaatttttttgttttcttgtttatcaccctatttttcctgaaatatatggtagttatattttataagcagcaaagcaatatatgctgcttataaaatatcactacaaaaatatggaaaaaatagaaaaaaatacctttgatcttatcacacagaggaccatgatgaacatttgggcgtttttttcttccaactttttttcatgtacacattttgccatgcacaaatatgataattttcttaggcagagtcttagaagaggattctacttaaatcaaagaatatgaatatttttaaatctttaaaggtttttaagaattcttataattttaataatttgaattataaatctacaaccattgaatacaatgggaaccactaaagtaaaattcttaaatctcatcttcctaatgacaccattagtcatttgttctccttcctcttctactttattcttcatttgtacaagcacatatgcaagagtttaaaaaattctttccccaaattaggagtatgagcccaatcctccatatgattttaacagtttgtttttgtttttgagacaaagtctcgcccaggctggagtgcagtggtgcaatcttggctcactgcaacctccacctcccgggtttgagggattcttctgcctcagcctcccaagtagctgggactacaggcgtgaaccaccacatccagctgatttttgtatttttagtacagatggtgtttcaccattttggccaggctggtcttgaactcctggcctcaggtgatctgcccacctcggcctcccaaagtgctgggattacaggcatgagccaccttgcccagccacatttagtattttaattaatgtatatacaaaaattctttcaatgtgtgtgtatgcaaatgtaggtatacaggtgtacacatgatattaaaaagcgtttttagtatttggtcacaaagatgagtcataaggtgttcagctatgcttctattgataattgagggttttttccctattaaacagtgctgcggtagacatcctcttacctacttataccagtatactaagatgtatactaccatcttagtatactggtagttttatcacaataggctgagttttaataggtgcaactggcagtcaaagtctatgtattttaaaaattttagtgaatactgccagagctctttccaaataggttatatcaatttaatgtctagctatcagcatataagaggagcccatttgcccactttgttgtcagaatttgattttaagaattcaaaacaacttttgccaatctgataagcatatctcatttttattttatagttccttaggtggagaaggtttttatatgttttgactcttgtatttcttccttgttgacttgtctatagagctaaacttttaaatcctcttgttttcctaggctggcaaggcaatggatatatttgcgaagatatcaatgaatgtgagataaataacggcggctgttctgtggctccacccgttgagtgtgtgaatacacctgggtcttcccactgccaggcctgtccaccaggtgctgcctcggttcaatgtcaacctcctgaccccagcacagggaacacagacataggaatacggaatctagtgctccatttaaaatatgatttctggctgagtgcagttgctcatgcctgtaatcccagcactttgggaggctgaggtgggcagatcacatgaggtcgggagttcgggcctggccaacatggtgaaaccctgtctctactaaaaagacaaaaattagctgggcatggtggtgcatgcttgtaatcctagctactcgggaggctgaggcacgagaatcgcttgaacctgggaagcggagattgcagtgagctgagatcgcaccattgcactccagcctaggcaacagagtgagactctgtcttaaaaaaataaaaaataaaatattatttctgtcttaggagaggaaatagtacagaaagttttgcttatcttgtgaattcaggacacattagtacaactctatgataagaaagaaaaaacattttgaatatcagtagaaaacaacaaactttacaaactgtcaaatagctacagagataatgcagaatttgaaaagttttctgagtggatcacagacttactgttccattgccctcacgaataatttgttaatatcatgcactcctgagttgttttgcatataccaagtttactaaaccacaggcatcacagtaggcatatatcgtaattgttggtttccctccttttctggaaagaagtcttttctgctattctctaatctaaatcgaattactacccaagaagttcagggagtactaagggataaactgaaaccttgtatgtttaaataacatggaactacagtactttgggcttctataataattgacctctaagaacatcagagtcactgtaatataaaaatattaactttcttagtgtcagcactttctaagtctaccagtagttttatacatatttttttcattagaaacaacccagaacattgcttatgaaatcaggttactaattcttgttatttttcttatttatgaaatttcatttgttgatgacattttatacttatattttttgtttcgatgatagaggatccctgattggtccatttcatgatatttgaatcctagacaggctttgtcctcccatcttcttgacattgtttcttatgacctggctcttgttctcatcagggtaccagggtgacggaagagtgtgcacactcacagacatctgctcagtcagtaatggaggctgccacccagatgcctcatgctcctcaactctaggtaatgactcatctctctctttggctttgggtattgtaatatgaccttctaaaccaattcaacatcttaaacacaaaatcctctgttctcaaaattgttattttgaccttcaaacctaaaattaatccatgccataaaactacacatttggctttcttaaatatgtaataaactatgctctttaatggtctgctctgatttaggaaataaggtaattaagccagttaattaattaacgactgtattccaacaagcaggcaggagaaaaggaggaagaaggcaatgccaccttcttttgaaggactcttccatttctaggccattgcttagaactgagctttgctgcaaagggagtttgggaagtacactctatatttcaggcatcctgagtccagctgaaataaggagttcagaaagaaggaagtagaaaatagatctagggtgacaaccaacagtgtttgcaatgctgcatagaagggtttaaccctgtaatttaacaaaatatatactgctaaactttctccaagaaagattgtatcaatttatgtattcaccgacagtgtataaaaatacatatttactccatctttgacaataatagatattattattatttttcatcttggtcagttttataggcaaaattagtttttccattattttcatttatactttttgattactaataattaatactttccacattttcactgggcatctttctacttgttcatcccctttgctctctttctttcttactgattggtaaagtttctttatgtactaaggacattatctcattatctgtcttatgttttataagtgtttttcctggcatgttgtttttgttttaatcttgtagtggtagtgctattcagaagtttagaatttttacgtagtcaaaaagataaatcttttctcttactatttctcccttcacagtcatgtttaggaaggctttctttactgaactctttaaaaattgtcaagtacatgttcttttatacttctatggtttctttttttatggtaagatattttatatttttagaatgtattttttatccgtagcatcaaatagagatctggcttggtatttttgctcaaataagtggacccaattccatttcttgaataatcatgtctcttgctatttcaagataccacctttattttttattaatttgtcatatacttgcatatatagaaaagaacatatatgtgtatgtaaacacacacacacacacacacacatatacttgtgactaaatgcttattaaatgattatcaacataccaaagtggttaggagcatgatttctagataaagactgcttgcatttttccctgggctccaccagattttagctgcttgtcctcagtgaagacacttaatctctgtgctttagttcttcatctgtaaaatgaggataataatagcacctacctcagggtgcttcagatgattaaatgagtccttatatgtaaagtgcttgtaacaaatattattacaaaaataactgttttttaatatggaggacagtcataatgttgatgacatgaagtattaataacactttgtgtacttttaggctgcccttctttactgcaacctgtaagtttaccctgggaaacttaaaaaatttctactcagagcttcaacagtttcagagcttgcttactccatttttccctataaatatttttaaaagaagtaattaactataaaaaaatgcatttctaggcaattatttatttaaaagaaatatttgtgttttttaatattgaagtggaatcttgcaagtaatataagctgagaacataacaaaacttgtatttttgccaggcgcggtggctcacgcctgtcatcccagcactttgggaggtcgaggcaggtggatcacgaggtcaggagatagagaccatcctggccaacatggtgaaaccccgtctctactgaaaatacaaaaaattagccaggcgtggtggcgggcacctgtagtcccagctactcgggaggctgaggcaggagaatggcgtgaacccgggaggcggagcttacagtgagctgagatcgcaccactgcactccagcctgggcgacagagcgagactccgtctcaaaaaaaaaaaaaaaaaaagaacaacttatattgtcattcaattctactgtaaatctgtcacattgtgtaatttgttctattttttaaattattcagcagggtttttctatccatctttaacagttcttgctgatggaggaatgtagttaactgccacattgatttccttgtattatttcaaccattgtgcagtagtagaaagaacatatatttctgcaatgagatgtggctttttgctattaagtgagaaatctggaaaactctctggatattaaatttagtaaaattttgtaatgtctatgacgagtatttttaacctaacattgcgtaagaaaactgtcaagatgctggatgctctaaaactcttgttagctattacctcatgtacatcataattaatcgtggatgttaattcatgttttaaatagacacgatcatttcaaattccttttgaccaagttccttcctaacctaattcgattgccattgttttaaccttgtaccttggcaatgaggagctcatcagaagtgtgggagaagttttggtgctggtattttgttgatgtccccatatatttatgttactatattatcttcaatctgtggttttattgcaaacatcttttagagacttaagttcattctgtgatagctatttagcctgtttaaaactggcagcatgcaatctgcacatccacataactggggacatgtggcctgcctgtgtaagccacactcctgtacaggtgtgctgtaggcagcctacacacgaggggagtgcttgctctctgggctcccctcattctagctgtgtgtgtgtgtccttggccgggacaggctgtctgtgtactggcttcatctgtaaagtggggattataagagagtacctatatagggctttttttttttttttttgagatggcgttttgctctgtctcccaggctggagtgcagtggcaggatcttggctcactgcaacctccacctcctgggttgaagtgattctcctgcctcggcctcctgattagcctggactacaggccaccatgccccgctaattgttttgtatttttagtagagacagggcttaaccatcttggccaggctggtctcaaactcctgacctcaggtgatccgcctgcctcggcctcccaaagttcagggattacagattccatagggctctttattagtattattattattataattaaaaaattttttcttggaaatggagtctcactctgtcacccaggctggagtgcagtggcactatctcagctcactacaacctctgcctcctgggttcaagtgattctcctgcctcaccctcccaagtagctgggattacaggcgtgtgccaccatgcctggctaatttttgtatttttagtagagacagggtttctccacattggccaggctggtctcgaactcctgaactcaagtgatctgccctcctcagcctcccaaactgctgggattacaggcgtgagccactgtgcctggccctctattgggctcttgggaggattaaatcagtcagagtaagtccagtgcttgcaacagatagtttcatcctaagaatctccttttctgcattaactcctccatgatgaggaatgtctgtcttccccaggtgcagctcacctttgtgcacagctcaggaccatctgacatatgggctgacagcacccatgtcaacccagtacgtcaataatgtgtggaaggcatttaatggctttcttattttaagataagaaatacaaaaataaagattctaatattttctcctcataccttgttttgtctgcccgtcaaaatacacagactggatgttggtggatccttgtctagacagcagattctgagtttagatactgcatccgaacagaggaggagacctgtatttacacgtttgtttttatttctgaacaggttccttacctctctgcacgtgtctcccgggttatactggaaatggttatgggccaaatggatgtgtgcagctcagtaatatttgcctaagtcacccctgtctaaatggacaatgcatcgtgagtcctttgtttttcctgtggacagagagtacctgagaattagtttcacgcctataaaatgtaacgttataggattcaggaatgtcaagataatgagtcaagtttcagataaggaactgtcgagaactctcagatgaaagatagataatgattttagttcttaggaaaaaacattgagttaattttttgtctcagtggtttatgaagtactaaaactacgcctgcagtttgatctaaataaatctgacatacaaaacaattaccatttaaacctattaataacaagtagactactagaaaatacttacatataaacacatatatatttgtagcacctgttaaatatatcagtaggccaggcgtggtggctcatgcctgtaatcccaacactttgggagggtgaggcgggtgcatcacgagccaggagatcaagaccagcctgaccgacatggtgaaacactgtctctactgcaaaaagttagccaggtgtggtggcgcgtgcctgtaatcccagctactcaggaggctgagaccggagaatcacttgaacccgggaggcagaggttgcagtgagctgagattgcaccactgcactccagcctggccgacagagcgagactccatctcaaaaaaaaaaaaaattatatatatataattatacatatataattattacataaataataattatttttaaatatataattatatattattttatatataataattatataattattatatattatatatctccatggcactacattcctattatttgggttgattaaagtttagtgtctatccatttgttttatggtattatgtgttttttttccccttaggacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaaggtacagtcagcatttcttatgccacggatgctcacagcatagcagcagcatcctttagtgagtccctcaacagattcctctgctgaacccactttcttgtccagttgctcagatactgagaactaagtctttccttgcagaaatggtataaaattcacaagctaaatatttataaatctcactgtaagccaagaacttttcttccaaagaataaatacattagtatttgccattttcactatgtcctttttgaatataaaacatgctaaggtattgtcttttatggttttctaaagggaagttttctgaggagcagccacttaatttccctagagtactgcattgaatcaagtcactctccctttccaggatacacagtggcttcccgttgcctgttaaatagagactgggattaattttcaatgatcttctataaccaagtctcactcaatccatctaaccttttttttcactagttccctagaaataacttcactcaagcaagttttctttcgtcaccggaccccatgtaccaccatgagtattttccactgtgttcatttatttggaatgtttctcccgataaacctcctcacacatcttccttgtttctcatccagatgtgtctgtccctcaggagcacttccctctcaacttcttccataaagtcacttttgactcttctgcccctcacttaaactcctgatttggaatcaacacatttattgagaggttgttgttatatgtttaggacaatagtagaccctatggaaaaatatgaaagtgtaaaatactgtctccacttatgaactgctcaccttgcagctgaggagacaagaccaaccccaatgggagaacagatacaagagttaaagacatgagctatgttgtgtggggtgaaattgggtgtcacagggacacagagaatgggaatcagtgaaaacataagacatggcagttcatggagcaggtgatgaggcatcagctgagctttgaacaagaggtgggatttctatggaagttgacagaaaaagggcacagaggagagggaatggcagggcttttatctccaaccttcattactcaaattttctctaagtttatcagcagcagggttacagttgcccaacctcttccttttaggaacctctgaaaagcacagttcatcttttcctttgcagtttgtggagagtccctctcaggaataaatggaagcttcagctacaggagcccggatgttggttatgttcatgatgttaactgcttctgggttatcaaaactgaaatgggaaaggtaaatgtagtaactcttgcccaaatgcatattatatttgtatatataaatatggagtatgtgtatattttattacataaaatacatgcaatgataattcaactatcatatattgagtgcttactaagtacggagtgccattattttggctagacatatacctaccttttcataaccttacattaattgtttgaaataagtcacaggggctgggtgcagtagctcttgcctgtaatcccagcactttgagaggatgaggtgggtgcatcacctgaggtcaggagttccagaccagtctggtcaatatggcgaaaccctgtctctactaaaaataaaacaaataaaaaaaaattagccaggtgtagtggcacattcctgtaatcccagctactcgggaggctgaggcaggagaattgcttgaatccaggaggcggagtttgtagtgagcagagacagtgccactgtactccagcctggccaacagagtaagactccatctcacaaaaaaaaaaaaaaaaaaaaaaaaaaagagtaacaaggccaggcctggtggctcacgcctgtgatcctagtactttatgaggctgaggcgggcacattgcctgaggtcaggaattcaagaccagcctggccaacatggtgaaaatccagctctactaaaatgacaaaaattagccaggtatggtgatgggtgcctttaatctcaggtactcgggaggctgaggcaggagaatcacttgagctcaggaggcagaggttccagtgagctgagattgcaccactgcactccagcctgggtgacagagcaagactctgtctcaaaaataaataaataaataaataaataaataaataaataaataaataaataggaggatcctccttttatagatgaaataatgaaaagtaggtgaagctaaacattttttgttaacacttcttagcttgtaattgtaatagttgaatttcaaagtcaagtttgtctggttccaaagtccatgctttctccagcatgaatgattctctacactggttgactgactgcaagccactagttaatctgtaaaatcatgttgttactgagacagtattttagaagatggttgcttagttttatgttgattattgtgcaaaaatggccactgatattaagatagttttcttatcaaatgtctttgctctgccatgttctatactaagtgctccatatacattacagcattccatttttaactctcataaccctgaaagatagaaattattatcttcattttacacatgaggaaacagagcctagtgccattgagaagtgtgtccaggtgcatgtggttcgaaagtggcatgcagtgactcagacacaggccagtcacctccacagcctgtcactctgagccgctccgtgaacgctcttcaaattaagatccaagtccaaggtttttagtgctcttatacccgacattaattacccaggcatttctaaatattgtttctcaaccacctcctggattcataaaaataaaatggtatgtctgaatagataaaattttcccttgaaatcctattaactttttccagcaaactattacagagggcattgtacaagggtcaaaaaacatttttttttcctttgaggagggaggactatttgcgacctggtaacctcacactaaaataaactccaaaataaatttcccagtgggtatgctatgtgaatttccttccttccatttagttttcatgaattctatttcctggcattgaaaacattcttttgaaaaaaaaatattcttaggtgagaaacttgtaatactttcattaccaattcgcaagaaaattcatcttgtttttttcttgattattgtgatttcatatcttctcactcataatggacataatatggtagaaaatatatacaaatcaggatagttcaattaatgaacatttgagtttcatttaaactgttttaagaaagtcatgtagtaataggtaactgatcttaaaataccctagcacagaattttaaaaattccttatattctttttcattaactgaatattgttgtgattttaggttctgatgaaaattaaattcgacagccttcttttgattgtttatctcaaatgaggttgtcagtacgttttataagttatattactatatttgaagtctgtattctaatccattcggacacatttttgtgtttattctcttctacttgtatgctcagtatttttcctgttattcttgtatgctcagtattcttcctctcattctctactcttggtattactcatcctttaattatatccagtccctgaagccgtccaggccttgcttgtctacatcccgcctactccgcccacacctgagcgtgtcggtctgggctggcgtcagaatcttagcccctctggaatcaacatccctggcgggcagtgatgaacgtctgtgtgtttgataacaggccacaggttattcagggaattagggtgtacattcttgtgaatggtaatattagccagttcaacttaattcaggtagattttcaaatctccaatttattttactgctttagaaacaatgtcagttatatatttgacataccttggtctggtggacttgacaagtttaatgaaattggggtaaatctatgttattaacattaagattttttgatatattttgatattagttgaagtttgtttttaacaatatttagcacaagttatttagtatatagattgccatatgtactggtggataattagggaatgataggtctagctcttgaaagtgcctcagtatgaatgctgcctaggaagtgggagaaatactttaaaatttacatggaagtaaaagataatatatgtggcctttgtatttttaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccaggtatgtgtgaacctggagaaaaaagcaagcaaaattttgaggttattaagttttcttaatcagtgttagacttttggatacatgagatgttttgggatctgaagatatataatatttttataatttattttattttattcatttatttattttgagacaaggtcttactctgttgcccaggctggagtgcagtggcctgatcacggctcactgaaacgtcgacctcctttgctcaagtgatcctcacacctcagccttctgagtagctgggactacaggtgtgcaccaccactccaggctaatgttttgtgtgttttttatagagatggagtttctctatgttgcccaggctggtctcaaactcctgggctcaagcaatccatctaatttggcctcccaaagtgctgggattacaggcatgagccactgtgaccaaccataattactttaaaatcaaatcaacctagaattaattagaatttattttgtgtctaaaggcaacaaaataagcatgaaatagaagggattaaaaaacatgagtcttagttggtcccttatcaaattactgaacagcctttttataagctctactagtagtttactgcaggaatattgaggacattgtccaccccttcatgtagtattccttcatcttaatgatcactcaataattttttctttttgttattattttgttttaattattctattttcttttaagtttttactatgcaagttttaaacaaataaaaagtaaagagatcagtataccatgcccccaattcattcatcaatacatctgtggatcaatttcagcattttctcatcttttttactggtgtttttatctatcctgatgctacctaggcttaacttctgatgcttgaaatctgagagtgtaatttcaactttgttcttttcaaagatgttggatattctgcatttccatataagtttttgaatcaacttgtcagttttcccaaagaattttatgggaattacattgaaactataattaactttggaagaaatgacatcttaaaaatattcagcctgccaatgcatgaacataaactatttttaaatttagttctcttttcatttatcctggcaatgttttatagctttcagtgtctaagtattccatatctttgttagatttatttacagatatttgatatattatgcttagtgaaatattaattttctaaaatttaatttttcacttgttatgtaaaaatatgtattttttaaatatttgattttgattccatatacattgttaaattcactcatcatgtctaattattttttgtagattcttttggattttttaaacgtacataattacatcatgtgtgaatgaaggatatttttcctcttcctttccagtctttgtaactattatttcttttccttgacttattgccctggctaggaccttcaataccaagccgaataaaagtggtgaaaaggaaatccttgtcttttccccagcagcatggggaaatgctcaatatttcattgttgaatatgatgttagctgtaagttttcacagataatttttatcagatgaagagtgttctttcctatgtcaactactattgctgtataactaatttcccacaaatttagtgttgtagaacattaatcatttgactttgtttctgattttgtgggccaggaatttggaaagaacctaacatgacagttgctacttgaaatctattcagcagttataagcgggtgtcagctgggactgtagctgactaaaggctggactgggctgaatatccaagatggcctactccagtggctaccaattgatgctggctttcaatgagagttcaactaggctatggacctgagtgcctacatgtggctactctaaaaagtttgtcttagaatagtgaaactttcttcgtggcaattggcttctctcagagcaagcattacaacagaaccagacaggtgctgcgtgggaatttttcagcctatgtttggaagtcattgtgttatttctgccatactcaatgggttaacttagtcacaagctgacccaaattcaaggcgaggggacataggcccacttctaaatgggagaggtgtcagaatttataaagaattaaaaaaaaacccacaccttttgttcctagttaccaagaattttaaaaaatcatgaatgaatgttgaaacatataaaatactttttctgactctattcaggtgatcatatgttttttgtcctctattctgtaaatatagtgagttaaattgattgattttgaatggtgaatcaactttgcattcatcaaatattttccatttgttcatggcaagttatgctttttatacattgctagattttatttgctaatatgtatttttaggatttttatatctatatttgggtgatattcttttgtaattttgtcaagttacaggtaatgtcaatgttttaaaattaatagaaaagtgtcctctctttttatattctctggaaggatttgtgtaagattgacaatatttcttaaatgtttgaaataatttaccataaagttaattgagcctgcaggcttccttgtgagaaggctttaaattatgattcaatgtatttaatatagatctattcagagtttacatttcttcttttttcagttttggcaatttttttctcaagaaactcatctgtactttcagaatattttcttactatgttttagtgttcgtaggctctgtagtgatgtcgtctcttttcattcctgatattgataatttatgttatcttttttaccttgataagtcttaccaaggatttgttagttttactaatgttttcaaaattccaactattggctccgttaatgttttctgttgatttttatttcattgattttcctcatggttttatcattttcttcccttgtgttattttgcacctaatgtatggttactttaacaattttttcctagcttcttgacttggaagcattgacaaatgagtttgaacttcttagaatttctaatatatgcactaatactaatgcattttccttggagaacttttatttgcatcccacaggttttaatatgtatgttttcattagcattcggctgaaagtattttgtcatttttattttgaattctctgtgaccataggttttattaaaattatactgtttatttaccaatgtgatcactaatcatgcagtatattatttcaatctttaaaatttgttaagatttactttatagaccaaagtctattttggtgcatttattgtatggacaggaaagaatgtatattctgtaatggttagatgtagtcctctacctatattaacttagtcaagttggtaaatagtgtttttcaaatattaaatttctttactgatttaaaaaaatatttgctttattacttagtcagaaagttatagtaaaatctcaaactatgattctagatttgccagctttttgttctgaaacttttgctttatttattttcttacattatttttatcttcttttcccaatatttcaagcatttatgttttcccagctttattggagcttaactgacaaatgaaagttatatatatttaagatgtacaatgtaatgttttgatattttgatatatgtataacttgtgaaatgattaccacaatgtaactaatatatctatcatacatagttaccattttagtcaatatggtgaaaatatttaagatctactctcagcagttttcaagtgtataatacaatattgttaatgatagtcaccatgctgtacattagatctctagaagctattcattccagagaacataaacgttttaccctttgaccaacatttccctattgcccccacctctcagctcctggccaccaccattctactttctgcttctatgagtttaactttttttagatttcacatataagcgagagcatgcagtgtttgtcctcctatgtctggcttatttcactcagcatgtctccctgtttcatccatgttgtcacaaatgacaggatttccttttctttttaaggataaataatatcccatttatgtctgtgtgtgtgtttttgtgtatttatatattgcacattttctttatccatttacctgttgatgagcacttagattgattccatatcttggctatggtgaatgtatgaatgtattgtgaataatgctgcaatgaacatgaaagtgcagatagctcttccagatatttatttaattttctgtggatatataaccagaagtgagattgctgaatcatgtggtagctctgtgtttaattttttgaggaacctccatattgttttaaatatggctgtaccagtatactttcaacaagggttcccttttctccacatctcatcaatacttgttgtcttttatcttctcgataatggccattctaacaagtatgaggtggcatcttattgtggttttgatttgcatttccatgatgattagtgatgttgagcattttctcatatatttgttgaccatttatatgttttctattcagaaatgtctatttggatcctttgcccatttttaagattgggttagtttgttttgttgatattgagttgagttttttatatatttcagttgtgcttttgtggtcatatccaaaaaaatcactactcagactaatgtcatagggcttttcctgtatgttttcctggattggttcttcagttttaggccttatgtttaagtctttaattttgagttgactttgtatgtggtgtgggataagggttcagtttcatttttctgcaaatggatatccagttttcttagcaccatttattatagactatcctttacatgttgtatgttcttgccatgtttgtcaaaaatcaattcagcataatatatggacttatttctgggctctctattctgttccataggtctagatatctgtttttaatgccaataccatactgttttgattactacagttttgtaatatattttaaaatcaagtagtgtatttttattttaaatgtatttttaaatcaggatgcctccaggtttcttctttttgctcaagattgctttagctatttggggtcttttgtggtttcatatgaattataggattctttttctattttgtgaaaaataccattggaattctgttagagatggcattgaactgtagactgctttgcatagtatggacattttaacagtattctttcaatttgtgaacaccaaatattttctttttttcattaatgtggtatagttttcaaaatacagatatttcactttcttggttaaatacattcctaagtatttaactttttgacactattgtaaatgggattttcttcttaatttcctttttgtacagttagttgttaatgtatagaaatgcaactaattttatatgttgattttatatcctgtaactttactgaattagtttgttcatttattagttctaaaagtattttagtggagtctttagggtattctatgtatgaaagatcatgccatttgcaaacagaccattttacattctaatgggatcatttttcttcagcctgaagaacatattttaatatttctcacagagcatgtctgttgaagacagattccctcagcttttgtttaagaatgcattttttaccttaatttttgaaggatattattacacatagaattttaggttgaccatttcctattagctctctaagaataccacatcagtgtcttgtcacttccataatttttttggggagaggaacctcagcagtaattcttgttgttctcctgaagataatgtgtctttttctccaccctcactgcttttattgtgtgtttatatttaattttccacaacttgattatggcgtatctagatctggttttctctgtgtttgtcctgcttgagagtcactgagagttttgaatctataggttgctttcttttatacaattttgagaaatttcagccaatattttttcaaatattgcattgccacttttttcctctttcttctccttctgagactcaaattacacatatgctgaaggttttgactgtttctaatagttcttatggttttatattcttgccttctttttttgctttgattccatttggttattttgttttggaaagtctgtaagtactgttgaaatgttcttcaactattttgtcaaccttttcctctaagttttatcataattattttggagtcattgtttggtagcctcagtatctggaatgtttctggctttgctgagattgcctgttttatttattattgggttttggttttttttttactacttcctcacaggcctagtcagtttttattgtgagcaggacattatacgtgatatgttgcaggggttctggattatattatcttcctctcagaagggttgggtttttttctagtaggcacttatgttcctggcagatcactttcattcaatcaaggcttgaatttacaggggacctatttcaaattttccatgaatcctggtggattgccatatttcctagaatatgaatcttactcctgtagcatacttttctcacgtttcaattcagttctcagggttttcataaaagtatctcctttctgactgaatgaggcaacacatcccttcagtatttattatgcagtctctcttcaattcttagcaacttccctcccctccgaaactgttctctgttagttagacctgctgtcttctctgtgcatttgcagcttgggaatgagctaaggacccaaggaaatgcctgtacatttttgaggtgccatttccatgcagctgctttccttatagtatgcagctccaaaaccgccagatgctttggtagccctaaatcgtgagttgtttgtttgccatagcaagggtattgctgtctccttgggcttcacttctttgaattcttgagtgtgtatgggacatactttatatgcttctcttttcagagattacagtcctttgctgtttgttctcaatgcctgaaaatgataaaaactaaaacaaacaaacaataattccttactattatcaatcattaatcattgttcattttttcttaagtgagagcaagtttattaagacagtaaagaaataaaagaatggctactccataagcagagcagtggcatggactgcttgactgagtatacttacagttattttgtgattatttgctaaacaaggagtgaattattcatcagttttctgggtaagaggtgggcaattcctggaactgagggttcctcttctttttagaccatgtggggtaacttcctgatgttaccatggcatttgtaaactgtcatggcactggtaggagtgtcttttagcatgctaatgcactataattagcatatagtgagcagtgaggacgaccagaggtcactttcctcaccatcttggttttggtggtgtttgactgccttctctactgcatcctgttttatcaacaaggtctttgcgacctgtatcttgtgccgacctcctatctcatcccgtgactatgaattccttaaactcctggaaatgcagtctagtaggtctcagccctattttatccagcccctattcaagatggagttgctctggtttgaatgcctatggtttattaccccactcccttttacaaggggacctttaatcctaagggttgtagagggatgtcagtccattttctgtaactccttcaggatgaataggggtgatgatattcctgcctaactattagggtctcttgtattcagggtagagaggagcttagtcagaaagcgtcagtatggtgagacccgttcataactctgataaaaggtgatatccacagtctgccagttggtgctacagtctgtttcctatgggtcaggggttttctccgtatcgtccctgtggggtttgccaggaagatgttaccagaaaggattcctgatctagaccccaagagagggttcttggacctttcacaagaaagaatatggggtgagtccatacagtaaagtgaaagcaagtttattaagaaagtgaaagaatgaagaatggctactccataggcagagtggcccattgttcaaatttatttgtgaaagaaatggattgtttgttctgtagatcatcccacatcttggattttgctgtttatattctacatgccatttgtcatgttgtttgtaaactggtgcttataccaaaaagtttggttaaatccagggggttttatgtggtaaaaaataatcttttcaggagatacatgaaatctgcttttctattatgaagttaacattggtcagagtgttctgatctcctcaggttgaacttcccattaaaagcctcttttgcactttctctaatggttttagcattctttaggttcagtatttagatgagttattcattgagacctacaacatgataatagtttgattttattatttcttctttatttatttattatttgaagttctttaatggaatagaagttactcatatcagctatttggttgctctcatacagagatcatgtaggaaaggtaggataaatgcttgattttctctctttttcttttttttaaaaagtattcaaattaataacttggttccttagcattcttcaaaatggtcacttattccattttattttgttttgttttcgatatctgtacatttatatattatatcacatttgatgtgctttaatcaattctaggcatttaaaaatgaaacacttttccgtgttttgtttgttgtgtttgttaataatttgttttcaaaactctggaaaattttccagttagtttctgaacttgttttaaccaaactccagttacctttgaaagctcctttgctttctggtcagaaaagatgttctaggctcttcctgcacattatttacctcaggactgaaaaccctgatttccctaaagagctctgactttttctgtgggaaatggtatttagatctcacaatctgggtgctacggatggctattggtactgggtgtgtcatcgtctctagacctttcagtggacagaattagaaaaaacttttttgttgttttttaaagaaaaaataccctatatattcatagtgatcttacactatattggaatattgagattatagagttgctttttttttttttttttactttacatttctacctcttctctcatacagtaaaaatcctggttcccaatgacatgaacatattatttatgtacttagtcctactgtacatattttcaaaataacaatactaatattattactaatggtatgataactggaaaccatttaagatttctttgttcttttttgtgtatttaaaatatgttttgcttgagcggtatagtcaaattacagtgtttaaggtcccttggaatatttctactctctatggttgtcagctcaatgcaattatttcaccagtttcacttcagttgtgattttaaatatttctttcatttttctcaaattttgctttataattatgtaaaatatatttatagttccaaagccaaatcaatgggcatggtagattatgagaggtctagcttttttttttcctgtcccttccactctgttctttctcccccattagagaacagtttttattagtttttgatttatccttctatttaaaaattaagcaaatgatctcatataattgtattttcctctttcttagataaaagggagcataatatacacactggtctatagttggctttttttcacatcatatatcctggagattactccataatcagagcatagtatgccgctatgtgatgtctcattttctgttcaatcaatactctattgacggacatttggcttgtttccagtcctttggccattttctttttagtcttttgttttttatttttgagacagggtgcgatcgtgtctcacagcaacctcaacctcccaggctcaagtgatcctccttcctcagtctccccagtagctgggactacagacacgcaccaccatacccagctaatttttatttttttattttttgtagcgatggctgcccaggccgttcttaaactgggctcaaatgatattcctgcctcagcctcccaaagtgctgggactacaagcatgagacatcacacccagtcttgtttccaatcttttggaattccaaatgttactgcaacaaaataccttattcacttgtcgtattgtatttttgccaatgtacctttgcgatatctttccaatggtagtattgtttggtcaaaagaaaatgaaatgcataggtttttgctaggtattgctatattctcttatgtagtgatcgtaccatcttgcattctctagcaatgtgtgagaatgtctatgtccccacagcctctccaataatttgttttcaaaactctgcatttttaacattctgaggggtaagaaatggcatctcaattaaggttttatttgctccttctttgtgatgagtgaggttgaacatcctttcatatgtttaagagacatctgaacttttttcagtgcactctattcatgtctctattctttttagaagttctttatattttaggataataactctttgttgcatattgcattttttcttattttgtcattaatcttttcctttgcttatgctattttatgcatttaaaactggtaacttttaaagtattacattgggaaatgcctctttttctgaagaactgagatgttttctcagtaggaacaatgagactcatggaactaatttgtttcattttttactttggcaggaaaatttttatttgaacaacctgtatagctatgtaaatttcatatcttacacatctaaaatgttacctatctcacttatttctaatgtctgtattactacagtctggatttttattatttagtgtttctgtcatttgatttacagtagcatttctcatagaaatctaagccactacagattctttgttaaataaatgtgggtattaatgaagagcaggttcttccagtcactagtcagcaacgttagggggccgatgtggtataatgaggatggtagtggggtcagcatcagaaagcctggctcagtccctcacttgctccattcttggaacagtggctcgatcactacagacatttgaattttttcatttattaaatgaatgttttaactatatgatagtattaagaaaccttctcaaatgaaaattatgtcacacttaaccattttaatatgcaaagtgatctggtttgctgaaacacacagaggttggcagaagttctggaattctttacaatttcacatacagaaattaatatcatcaaagtgaaaaagatgactctacaatcctggtattcatcgctcagatggttcagccctgtttaaatagtgtcagcatgtgatggctcacaagcacagagcttgacacatgggtgattcatttgtttatcaattgatacttctagacttgtaactttataaaactggaaaatgtaaatcttttttaatttatgagggtgtctaaaactgctcatagttatttaaacaaagtttggcttcttacgccaagggctctgatcattctccataaattatagcatctatacaaatgtaacattatttttccctcttattttagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgaggtaaataattatatttagatagaacatatcacaatatgattaggactcagggcactatggtctagccatgcccatggatgaccccaaaatattagctgtagttaggtgtgtttctcaatagtcagtcaatatctaactcttgcaaagtctctatttttaactgtgcctgtttgttgcttcttcttctgggttccatttgaatctgggaaacagattaccttgccctgctatggtgttacctggaagctcacacccctgccatgagaatgcagaatttatgaaataaacactcagtaatagccatctccttcaatgcagattcaaaccttcagttgtctgtggtaaactggcaaggtctttcacagcttaactgtagcattccacgaagaggccgggtgtggtggctcaagcctgaaatccctgcactttgggaggccaaggtgggcagatcacttgaggttaggagttggagacagcctggccaacatggtgaaaacccatctctattaaaaatacaaaaactagctgggcgaggtggcgggtgcctgtaaccccagctactcgtcagtctgaggcaggagaatcgtttggacccgggaggcggaggttgcagtgagctgagatcgtgccactgcactccagcctgggtgacagagtgaggctctgtctaaaaaaaaaaaaaaaaaaaaaaaaaaagaaaaagaaaaataatagtgattgtgttgaactgggttaggttcctggaataaagtaatcattattactgagaggagaggtatcagccgaagctccttctgcctacccattagtaaaagattaaaatatggaggaggagaaaaggctcttatattcaaatgccgtttgtacgtaggtgcatcaaaaagtgttgctcttcatttgtagactgacaagataatggagaagattgagttcccaggttgtcctgtattttttatcaccataaatctcagccccttgcagcagtgtgaaaaagacaatacgcatttccaagtccattagagagggatagagtcaatgcaattattcataaaggatagaaggatgtggtgtcaaaaaggggctctgcaagtaaaagtcattagtaattcagcaataatggatttgaaacctttgggaatgactggaagatctgtctctctctggaaaatttctgcaaaatggtcatttaaatgttgacagaaaagtgagttatcttgaaattaattttcaataaattccatcaagttaaaattagaggctttaaaaaattcctacacattcatttctggagaccatatggtagaaagtgtcaaccactctgacaatattgaaatgtctctcatttctctttaaactacagtatttcaaagaaccagttaaatattagaataaagttatgctgccatctaactttgatcccagtaagaaaagtaatttgaatagacaaaattgaccatattaaaatattctttagttcattgactcctcggtggtttatatagtatagaatttgcaattacaacaaaattatagagagattgacatgattacatcatagattaaaaaccaacaattagaaaaggatttctaaggtcacgtcattatcattgtagtacttacttactatcaaagttgcatttttaaattcactaacctgtctttctgttgtgtctaatctgatggcacttcctctctacctctgacccttctgaaaacctggaccaagttatgaatcagttggcatcaatggtgttccttcttctgttttctttgcttatattcattttcttctagatcactaagaatttataatgaaaaaaatcaaaagggaaagatctttgattagtaacatcatgacaaaaattcaaactatatgtccagccttggaattgaaatccagtcacaggccaggcgcggtggctcatgcctgtaatcccagcactttgggaggccgagatggtcagatcatgaggtcaagagattgagaccatcctggccaacatggtgaaaccctgtctctactaaaaatacaacaaatagctgggcgtggtggcaggtgcctgtagtcccagctacttgggaggctgaggcaggagaattgcttgaacctgggaggtggaggttgcagtcagctgagatcgcaccactgcactccagcctggtgacagagcaagactccatctcaaaaaaaaaaaaaaaaaaattcagacagagagaaggcattggggtgatgggagaaggagacacactttgctgaacctcagccatgagttacatttggatgtgatggggaaacttccttgagcgatcacttttaaatgatagattttatgaagttaatatccaaagtgacctagtttgttaaaaatctgaccactttgagcttaatgattcatccttttgttttagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttgtaagtaacctaccagttgggggcttaagagggatttgaaggccaatgctatgcttacatctgttttatattttaatgtgattcagaggatgactgactgtcttagaccaagaacatttctttataaatatttctctcatagcttcatattttttctttatcttcccaatgctctattattaatactgcaataccctttgatccctaaattatgggatccacatcatgataaagatgtatgaggcacccaaacttaaataattcagggcaccaggtccctcgtggtgtttgatgtttagttgtgagagaggtttgtgcatgcgagcagtgcagtctctctggattttatcctcgggtcaagtccagctgcacaggggctggggctggcttccagcatcacagtgtcccagactctagagcttcacttccagccaaatactattagctgttaggacctcagttgctttgataccttaaaacaaacaaacaacaaaacacaggaaatactctatgatttggatttttttagggaagtggaggattttgtttatgacatctattattgtgcccttaataaatgttctcagaaaaagtaccttttaagtttcaatatcaggaagagtaacaaagaacatctttacttgtcccctttcttcatttccttttctttccacggaatctggtgccaacctcctgttcccctttcaattgttttccgtgcaaatcaactccccctggctacatcttgctattctgtattcattttttctttaatctgcttcatgtatacagttatgtagtttattttgttacatgtttttaataaccatctcaaatcttattgaaatgaagcagagcattaatgtatttaaaaagcaacttatagaagagaatggcagattggaagctagatcacacatctctgcatctatttctttaagccactacagagatgtcccacaacacatcaaactgaaaatcttaaaattagaggcacaagcctatagagggtgaataaaatggatatgtgcttgtgtgtgtgtgtgtgtgggtaaatttttagaaattggatccaatgcctgcaagccagagcaatgccattgccatgacctgttcgtctcttccctgttcttagcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggtaactttcactactcaatcgcccttagatgacattcatcaacatttttatattctgcagagtggtggtcttcaaaagattgttgggccaccagcagccagaatacctgagagcttgttagaaatacaataataactaagctctaatgactaaggtgcaggcaaataaggctgataggatgtactaataagatacagatttattatctagaataattaatacaggaaagaactcaacccagggaagtgaagggatttgcccagatgacccagctagtcaagtggtaataaagtttaagtgttgaatgacccttgttttggaggttagggtttttccttcctttattctgcttgctctcctccagaaatctttaattttgatttaagtgtgggtaatgattgtaatacagggaatatttgaaacagagacaggctgtttttgtttgctgggcctggtatttcttatgctaaattattggtcaagccacaaattaaagtgttgagcaagataaaacattgtttttttgggcataatcattttacataaactagagaagaatttacaattttgtttgtttgtgcaagttaaatccatttattcatccaggaaaaacctatgtgacctcctgtcctcttctttctacatttagacagaggaaacagaactttagcataagatctagctagacttagttgaagtgcattgaccatagcactacagcagtatgtatgtatgtatgtatgtatgtatgtatttatttattttgagacggagtttcgctcttgttgcccaggctagagtacaatgtcatgatctcagctcaccacaacctctgcctcctgagttcaagcaattcttctgcctcagcctcctgagtagctgggattacaggcatgtgccaccacgcccggctaattttgcatttttagtagagatgagatttctccatgatgggcaggctggtctcaaactcccaacctcaggtgatcctccggcctcagcctcccaaagtgctgggattacaggcatgagctactgcaaccggcctgcattttttttaatccagaaatttttatttaagatcatttcagaatgggtatatttattcaatttaggttttctaaagtctcttataaagtatattaaagttttacactacggaagaatttcaaatatttttatgtaaatcaaaattaaattattaacccttttttttttaacttttgagaacagcaaaaatagctttcaattagagagtgcttcctgtactccaggcactattataagactttaaaatagtataacaaattaaatagataatgatcattgtcagcttactgcctgccatgtgtggtaagtgcttttcgtgagttatttcattgaatcctctcaacaaccattattatttctgttttaatcttaggaaactgtagcccagagaagttacttgtccatggttacatgtctagcaagtaatggagctgggattcaaatttaggagatctagttatacttatcttcagtaagaacagaaatgcaattgtgtgacgttgactacaagaggtgtctcatcttccatagggaggaaggtcttgtgaattacccaattccatacctggctctccgatcacgagactaaaacatgaagccgagcatcatgattttctcagatacgcaagaatgtaactataattttcagggaaatttggggccctttctgttaaagccttcatggtgattctctggttctaaagaactatcagtacctctgaatggttcatcctctcaggctttgcagaacactagaactgaatttcagtgagcggttccatgaactcctctgaattcttctgaaaagttcgcacaaaaaatcataaaactggctttggaagttttaatttcataaaccagaatggtggaatgttttgtagccagaaggggattaaagttagttcacctaacttcttattttagttcatttgtcagatgaccgtataaccttggacaattctttatctggatctttcagttcctacttcagtaagatgtcctatctatttctctaaactttgggggtagaatcaaggaaataaatgataaaaagaagcttgaagtgttaaaaaaaataatgcaaatgcaaggtttttctggaacaaagttttaactctagccttgaatttatcagttcagagacagccgatgtggctgtcacagttggccagcgaggtatctacattctgatgtaaccacatatcctcaaagtcttgaccaaatttccctcaaggattgttgatggaaaaaaaaaactgtattattcagaaggagaggtcatgtacggtgatttaaatattaatagatagatttttatattatatctttgaccaaccaacctaaaggaatacaaccaacctgtagaattttggcatcagcaaggaccttaattttacaaatgagaaaattgaggctcacaaaggtcaaactctagttattgtcaaagtaaaacttagatgtacctctatgagattctagatggacgtacattgactttggttaaagctcttgtctttaaatcatctctatccattgggaaaatttgtgaactgaacccgttttctaaaaagtatattcacttctcttgttgttcttcagatagtggtcatacaagaaagtgatacaggaaccaaattctaatgacattattatgactcaatatattgttccctaaaatgatgtcttcattttttaaagctatctctaaaaaatgaaatatttatgaaaaagaattaaaaaaagaatgttggtatttcgaatactttggtggtttagaggggggttgactttgtcctttactgactccattgatgagtaaaagcagtccacccaaaattttagaaagagtggagaagagaaaagaaattctacagagatgtgggagaatgatcctaaggacatttactttgcatgtgaataggtgtacttttaagaatcctagatcttctctttgtgtggttttaggtgccttggttgccaggcaaacatatccttcaaatgaagattaaggtaccattgctgagtgtgtatctttcacagatactgtggttttgaaagacttacttttgctcagtaagagagttccataagcactcattaaagaatagattttaactgcaaaagataagaatgatattgacccagtgtagcatatctttctttttttttaacacaaggaacacacattaacatgttaattcttagatttatatatctctcttaagtgaagtttctacttttaaagatatacattacccatggaagatgtgacatggctacaaatgaatgaatacaagaacagatcaattgttagttcatctgtttttgtcgaagagagcttttaaattgtatagaatagttcaatgaaggtgatggaagcatctttccagaataaaaagcagcacctctcattaatatttcataagtgatttaagccatcagaactctgagtgaaggacacataggtagtaatgaaagtttaattttaaatcccagagaagggaagttgtaggctgaataataaattcagaaggctatacgatgttaaggtgaaggcttgaggtaggatacgaagggaaatgagtagaattgttcacccatcaaatctccttgaccaatcccaaagtatctgcctcctctccccagagacactgaggaaccagaaagggggctctacaagagacgcagggagagcgatgtgccttctggagaaagagaagggctttcgagaagttgttgtttcttagatgtggaaagcaaatacaaacagaaaagttgaaaaatataatcaataagacaggaaggagtaatttacattgaattttatttctgaaatctagggaatatacctgttctacaagtggcgttgaaccctaattcatcatattttagacctctatggcaatcccagtaaattaacaaagcagaaattgtacatctcttcacaatataacataacccaagattatttataaacattttaaaatgcccaagtgtgtggaagtatgtgaactctccaaaataatcattggcttgagaaagaaataaaaaatgaaagactacatagaaaatgacaaacaggaaatgctgtgtatcaaaacctgtgagatgtgatgaaactcaactccctggtaaaatctttaagatttaaaagaagagaaccaaaataattgggaaagcaggagagcagaagctgaggcaggaaggtctgtcctccgtctgaaccttttctttcaccaccttcccctgcatccttccctctacttctccctccccgctacactcctgcttcagcctaagcagccctcccgcatctcctgcatgtctttagatgaatgcaaattcacaaaggacctccttttgtgacttcttaggcattgagatgattccactatgagcttgggattgggtgggggagagccaggacttgtggaatgcatgaggcacttgcttccctcaagtggacctgctgctcagagtctcatggctgcaattcacagactacacacctaaatgtcagaaaaagaataaggcctggagcaagcaaacacaccacataggctgaatagtattgtgtttttcagttaagtacatattgaaattaattgtaggtcagaaaaatatctttctagagagggtaggataaagggaaaagggggagatcctcaagagtttgtactcttggccaggcatggtggctcatgcctgtaactccagcactttgggaggctgaggtgggtggatcacctgaggtcaggagtttgagaccagcctggccaacgtggtgtgaaaccccatctctactaaaaatacaaaaaagtagccaagtgtgatggtgggcacctgtaatcccagctacttgggaggctgaggcaggagaatcacttgaatccaagaggtggaggttgcagtgagctgaaatcacgccactatactccagcttgggtgacagagtgagactccatctaaaaaaaaaaaaaaaaaaaagagtttgcattcttgagcatattggatttagggttttgacagagactaggaacatttggttagactctgagctctgttgttgtgagcacagtttttccacaactgctggaccatcgtgatgctttttagtgaaggaagaagataggccattcctctagtgaaataattctgtaggttggagtagtgggaggcaggaaacagactgagagatgatagaacacctaatttggagttgtgagaacttgtagagaatacatttttgctgtgtttgaaggagttgcatgctcatgtagaagctgcaaacccattgaacatgcgtgatgtagagcagtaagcaggaataagaggatatggatggaccattatcaagaacattacaaattcctaggtcaaatagagggtatggctggtacttttctgatataaaatggaaacaatattgcatggaaacatgataaaacccttcagctctctgtgttactaaaggcaagatacctgtaagccacagcttcctcatgtgtaatagggatagtactagtagtactagtagaaagagaccattcattcatttatctattcattctctaaatatttatcaaaccacttaggtttcagtcaccatgctagggaatgggtatgtaatatagatattaaataagtaagcacacactacataatttcaagaggagataagtatgggcaggaaagaaacagtactgtaagagaaaagaacagagctactgacttcagtggagcagtctgagtttgcttctcaagggtctttgtatggctagctcattctcatctgtagaccctgtatgtaggatctgcagatgaggagtgagcaatgcaaagaactgagagaaggaggactccaggtagtggtgctaacccagccctagagactgaagtcagaaaaaataaactaaaataattggaaatagaccagggtggctggaatcacacagggatggaaaagagaaatatgagttaggcaggagctagaccctgaagggtcttgtagaccgagataaagagcctgggttatattctatatgcaaggacaaacaattagaatgttccttgtcacattgtgcctgtcacacaatgaatgctcactaaagttaacatcatgatgataatgacgatgatgatgatgatgatggggaggagaagagagggcaggagaaggtgacctactggagtttgcaatcatgagggaaggcacttctaggtaaaacttattcatgtgttcttgattttagaatatcagatcttaaaagatcagattatatttattaatagagatgttagaagggacactttcacaaggcatgaaaaggtttaaaataccaactctaaaaatcatgaaacatactaataaagaacaaaggataataaccaaagtaaatgattttgagatcctaaatggcttctctcatctcttatcctcctcaccccttattctctcactgggggcagggcctcattcctctcctgctcacccagattagcccaaggctcctccctaaggtccagtctttacttagctaagatgtatgtcagcctgaagctcacttcacagaaagccacatgttaaacactaccatacggtgtggttctcttttcagctctcagatggactaagcgtaagtgccagcatatttgaattgctttgaattaaaatttaatgcttattattttagaaattatagtataaaaccaaatctggattcatagcagaggaagacaaatgagcgtgcgtattaagacatggctttgggacttgactcattccagatgttaaagctcacgactcactaggctcaaaagcccacatttaaaatttcatgtaaatggtgtttctcagcaaagtaaattttagttctctctatagaaaatcattcctttacaaaaactcgtttttttttatgagtagtttctcttctggaactagtttaatctgatgaatgtaaaaattggaagccatttggaatacaccatatgctgaacatcctgggacctgaaaccttcagtgtttcctggacgaataaggcaatccacaagaaatctgaacctggtccgtgaaacactagaattttgaattggttcttgttgtttccttgcaaatgcgattcactaaaaagaatgaattcactgtgactcctctgcaagtgatcacggcatggcttcacctgacttagaaaaattcagtttttctgcacaaaccagactcagatattggtcatctttctctaggttatgctgcaataacaaacaattagtagcaacaaccagaaaaatcaaaaacaataacaaaccaaaagcgtctgtggctttcaataacgtgtttattctttgctcacaatagcaggttagttttggatccattgcagttctgtttcctatgtcagtttcctgtgccttcaccgtcctgagacccaggctctagagcttgctgggggaaaagtaaaagatggttgaattatgcagtgacttccaaagcttctatgtggaaattggtgtatcacttttgctcacactctgttgggcaaagcaagtcctatggctaagcccatagtcaatgggaagattatgtattaattctccgtatggcagtattgcaagtcacatggcaaaaagcatagatagtcaatccttttacaggaagggaagtgaataactatgtaaaataatgccatccatcccagttcatgagcataaaggaaagaggtttttttttttttttttttggtgggggtgcaaatttatcaagtcctagattattgaacgcaatacatgcttcagaggtagctagggtcactttagaacatttgatgaattttattctagtgtctctttcaaaggagttgtagttaaagtattgccatgtctagaatccagggagaatacaggctttcagaattaataaggtttcatttccacagagagagagagaaacagagccaaaatcaattgcaccttctaggttcagggcccttgagccctatgagttcctcttaaaacatttggactacagctgcctttctccttgttaaaatccttgaatttcattagttggggcccaggggaatggcccactttagcttgcagtgatgctatttggctgttttttttccttcttgtcatcttctaatgggcgaaatagaaaagagagactacaatcttcgaagaagcaaatagaaccctggaggattagagagcaggaagataactttgtgtttcatgctttctagttttcaagaactgcagtatgtctgtatctctaacaaaaactgaaccatcatactgtaccttaaaattaatgaatcaacaagaatttgtcaaatacctatttgcaaagttttttttattagatgctgaagggcaaacagaaatttttcccttccctcagagacttactgtttggttagagataaatttagcatagctttactacaatatgtgaaatttgtgttacagatgttgtaagagctcagagaaaggaactagtatgagcctgagtcagtggagaggcatgtgatttttcatgtctgtgtcagactctatcatatggctgaatcattatttatttaatcacctcactattattaggcctttagaatggtttcaattattgttattatagagcagactttgatgtggatctgtatatgtcttttcctgcatcttgaatatccttgtgatacagtgttagaagtgaaatacccttaatacatattgtcagtttattttccagaactttatacttccaccagttatggatgagagtaactgtcgccacatccctaccaactttgaatatcatccttttaaaatctttcctttactggctaggcacggtggttcacatctgtaatcccagcactttaggaggccaaggcaggcagatcacctcaggtcaagagttcaagaccagcctggccaacatagtgaaaccccatctctactaaaaatacaaaaattagctgggcgtggtggcgtgcccttgcagtctcagctatttgggaggctgaggcaggagaattgcttgaatctgggaggcggaggttgcagtgatccgagatcgtgccactgcactccagcctaggtgacagagtgagacttcatctcaaaaaaaaaaaaaaaaaaaaaaaaaaaagaaaacaaagaaaaatcttctctttactacctgtttgccttggcctagataactcctactcagctttcaagtctccgcttaaatgttatttccactgagttttccataatcccctgggtgagttcagagtctttggttaacccagtggttctctacaatttaagactttttaatatcactccttgattattcagaaatgaaatacactgatttaaccccactagacacattatatttaaaaatatgtaaagttgtaagaataacattaagaaaaaatagagtaacagaataaaatcacatttatttcagtatctgaaaacctaggcaagctgtacttgaagacaaaataaagcagttgattgtctggaccccaaattgctatgaatatgacagtacaaatgcaggctgacacagttatgtgggttggtgactaatttttcagaaatagtgactaactcttgacagatttccaggagaaagaatcttcaatttacactctacttgtaatcctggaaaattcagtatgcattaaaattgcacaaaactactttgcgcttaatatgtaaaatagagcgagattttatacccaataacagaactttcacttatgtgaatgtcacacaggttcaggagaattcttgttgtgtgtgacgctcacatttcaggctgcctcgtgtctttggtcccttgctacttactaaatgccagtaatgccccatgattgctgtgataataattaacacaaaaccaaaaaggtactctcacacatttcccaaatgctagattgtggtccctgctgagaaccattggttaggtaacaatgaagtatcctgcgcttccccaaaaaccgcagtcatcatacttttcaaaaatgttcctgcctattgtaagttccttgtgagcagtgactgtttcatggtattgtcacctgcacagttcctggcatttattcatgccttgataatgttaatgaagtgaatgaattaatatttggatgtctgtatccttcagaataattgtactgaacagcggcggtatatatatccatcgaataattcctgctcatagtagcaagcctccagtgtttcacctccaaaaatgtccagaataacaacagctatccttagtcaacattttccattaccaaacatttggctaaggaattcacactattgtttcatctgtttgcttcaacaatcccatgagcttagatagagtaacttgctcaaggctattaagtgaggtggtttgtaagtgacagaggtaggttttgaacccaagtccatagactgtattcatggccactatactataagagctggctatttggccgggcgcagtggctcacgcgtgtaatcccagcactttgggagtccgaggtgggtggatcacctgagattgggagtttgagaccagcctgaccaacataaagaaaccccgtctctactaaaaatacaaaactagctgggcgtggtggcacatgcctgtaatcccagctacttgggaggctgaggcaggagaatcacttgaacccaggaggcagaggttgcggtgaactgagatcacgccattgcactccagcctgggtgacaagagcgaaactccatctcaaaaaaaaaaaaaaaaaaagagctggttattgatttaaaatcagtagtctattatatgaaggaaattccttttttttctaataaaacaggaatgctaacaatgttttttgaatttatggagttatcatatggcttatcttatctgatgtactgaggaagttaatttatagtttataatttctaacctttcttgcactattattattcccatatttgatctggtatataagctggcaatggactgtgaatttatttttctagaactgtgtttaggatttgtgtatctatattaataggtgacatcagtctatagtttttatttctataatctatgttgggatttggtaacagcgttctaacaaaaattatttggaaattattctatgtttgaggatggcttagaataaattatacatgggaattatctcttccttaaaagttttaaagaatgtactaagtagagcatcttatgggagatttttctttttgggggttgagggtgggatgggaataattatttgataatgttttcaattttatttatgacttatgtctgttcaaatcttatttttcttctccttcagataattttaatgttatactttttctgaaaataacccattaaaaacattcatagagttgtacatagatttcacgtttaaaaaaatcttagtatctgtgtctttgtcattttcaattttgtatatttgtgcttatatatttattttctttttagacttgccagagatttgtcttttatatccccacccataaccttcctcaaaaaaacagttcttgaatgtatttatgaataccacatgattttgtatttcatttattaagttttgctcttctttttactgtattcttcctcattttaaggatttttttctaacttaaaaaaattgtacatagagctgggtctcactgtgttgcctaggctgtctccaattcctctcaccttggcctcccaaggtgctcagataataggtgtgtgccactgtccctggccttctttctaagtttttaagttgactccttacattcttttactttctctctctttcatcaacttttcttttttttccttttttctttcaatggcaaaagtagtttagtccataactttctttgattgcagatttggctaacacgtgtattttttcataggtaatattctcattttttattgttttccaagtagtctaaattgtgaatttatttcctctttgacattgtgaaaattattaggagaacattctttaaattcttgtgcttttggactttattggcttaggattttatcagcatttcatgttattgcattgtgcttaaaaatgacctactgctttagaaaataatagaaatatgtaactcaaattggattatcattcattttgaatctgccattttttcatctccaagtaacgccaccattgccgacgtaagtttctttatttgaattacatctctattttatttttctctttaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcggtaaggaaacatataatttttaaatgtctaatttgcctgattgtaatattttaattcttcaaaataatttagtcattttatgtcctcaagtgttaagtggaaaatattctcatagaaatgttatattcggttatctcctcaggcagtattagattttgcaataaaattgagataaaattattaatatctggacaagcactactataatttttatgcttacagcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgaggtaagagggaaaaaatctttgaatttgtatttggttgtatattataaaaaatattatgggttgttgtcttcaaatctgttataggaaatgaaagtagtttatgtagaccaatatgtcttatggatacatatgtaaaaatcctcagcaaaatactggttcagtgaatctagcacaaaaagaggatttatataccatgattaagtgagatttgtcccgagaattctaggttgatataaaaccccagaatcagttaatgtgatacatggtaccaataaaataaagaacaaaaactccatgatcacctcaatagatgtgagatctggattttgctggatttgacaaaattcaacatcctttcatgatgaaacactcaacaaactaggagtagaaggaaccttccttaatctcataatggacattcatttaaaaactcacatctaacatcatatttaattatgaaacactaaatgctttgcccctatggtcacaaaaagacaagaacgtctgttctcactacttctattcagcattacactggaaattctagctagagcaattaagtaaggagaagagataaaatgcatccagaatgaaagggaacgagtaaaattctctctattcacagataacatgaccttgtatataggaaatcataaggaatccacacacataaaaaactattagaactaatccattcagcaagttgtgggttatgagatcaaaatatagaaatctttctttttctatacaccagcaatgaacaatttgaaaatgaaatcaaggaaacaattccatttacaatagcattaaaaaataataaacatgaaggaatacagttttaaaaataagtgtaaaacttgtcctctgagactataaaacgtccttgaaagaaatttaaaaagacctaaataaatggaaagacatttaatgttcatggattagaagacaatattgttaagatggcaatactccctaaagtgagctaaagattcaattcaatccccataaaaatcacagcgggctcttttaaaaaaatacataagctgatcgtaaaattcatatgaatatgcaagggaaccagaataaccaaaatgttcttgaaaaattacaaagttgaaggactcacacttcctgatttcaaaacttagaacaaagctacaataatcaagacagtatcttattgaagtaaggatataaatatagatctatggaacacaattgcaagtccagaagtgaacacatacttttatggccaattgatatatgaaaatgatgccaaaacatatcaatggagaaaaatcattttttcaacaaatggtgctcaatagccacatgcaaaattatggtgctggaccccttccttatagcatacacaaaaattaactaaaaatggattatagacctaaatgtcagagctaaaaccatgaaactcttaggagaaacctaggagtagtctctatgcccttcagtttaggcaaagccttcttaaatatgacacaaaaagtacaaacaaaaaaagaaaaaagaaaaataacttcctcaaaattaaaaacgaataacttgatttttaaaatgggcaaaggaggctgagcacagtggctcacacctcatcccagcactttaagaggtcaaggtggatgaattacttgagctcaggagttcgagaccagcctgggcaacatagtgagaccccatctctacaaaaaattttaaaaatagctgagtgtggtaatacacgcctgtagcctcagctactcagaaggctgtggtaggaggatcacttgagcctgggaggtagaggctgcagtgagctatgattgtgccattgcaccctagcctgggtaacagagtgagaccctgtatcaaaaaaaagaaatgccaaaaacaaaaggacacacccataggatagctataataaaaagagtcagataatggtgtggacaaggatgtggagaaattggaacctttatacactcctggtggagatgtaaactggtacagccaccttgaaaaacagttggcagttcctcaaaaagttaaacatagagatactatctgatcccagcaattctacttttagatatattctcaaggggaatgaaaatatatgtccacacaaaaatttgtatgtgaatatatctacagtcatcatctataataacatatacaaatagcaaaatgcaatcattatttttaattttaaaagtagaaacaacttaagtgtccatcaactggtaaacggataaataaaatgtggtatatctttacagtggaatattacaaggcattaaaaaagaatgaaataatgatccatgctacaacgtggatgaactttgaaaatgttatacagtgtgaaagaagctaatcacaaaagaccccatattgtataatcccattttgtttgaaatgtccaaaatgggcaatctacagagacagaaagtagattagtggctgcctggggctgtggtttcaggggaatgaggagtgactgctaaaggatatgagtgttttttggggggtgactaaaatgtgctaaaattgattgtattctcaaattgatttgtactccattaaaaacatttcagaaataattattcttgaagcagttttcaaaattgatatacaacatatttgaacatatcttctctaattttagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttgggtaagagattgttcccttttttttttcctcctcttgggcttgtatcagaataagtgaatgatagaaataaattatatgaaaatcatctgtactgtgaaaaattttaaagtacactcaaagacaaagaatatatattttctaatcaacatttatatcaaaagttaattgttacttattaataagagaaaaatcaggttatcttaagtggcaactaagaaacatttttccttttaatctttgaagaggttattatcagagccttttaatttgaaatccaggtagcttggttacttgctgcagtaattataatttttatttcaacagcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaaggtaaggttatgtttgtttgtttgtttaacaataaaacttcactgatttcctgcttcagtgaaggatcttaaaattgaccacgttgtgttatgaaaaccaggtgagatcctcatgcttcttaatgaccatttctacataactactctgtagttgtggccttgtaggcattaagttttgacatctgtatatattcatgaagtcaaaaccaaaattaaaataatgcatatatccactacccacaaaactttcttcctttccgttataattccttgcttttgttcctcacccccacccacaggaaaccacaaatctactttctatctctgtagatttgtttgcatatcatctaaatggaatcatactatacgtactgaatgtttttctgactttcctcaattagcataatttttgttgagcttcttggatccgaagatttgtagttttatcaaattgaaacattcttggccactggttcttaaaatatttttctgtctttcctccccattagggactctgatttcatgtatattaggcacttgaaattgttctacaactctcttgatagtctgtttgatttcaagcctctgttctctgtgtgttttactttggaaagttcctattactatatattcaagttcactcatcttttcttatgcaatgtctaatctgctattaactttaccaagtgtatttttcatcttagatattgtagttttcattttagaagttcaatttgagtcattttatatgtagtccatgtctctactttacacatgaattttttttctctagcttaaaaaatctgtgagatatagttgtagctattttaatgactttatctactaattcagacatttggattgtttcctgctatggttttatagattgatttttcctctctttctgagttatactttcccacgtcttttcatgtctgggtaatattcagtgggataccagacattttcaattttatgtttttggctgctggacattgtcatattcctgtaagtattcatgagcgttgttctggaaagcagttaagctacttggaaacaggttgatccatttcagttttgcctttaaactcatttgtttcctgtctctgaaggtttgttgtcctacattgcttgatatccagtgttttgagagccattgttttatacgtttttgtccaggatttttgttgtttcaggtgcaaagttaaatctagcctgttattacatttctgttggaaatggaaatcttttgatattttaaaatgtctttatcttgcattttattttctttatttctcattcatgttttaaatatccttcttatcctaatctttcatctttttaactttcttctttttcttttttgggaaggtacttaacacatcaccactgcaaaatacagaacgtttgctgaatggcataaactataatgatcttccccaaatttcatatacatgggcatatacgaaggcatttaaaatatcaattagttcacctacctttattttgatgaagatattaaattttttttcacactgcaatggtattatacaccaaattttctttctttttctcctttagcaattgacgtatccatttcccgtactcaacatttcctctctttttggtttctatatttgttttctttatcatttcttttggttaattttaccaagtgtgctttgatttgagattcctattttattgtcacttcttcctacaggtatttctccagataaaagctcatggcattctgtcttttatcacaactctctttttaacattaatagaatagtttttctgagctaaactgcttttgttcagcagaaacatggcatggctgaatcatcactcttatctctttataagtgagctgtttaaggacaatagattccctctataggggttacgattgtaggcactgttctaagtgctttatatacagggtattaactcatcacattctcaaaacaactctatgaagtaggtactgtcatcattcccattttagggatgaggaaggcaaggcacagggattgagtgatctatgagtttagattagagagatgactctatgattttatgatatattgtttccctttgttgtataagtttattacatttctattaaaaagtgtattaatatgctatatggcaatctagtgtagcttttattaaacttctcatacatgacaactcacatagccagtcacatacctaaaaccatttcagggatataatcatgaacgggacaatctttcgtaagtttgcaaatcttttttgcctgaaatatatttgtgttttaaggttgatgagaggtagagaacaaaacctattattatatttacatgtccaaatttttgttacatcattttcagtataccaaactaaaatacacacatctgtcctttcttggtttggaatagatactgtggaaagtcgatcccgccatctctcacaagcagtggtaactcattgatgctggtgtttgtgactgactccgacctcgcttatgaaggcttcttaataaactatgaagcaatcagtgcagcaacaggtaacaaaacagcattgcatactcggttttattgactccattgcaaaacagtgctaatagctaaaacacaatgagaatacatcatccgcaaacctgtggcacacaatgagagctatatttagaataaagggtagtgacttaaataccttccttattaaaagtagtgactagataagaatattgtgtcaatattaaatcttctaatgttggtaattgtactgtggttttgttaaaagaacgttttttcttcccttaggaacaatacactgaagttttcagacggtaaagaaatataatgtctccaaagtactctgaattggctgagataataagtgtgaatatttgtgtgtctgtgcatgtgtgtgtgggggggggggagagagagagagaaatgataaagtaatgggagcagaatacaaatacataataaatctgggtaaaaagaattcaggagctcattcttgcatcttttaaaattctatcagaatgaaaagttaccaaagagactgaatacttatgttaagaaattagaaacagaataacaatgtataaaaattagagactaccgcatgaaattccagggaaaggaatggaagatttcttggcaaaatatgcatttctcaatttgacctaatgaagttaaacttttcagcatttattcctttcattgtatttttcctattacttaatttctcattattactatgccctttgcaaatgaagtataggaaacaaatcccttttgcaggcacagtctttgaggtaagatgtgaaccagagatgctcccagccccaagagcctgtgcatgggattgatgaaggagtcatatttcgttaggctcatgtttccctaggatgtgttgttttttagagactctgagctttccttttgcatcattgtattaaaggacccaaataacatccagcatagacccatagtaggcatatggtgaccatgcttccaagcatttctccgctttgggattaccccagcagcatggtacaattcactgagctccctccagaaagaactggtagcttttcctatgttgggacatgcaccctgtgacacactctggcatcctgagaaccccagatgcttatcttttaaagtccccactccctaaaataaataaaagtttaaacatctcccactcaaaatcttacccaatttcccatttatttctccttcagaggggctggccactactcttcatttcaggcaaaactctgcagcagttcaagttctatgttcaaaagcatggctttagatttgctccagaatcctgagtgtgagagaatcaatcaatacttttctcccaggtaggaacctctgcaggagcagttcattatccagctcaagtgcaagcacatgcgaaatggaatccctggcagttacaataggctatggtgtgtgattgacgtattcactggacttcattcaggtggttaacatccagtgaccaaaattggtttcttaagaaattatagggtgcacacaatttttcatgctgttgtagttttatctgtctggtatgtttggccccaaagcacactgaatattagatcaggatttggagcaagtcacttgaactctctaggccacagttttctcatctgtaaaattaaggaattggatttggtaatcttcgagagatgacttctggctttaatcatctatgaacataattttaatttggtgcatgaataaactggctgtatcttagataacatataatacaggcagggcctcctgaaaatgtggaaatctttgtaatgatatgcaaagtaagacatacctttgtaaaacaattctattaccatcctagcttgtaaggcaatattttgtgcagaaagaacccagagcagttaaaataattgggcagggaggatattagattttaattctaaaagttttcagaaagataagatacacgtaaaataaaaatgagtcaggaaaagagatagaagcaaactggacaggaaaggaaactataaagaaagagagaagaaaaagcaagcaataaaagtgaaggggagacgatgttttcatagaaactcaaaagattctccagctggcttccctgtgtgataatcattactttggcctctatttggtctgcataaggctgaaatcacagacgagggagtgtttgctttctgtccctgggctgagcccggctggtcactgtgcccgcttgttgttggatgaactcataggtctgactaacacagtcaagccattctaaatagcaatcagatgacgagatccaggaagacacaacacaccttctgtttataattctggagcctgtcacagtttcccatagatcaagacctgagagatcggctctcatgcattgctgagggggggtcctgcagcattttttagggaagggctggtgtcaggagactgagctggtgttgggctggtgacaccaggtggtgggctagtactttaaggcagtggctagacctagaaggcagccagagtcagagtgagctgctggtgtggaaacacagagatgctaggactcattcttttcaggtgtcatcgtatgttggatattttctgcagaataaaatagcatcagggaaaagcatcaagggaagctcagtcatttgccctcatcttactttattgttctaacagaagttatttccagagcagtaatgttggtatttggttgttgatttctagctcctcagcccaacaggtgtgagtttgcctgctgaagtctttcttgtcttcatctgataaaggttaagtttccggatttgagttcagatacttttccatctgtagtttgtgccatgtggctatgatgtcagccccaaaatatgtgtttgggagaaaaaagattggtttcttgtgattactgggacttcctcccttgttactttgtttctgcctttatccagatgtgcctgggaaaacagaaagaaaagaactaacaagtacaggtttaacaggttaaaactcttacgaagttcttagaaactacaagactaagctttaatttaacgtattagattttgctcattcaaactacaaaatatttgaatcctgagagactataattgactaatgttatcaatttaaagtaaaattttatattctattaacatgtattgcatatacattaatatataatcctgctaagagggaactttaaaagtataaacagggacagataaatgtaccggattcattttcaactttaatattagaggaaaacctatgtaacatctagtccagtgcttttcaaactgcaattcatgactcattcgtgagtcatgaaattaatttattcggttgctacttgtgattgttaaaagtatggagtaggatagaaaggaataggagagaaagtatcagagtttatcatacaaagtaaggtgccgcttcatgagaactgtttgtagtatctccgcgcatgggtggctaacgtaaatgtattttttagggtatgtcaagaaagtttgaagcacaaatctattccagttaccttaatttttaaatgagggagatagaagtctaggatgttgaatttatcctcccaagaatacatagctgattggtttgaaagtcagactaaacaactgagtcccgtcttagaatccattgcttttgccatgtctaggttagctcttagaaacgctctaaatgaactgcatataacagctagtaacatttaattcagggctatcatcaaactgtggtggatttttcatatttcctgcaaagcgaaaaccttcacaattgtccagggaaatggccaaggatgatcccaacaacaacaacacaggattagagatgagccctactgggctttcttggcctccctccttcccagggcagggttcccacctactcatcagtgggtggttagtgctgttttttatcagtgatcctggaatgagctcagaagaggcatctagcagtgcaaagttaagaaatgatgacaaacatgcccaaagaggccttctttacactaaacgggtaaagagagttctgtttctattttaaaacttcagtttgggagtgtagtgttctcaaattctagtgttcataaggaatttgagatgggggattttcttgctataaattcaggcatctgggccccacccagaaattctgattaaaataggtctagggtgcttgttcgccaagcaattcaaggggttctaatgaaactttgtagtttatcaaggactctgaaagtcaagccttagcatgtgaattgctgtagaattacaagggagatacaatagtggattggactgtaactgctcatgatggaaagtactattcatgacacagggaaaggggatgctgtagggaggtcagaagtcttggtcctactctcagccttgatactaattaggaatacttttgtttgtttgtttttgggttttttttgttgttgtttttgttgtttgttggtttgttttttgagatggagtttcactcttgttgcccaggctggagtgcaatggcaatatctcagctcactgcaacctctgcctcctaggttcaagtgattctcctgcctcagcctcccaagtagctgggattacaggcatggtcaccatgcctggctaattttgtatttttagtagagacagggtttcaccgtgttggtcaggctggtcctgaactcctgacctcaggtgatccccccgcctcagcctcccaaagtgctgttattacaggcatgagccaccgcacccagccataatttggaatactttggacaactcacaagcctctctgattatttctatcgaccttgaattctgtattctttgctatgagagattcagatattttccctctggaaaaggtgttgtagtaagtcgattcgtcttttaaagatttactttcttactggctagtgttttctcataattttgtatgtacaggtgtcccagcacttctctgctcagttcgtttatcttgtttgttatatttcttactccttagaataaaaatgcaacaaaatgcttaatcatgatattctgagttccctacttgtcttcatccttaaattgacatttcctgtgtagaaaaaccagggattgtggccaggcagggtggcttatgcctgtaatcccagcactttgggaggctgaggcagtcggatcacctgagatcgggagttcgagaccagcctgaccaacatggagaaacccagtttctactaaaaatacaaaattagccaggcgtggtggctcatgcctgtaatcccagccacttgggaggctgaggcaggagaattgcttgaacctgggaggcggaggttgcggtgagagaaaatcgcaccactgcactccagcctgggcaacaagagcgaaactccatgaaaaaaaaaagaaaaagaaaagaaaaaccagggattgttaaagagaataggatttggaaagagggaacttgggttcatattttatcttggccatgtctgaagttaagtgtcttttagaatttaatctccaggaacctgagatctctcatctacacctctctaaaaagtgtggtgataatgcctggctgttttgcaaagttgaggaagacaaaatgagacattcaatgtgaaaattacattagagttgtaaaggaccatgactttgccagatataaaatatgattctcaatatccaaggacaattttacaatagctactttgcttatttctatatgaatctgcactggtcatctgagagggaaaagaaaaagcaatgaccatgaccgcctagcagaaaattgtagcaaaatgttgagtttgattgagaaggcttcttctttcttaagggagaaactgaacctgtaattatatcttcccttgggtcttcactttgaaggatgctaaaccaaatatgtctgtggaagcagatgatggctcctgggttagctgtttatttagcacattcctagaatatcagaggtcatatggattcattcagaaaccaaacatttcataagtgatttcagaaagcatagcctaaagattgagcctcaatgtaattggatagtcacataaatcatcccataatgcaaagcaggaaggagctggagcagttccccataatctagagtctccctatgagatgcattcctctctccagaggatcagcttatcctatttctgtggctcaaattttatgggactgatatcattgttgctttgtggtttggaaggttatagatgtttctcattttcccctttgataatgagccaagtcctgtgttacaaaaacttatttgaaaatgtttagtgaaggcaaagatacattgtgagttttagaaaagtctagttttgtgatttttgtaatggtccacagaaggcatttgtatgttttttcatttctttctttacattttttttttttgaggttggtcagagagaaaaatatgtgagttttgccaacagttgtctttgatcctcagagatgtgcttttccattgctagttcagttgaatttaggggataggaaaaatgtactttcatttttcatttctttgtaaatgttcttagaccataataaaaggctaaactgatattggatatgaattttcctttggcaatacaagataaaataaaaggcatagatacatttttatctttgcattttgtattgatgtaataataagcatcatgccaacacataaatatccttgtatggaaacacattctaatttaatcatttgtgctttgttgaaaatcacaagaggaaaccaaaacttagtattgatatttttcagtattactattattctagaaggagccatttatattgtcaagggaagaaatgtaaacatctatagagttcagtgatagttaagaggggtttttaatctttcaagaaatagatgcattaagttcagagaatagtaatttttctctctatgaaatttgaatctcataaaactaccatcaggttttaagattaaatatcctattgtttaatacgtgtagcaggggtcccttcaaatatgatgttttatttctctatttcaattttatgtattctttattagatatctgaattatttattggactttctctagagagtgcaacctgtctgtgcacagaactttcaagcttttaacataatatggatttttccctgtaatttcagtaaatttatccataattttcagaattgtgtacacccatttaactacctctccattcaagctatcgaatacttctgtccctccagaagggatcctcgtgttccttttattagtttcctcaacaacctctatgtcagcaaacacacacctggtttctaccaatatagaatagttttaactgtgcaaaaggcagctgtgaacaggaatacatagtatgtattcttttgtgtctggcttcttttttttttgagacggagtctctctgtcacccaggctggagtgcagtggcgcgatctcagctcactgctacctccgcctcccaggttcaagcgattctcttgcctcagcctgcccagtagctgggattacaggtgcgcgccaccatgcccggctaattttttgtatttttagtagagacaggttttcatcatgttgaccaggctggtcttgaactcctgacttcttgatctgcccaaattggcctcccaaagtgctgggattacaggcgtgagccaccgcacccggcttggcttctttcatttggcataatgtgtctggaaatttttcatgttgctgtattcatgtgtttttttctttctattgctgactagccttccattgcatcgatatatcataatttgattatctgttcacctgttgttagatagttgagcttttttttcccagtttttagctattacaaaaaaagctaccatgaacattgacttgcaggttttttgtggacgtattcattctcttgcgtaaaatacctaggagtagaacttctgggtctcatatggtaatgatatgtttaactttataagaaagtgccaaattgttttccaaagtggttatgccattttatattcccacctatatgattgacaattctgaaataggagttggggctccacaccagaccagatggaagactggctaaaacagggaagagacagaagcacctctgcataagacatgcccaacagcgccatgacagtgtgccattgccatgacaacacccagaagttaccatcctttttctagacatttccaaataactcaccccttaatttgcatgtgggtgtaaatatgactgcacaactgcgccaagctgctaccctcaacacgttgcctatggggtagccctgctctgcaggagcagtcacggagctggaacactgatacctcagtgaagctgattttttctaccaccagctcacccttgaattctttcctggccaaagcccaaaaccttcctgggtggagtcccaatatgggggcttgcctgccttgcagcagttcttttctccatctttcccaatccttaatattgccaatcttttcatttttagccactggcagttgcatagcagtatctgatggttttattttgcatttccctgatgactaatagtgctgagtccttttcacatgctttttgacaattcatttattttcttttgtgaggtgttcattaaaaccatatggttcatttttgtttgtttcttattaatgagtcatatgttgtatattctgcatacaaatacgtcctttgccagataaatgtattgcaagtattttcttccagtgtgtggctaaacttttcttttccttatggtatcctttgaagaacagaagttcaatatatccttttatcccttttatggttagtgcattttgtatcttgtctgagaaatatttcactaccgaagttatcaggatctcccacgtgcatccttctagaagttgttttttttttgagacggagtctcactctgtcgcccaggctggagtccggtggtgcgatctcggctcactgcaagctccgactcccgggttcacgccattctcttgcctcagcctcccgagtagctgggactgcaggcgcccgccaccatgcccaggtaattttttgtatttttagtagagacgggtttcaccgtgttagccaagatggtctcgatatcctgaccttgtgatccgcccgcctcgtcttcccaaagtgctggaattacaggcgtgagccaccgcacccggctccttctagaagttttatagtttgagattttatacgtgttctatgatccattttgcatcaatttttctatatggtgtgagttatgtgtccaagtgtgtttagcaaatggtatttaattgttcaagcaccatttattgaaaagattctccttcacccccactcccactgaattgcttttgcatttttgttgaaaatcacctgcctgtgttcatgtgtaggtctgcttctggaatctctatttcatcacactgctgtacatatttacccctttaacaatagaacattatattacttaatgttacataatttcatattgtatattaaaatctggaagtataaaacctctagattggtacttatttttcaaaattgtttgggctatcctagattttttgtgtctccatattcattttagaatcagcttttcaatatataaaaaaacttgagaatttgattgagattgcattgaatttacagaccaatttggggataaaggtcatcttaaattcagccttccaatccatgaacatattttacctctccatttattcagatcttccttcatttccttcagcaataaagttttcagtgtagagtttgtgcatgtttctattaaacttgttatcaagtgtttcgtgtttttatgctattataaaatgacatgccatattatatatgctattttaaaattttactttctggttgtttggctgatatatgcaacataaatggatttttgtatacatatcttgtattctgcagtcttgtttaactcagttattagttctaatgacttaaataaatcctttagtatatactacatagatgacaataactgtgaataagttaaataagttttattttttcccttctctctctctgtccctctttctctgtgtatgtgtattgctgtgatggctagaactttctgtgcattcttgaacagaaagggtgaggttggaatgttggcctttttcttaatcttgacaggaaagcgtttagtcctttaccacttaagtatgatgttagctttggattttccatagatgccattcatcagtttgtggagttcccttctgggcatacttgctgagtttttatcctggataggtgttgaatttttctgcatcttttggtatctttcaaagcttttctttttttattctgtttaggtggtaaattatgttgatttagttttctactgtcaaaccaatcttgtgtaatacatcagaactccacctggttctgatctattataacttttacgtgtattcagaattgttatgctaaaattttcttatggatttttgcatcagtgtaagacatactgaactgtaatcttcctgaatttctttgtctggtttggtataggagtaatattggtcttgttagttagaaaatatcttctcctctattttctgagtttgtggaatataaacaatttcttaattgtttgatacaattccaccagtgaaattatttgagcctgtagttttctttgtaggaaggttttatattacaaatttaatttcttcaattaatagagactattaaagctttctatttcattttgagtcagttatgggaattttgaaagaattcatctattttatgtatgttgtcaaatatatttgcacagttttttgtaatggtgtctttctattattttaatgtctgaagattctatagtgacatcccctcttcattcctgaaaatggtaatttgtgttttttttcttttttctttgatcagttttggtagaattctatcaattttaataattttctcaaagaaccaatttttgacattgtttattttctctattgctattgcattttccatttaattgatttctgttcttatattatttcatttaattcttgccttagttagcttttctctagtttctttagataaaaattaactacagatagatagatatagatatagcctttaagcactacttcacttcacctccccagttttttttttttttttgagacggagtttcactctcgttgcccaggctggagtgcagtggtgcgatctcagctcactgcaacctccgcctcctggtttcaagtgattctcctgcctcagcctcccaagtagctgggattacaggcgctcgccaccatgcctggttaatttttgtatttttggtagagacggggtttcaccatattggtcaccctggtcttgaactcctgaccacgtaatctgcccaccttggcctcccaaagtgctaggattacaggagtgagccactgcgcccagccacctcccaaattttaatgttttattttcagtaacttccagttcaaaatattttccaattatcttgtgatttcttctttgttctatggattatttgcaaatgtattatttaactttcaaatatttgcaggttttctagatgtcttattgatttataatttcagttttattgtggttaaatgatatactttctaagttttcaattgtttaaaatttatggagaattgtgttacagccctgcatgtggtctatgctgctgaatgtttcatgtatgcttgaaaaactgtgttgtctgcagttattaagtgtagtgctctctgtcaattggctttaagtcggctgagtgttggtcagattttctatacccctattcatctttatctgtttcattttcggttactgagagaaaggtgttaaaatcttcaactctaatcatggttttatttttttctttaatttttgccttttcactttccttcgtgtattttgaaactattacttcatgcatgcacatttaggattattatgttttactgataaattgtcccctttgtcattatgaaatgtctttctataaatctaataatattatccttcttgaagtcacttttgtttgatattatttcagtgatttcagctttcttatatttactgttcatatggtatatcttttttcattcttttagttacaacttagtttcaccattatatataatggcatcattatatataatgtgcatgcatagtaaaaaacatataattgggtcctgctttttctgtgttttagttgaagtatttagaccatttacaactaatgtaattatttttatggttgaatttaacataccattatggtagttgttttccattcatctctttttgtgttgccattattctgtcttcattttggtttacagaatattattagtattccattctatttccttcattgtctttttaatgatacctttttttttgtatttttacattaggtctaaaaatatactccttaacttataagcaagttttcttagagttaatatgcagctgctttacatttcataccttccaattcatacctgacacttcatattacacaaattcccctttatacttcacaagtgaaatactgtcatactagtgtaattccatgtgcctatccttctgtgtgctgttttagttatatcttttacttctctctgtgttataaattcaccttactattatttttgctttaaatcactaattctctctctctctctctctttttttttttttttttttttttttgagactgagtctcagtctgttgcccaggctggagtgcagtggcaagctcccagctcactgcaacctccaccttccgggtttcagcaattctcgtgcctcagcctcccgagtagctgggactacaggcatgcaccagcacgcctggctaatttttgtattttttttagtagagacagggtttcaccatgttggccaggctggtctcggactcctgacctcaggtgatctgcccacctcggcctcccaaagtgctgggattgcaggcatgagccaccgcacccagcctacttctctctatattataaattcaccttactattatttttgctttaaatcactaattctcttttaaggagataatgaaaagaaagcctatcatttatatttatacaatgatttatcatttccagtgttcttcattccttcttggagatattttctgtttggtatcattttcctttggcccaatggatattattatttcatacagtacaagtcttccagtgacaaattatgtcagcttctgtttgtctaaaaatgttacactctcgttttttaaaaaagtagttttgctggatatttaaacctgttttccccatctcaacattttaaagatgtattccattttcttcttgcctccattgcttctgtttagaagccagctgtcatccttatcatgatgtccctgtatgtgatgtggcttcccccccgccccaactggcttctgtgttttccttgtttctgttttctaatagattcactctgacatgtccaagtgtagttttcttttatttctcctgtttagtattgactgaactcctatatcttactagacatttttcataaaatttaggagaattttagccgctatttccttctccttttttggcccatttttattaccttcttcttctggttctctaattgtatgtgtgttaacctatttgttgttttttctttgtttttttaaatatctgtccattttcctggagttcttttttctttgttctttagattaaattatgtctattaatacatattaaagtttactgacctttttttcttctgcctacagtttactgttaaacttgtcatgaagttttaatttgaattagtgtaattttaagttatataattttcatggttccttttaataattttctccctttttgggccaaaatttcatatctgtttactttttaaggctttttctttaagtctttgcacatatttttaatggctgctttaaagtctttctcttttaaatctaacacctggatcatctttgaatcacaagatgacattttttttctcaactatgaccacatttttcttgactactgatgacatttcttttcttgatttgattcatattttctcattttttgttttgtttttttaagacggactctcactctgtcgccaggctggagtgcagtggcatgatctcggctcaccgcaagctccacctcccaggttcaagcgatcctcctgccttagcctcctgagtagctgggactacaggcgcccaccaccacacccagctaattttttgtatttttagtagagatggtgtttcaccatgttggccaggatggtcttgatctcttgacctcatgatccacctgccttgacctcctaaagtgctgggattacaggtgtgagccactgcacctggcccatattttctctctttttttttaatatttgtaatagttttgggttttatagtggacatgatagattgggacatgatatgggggtcccatatcatgtgggtaaattatgtgttgtagacactctgtattatcttatcttcctctgaagctagtttgatatctagctgattactttgtatctgcataggtttatatctgtacttgctaaagaatatttgtgaacatccctgtttctcgagcccctctaacttgctaggtctctacctccaacttctatgattcctgcaggtcttgttaagacttatcctttggcccggaagttctagagagccctactcttggccatggtcttcacttgtaagatatggccttttaggtgtctcatttgaatgcctgaggtgttaaggaggtatccccattctggaatgggagagaactctaaatgatcttgtttccgcttccagcctagtagcagctcctgtctgacatgctttctgaagtctcaccttatgtattctcagcccaggcttagctaagaatccatgggaagccctactcagatgcccggctttcctctctatatacttcttcttctctgtagaatttccatatagttccagctgctttggcaactctaatctttgcatcatcagctcagtaggactgtcattcactacttggacttcagctcccttctgtggtcaggaaattctgcacaggtagaaagccaaggaaatcaagagtcgtacatcatgagtttcctttctgtcaagaatcacaatcttgtactgcagattgtccaatattttgttcagttttacagttcttaaggagagcagctagtttagtacagttgcttgtcatagctggaattaaaaaaatattaaagaacctcagccaaccaggatagagtacaggaagaagagagagagaggaaaaatgaggtgagaaaaatagaagtcgtaggattggagtttaggggtagtttgaaagagaagaactgaatggagtagggagagtgggaggaacttagatgcatgtaccagtccccttcgtttccaacacatcatgtaataatatttcaacaactacttactgggacctcatctgggccaggtactacagtgatagtaaataatggttaataaagtcttagtcatatcccaaggtttagtaaggtaaatatactcacataaaaacaattacaaaatatgtttggggttcaaattgctatttgcataaaattttattatgctaaataaattaattctgcttggttgggaaaggtttcagccaaccttaaatgatgggtaagagtgtatatgttaaactgtgtattggcaggggttgttgggtggcgggttaggtaaagggtaaagcatttcagacaaagtgaatggtgtaaatatcattggaacacatcaagaactgtagtttacttttgtgccagcaacagaaaagaagcttggtgagtaaatcaaaatttcagtacagattaacagactcccaccagttgttccagaataatcacattcatgtaagcaagataaagggaaactacccatcattattgccccaaaatgtcattaattcaggttcctccacctgagacctaatcacacttaacattctcccacagacaagttgcattagagatatgcaagacaattgtatttcccctccaggagtacagtgagtaagcaagaacaagtgacgacagataatttcctctaaatatttgatttactggccaaagctctctgtgtgtgggtcaatgagtctgtctgttctgtcaactcagggatactgggtcattgctttcatttgatgtcctttttttagcttagtaagtttcattactgggtctgaaatattaatagaccaatgctatactcctccccgctctctttatccctcttttctgcctttcctgttgtctcccttctgtctgtcttattcccttcctctctaccttcctttccacttgtggaaatattttggcagactacagagaagcatacttttctatacttttggagttaaacataatctttggtgttaaatgtcactgtgaattccttcaataaagtaaagccttgattgcttgctgtttaaaatagagtaaaatcaaatatctggcgaatgcccattcctttgagagctacacacagatagtagaacctataatatgttctatgcatctctatgttttcaataccaatgattcttcttttctgagcatggggattatatagcagcaactagggaaacagcataactaaacatccttattattattattattattttgactcacaatgaaacacaatagtttattgtatccaaaacctttcagtaggagacctctgtctactcctataccctagatttaggttatggctggatgcaattggaaatacattaaaaatgcatttatttgctgggcatggtggtgcatgcttgtagtcccagctgctggggaggctgagacaggagaattgcttgaactcggggggcagaggttgcagtgagccaagatcccgccactccactccagccttggcaacagagcaagaccctgtctcaaaagcaaaaacaaaaacaaaagcattcaaaccagattttctttgtaaaatatttcagatttggagggcataggagattgagtgggtggtaataaacacagaatcgactgaataggtaacgttaaaactgttaaactagaaaagtttttaaagaagatatttatttaggacttcaaaattgtccaggtactatgctaaatgttttataaatgacctaatgtcttccttataaagtaaatgaccaccatttactgagtgcatatcatgggctaagcccttgtaatgcattatctttaactcttaaaccttcagtcaaaggtagcaatcctcttcatttgcgagatgtgagaactaaggcttagagaagtacagtaactctcccaaggctgcagagcttgacagtgtttgagagggttttcattcgagatcactctgatccttgagcctgggcccttattcttcaccccgtggtggaggtacctgctttgtcatttctcataaatgcatgctttggtgaaaaccactttaaagggagcttatgaaaaggcaagattgaattatttctaggccctcctgcagtggatcctaatttttaatgtttatggtaatttgcaaggattagaaaaacgtaacactttcaagacttaaagggttgtttactcaagatatatataacaatttcctctccatagcttagatttagtgttggtaattattttgtctttaagattacaaaaactttgtttcagaatgaagtctttatttgcacattccagaatggcttattgaaaatcaagtataggcacaaattaatgaaatacatattactggatgtattataaacatatcaatattttctattttctctcttatggtctgtttctgttcacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcaggtcagcacttttatttatttcattataatcttttcattatttattctcattaataatctttcctaggaagattaaggaaaaaaatatggaaattctctgcaaagctccctgctgtgcactttcttgcaagaaataaagtttgtcatttggagcctgacttaggagaaatacaggaattgcataagattctgtggttattttgaagtgattattttattggaaatacttgaaaataaactccagattttatgtgggcaaagaaacagatgtgctactactctgaaatgatgtaacttgctactgttgaatacctactttaattatgtaaaatcgatgtaaattttaggctgtttgctgttcatttaatctaattatattataaaatgatggcaggatagcaatcttaaagttttcacaaagttttcatgttcaggtaataaaagtctaggcttgtgaatttcagtacaaggcattattctttcattatcatcattttgaaagaatgtgtttaaaaagttatatttgcagtaaaagtaagttagcttatatgttactatctctccatgccactactttgagttaaattaggctaatcattctggtgggcatctatatcaaatgttttatttgggattttaaatctggaatcttatgtattataaatgttattctataatataaagtaaggtattaaaataataaatcataattggaccctatcgtgctaaaatgacataattttcttaatttacagcagttactcactggactttgatgttgaataaatcccttttttgttgtttgtttcaaaaagctacagattataaactagaattaaggccccagaagtttttaggaaaatgctatttccagaattttgctaagtatatcaaatatgatatattacatttcaaaaatttccaaatcagaaggaaaacgttgaaagattctctgtaaaatacagcagtatgtttatatagttaatagtatagtttctttatcgtgttttctctgacacatttgccagaggctttattcgaaagggtgaagattaaacatattctctcagtttgtgattggttatataaaacaccataccagctatgaatgatggttattctttgttaagtcattcaaatatgatttttaaaaatttaaaagtgaaaatcgtgttttttagagtaagtgtagtgtttgagagaaattacttcatccaataaactgctaatgtttgcaatcccaaagttcaaattatgttaaatgtttatacagtaatattgtcagtaacccaataaattttaatttctgtattctgccagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggtaaatagcaaagagctgtcttttactggagaagccaatctgattggtttcttgattctgggattgtcatgctctgtccctcacttgtccatgtttgcccagctgtatttaaacttcaatattgcaaataattttaaattaacagcagccatttctttttaacagacaaagggagaaagttctagtttctttttatcaataaataagaatcctggttagaataaggaaattgcattaatggaaattggggctgggtgctgtggctcactcctgtactcacaaacactttgggaggccgaggcagggggatcacctgaggtcaggagtttgaaaccagcctggccaacatagtctctactaaacatagtctctactggccaaccccgtctctactaaaaatacaaaaattagctggacgtggtggcaggtgcctataatctcagctactagggaggctgaggcaggagaatcgcttgaacctaggaggtggaaattgcagtgagtcaagatcatgccgttgcattccagcctgagtgacccagtgagactccatctcaaaaaaaaaaaaaaaaatagaaaaaaataaaaattggatttttaggctataactactctttcatgatgccattttgctgtgcaatttgatttaaaggatagtagaatggcaccagtttaatgcagacaaaaagattcaatttccccagaaggaaaggggtgtgtgtcattccacttctttctcctgtaggttgcgggggtaatctcaccacttcaagcggcacgttcatatctcccaactacccgatgccctattaccacagctctgaatgctactggtggttgaaatctagccacggcagcgcatttgaactggaattcaaagactttcacttggagcatcatccaaactgcactttagattacctggctgtatgtataatgtttccatcatattgttccctgctcccatctcacccaacgcacaatgcacttatttttattttcgagattcaggaaaggggagcatctaaaccgaacatccatataaaaattcaaacaaaataaaaacataaaagaaatttggtgaaagtgaccatcttcgaagtactcaatggctcgatacactaagtatttaaaatatattgatagactattaagatatggtgaaaatctcctgaaagggattacaggatttattataatcattatttatgtttttccacatatgcattgaaaaatcacaatttagaagacagttttggcgaagtagagaagataatatgagtcattccactaggatttttcacagtacagcaattcaccattgttcatttgttaaaaatctaaataaaaatgtattgaagtgtcatgaatcataaactatggaatcaaaaaacaaggaggacagttgacatcagctgtggcattacaatatgtattgggctttcattttcaatattcagccttcagtgtaagctcacacgcttattactgctgcacatgtccacagcttaattgcctgagtttatggcctgagtttataaatacctaaatataatttataaggttattttatttcatggctattcttttgtgatgtcatatatataacaaaaaatatatatttattatatataaagatatatttattttatatatatttatgtttacatataaatatttaatacatatataaatatatgtatttaatgcaaatataaacatatgtgttgaatacatatataaaaatatatgtattaaataaatttattttataaatatattatatataatgaatatttataatattttatatataattacatatatttatttataatatatatacataataaatatatatattttttcttcctcacttcttctggattatagtcctttacataatgtttatagtctcaaccatctaacattcaaaatattttcttaaaggtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagagtaagtgtgaataccggcagagtaagtgtgtatactggcagagtaagtgtgaataccagcagagtaagtgtgaatactggcagagtaagtatgtatactcgctgttcagtgcctagagtgggccttcaaattcttgaaacaaactgaaataagtgtaacgcattggtgtgagcaattgaacttcatcttagtttcttctgtgaatcgtttaactccatttgagggagaaatacgtattaaatttaatctcatataactaaaacatctggcaaactatagaaacttagaagagtatttaatatgctgagagagttgcaattcagtgaaagatcagtgtaccagactaatgactaatagcttttcatttgcctcacacattgcaatcttgcagtgtacattatattattccaatgtacatagtattctatcacactagtctctaccttaaaaagtaccttaattttattagggaaagctgtggtccatgtgagtcatgcatggaataagcatgttctttacagtagaaaaatctggccattgtacagatgccattttaaatctacttttcccagatagcaacatgatggaattaaaggaacactgagcaaaatgtcaaggggcctggggtttgttctggctcctaacccttgagaaagtcacttttctttgtggtcccatggtttcttcttttagaaaaggagattaaattagatggtctctaaacctgccttctagctctagaattaaatgctttttgaagttagttccaaaatggacattcaagaaaacaatattttcttgaatttgttatttgatagagacttttactttatcaaagtaaagtctaggttttggaaacataattctactgaatcaaaatttatccataattttacacaattatcttttcccacagaatcaaaatttatccataattttatgtaattatctgaaagtggaattaaaagtcacaaaattattaactgtatacacaatatcccttgaattaactgaaagagtaataacatttaaccttgattatgtatgaattttaagattcacattgatttatatctggggattaggctgaatcctagatagttttgaatattaagttttaatatatagctttgttcttcagaaatgtatcactagtacataaaaaggtctcctaagttctatcagagatacatctgttttactatgtaatcatttatctaattttattactgctgtgctaatctatttctggttataatcagattgtttaagggtttcttttttttcttttcatttctgagatatttttctgtcataatttcagaatcctgaaagtgtaaatgagtgcacataagaggcaaaatcagagcaaactagtgagattatctgtaaaatttgccatgggaaattggagatttacaaatagtataaggtctgagtgctgagagtggcccatgtggtttactggaatgtattttcctgggccctgtgttgcccctagtcatcgaggcacgtgatgcctatctgcctaataggtgtaccttctcacagtcttctaaaacaataagattattctttaaaaatcctttatggacaaaactgtgacctaaagattttcaaacagaatgggtttaagtattctccctgctccaacaaagcaatattttgaagcgccacaaatgtacacttttttaaaccaaagttataaatggtgttctacccaccttcagaaagcatatcgtagtaggaatacatctatgaatcacactttcagagacagctcattccatataatgtttatttcccgttctcttttattgcacatcatagagataatatattccttgtttaagtcattaggattggctgaactgggcacccaggattagacatacttagaggtatctggtttggttttgttgaaaactcagctcaagaaaatgccaccattggattgaagactttttttctgtaatttcacattttcctttcttctttaaatcctttctactctgtctattcgcttggtacttcctgatgactaactagagggagaacggagcctttactgtgaatttcatgcagacttttgaatgttcaacaaagccatgttgttactggtttttagcattcccataggattttgggtttttaaactgttgaatttaaaagtcagaatttctgtcccttccacgtgttaacattaaaaaaacagcagcacagaacgtcgaatgcgcttctctaacaaacaaatcagactgatccctgaatataaccaagttattctgctctccacaaattcaagggaatttgatgcctattttaacatgactatttaattttcatgactctttagtttgaattcacttcagtattatttcacatttcttctaaatggaaatcctttcactatgaaaatactgcaccaaatatatatgtgtgtgtgtctctgtgtgtgtatatatacacacacatatatacacatcatatatgtgtgtgtgtacatacacagatgatttttatttattttttttaaaggaaaatctcatcttggagcacttatgaagtatataatagtggttcttaacagtcatttctttttccagcatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagaggtatgtattataaagcttgattgatcactgctttttcagatcaagggagatgtgtcaagttagaatccatcatgctttttagaataaaatccctaactctgccccacgcatctataacacaccaaccacccatggtatttgaacaggtatatttcatatttaatgtattaaattgtgaatacagagaactatctatgtttttaggtttcagtgtaacttctggactcattgacctcatattacttaacttacatggaaggagagtaataacctctattttttgttggttgtttttatgtttgttctctgtgtataagagatcagaaaatgtttgggtatcttggatttatttaagatgtcatttttctagtatgaggtatcatggttttaattgttgtttttatttttaaatgtaagttcatttcagtatatttttatttttgtaaaattgaagtttcaattgttataatcatgaccactagtaacatttattcaactgtctgtatgcaatttcaggcaataaatcttgcttaaatattaggcaaccttgaatataaggtaatatgttatttttgcaataagaaattttaacttaaaaagctttttgataacttgcatatgtaacttttagggctacaaattgggaggttattttggcatctacgtttcatcatcagtaaaataactttttgagtcatctaaggcattatctttatttctgtctatattgttaatatataatacttcaaaaaatccacatataatgttttcactagataccctttctgaagtgataagtacttgctctgataacaggacattttttttcccacctgccctcctacctgcagcctagtgacttaaggtagttgtttttaaggtggtcagtgatttttagaagtcttacttacaaagacttcaacatccattgctggcaactctggggtcatattcccaggaaaaaatatgttattcttgtaaaatgttcttaattgtgtttttacaagttgtataggaaaactagcattggttgaggttggttgaggttaacatatattttccaaatagcacttttgtttatgaaaacaaagagtgacaacaaagcattctgcactttgagagactctgtgaggtcctaactataaggagattcccttgtttttcagagataattttttgggaaaaaattttgccttatatttacaaaagtacaatattacagaaatattagccatagtgtttacccattagaaagttttgtttaccagtattctaagaaaatatgacacaacatgaaacaaacttacaagcacgtacttggcaatggttttaaagtccaccttccttgacctggagttcaactggtcttcacaagcttaatgataccaggatggtatcattaagatactactagaataggcatccatttcttcacatggtgagaccttgtttgtgttttagaaaaagcagaaaagttgctttcaaagccctttgtttataccgtgaacacagcagttggtcatacctccttttaccagttaggactattctgattcccactggactgtgggcttctcgaaggtctgtgctgtctcctactaactttgtaacccaggcacttattatacaggtgggacattacaggagttcagtaagttcaagttgaattgaatatcacagccatattttagtatcagtctaatgataactactaatgaatgagaaagattgaattccaaactggcgtttttgtacgacctcctacacacgcagtgcaatcctacaaattggagcacaaaccaaaataggactcatgatcttgccgagcgttgcacgtataacagtgtgctgggcaccataatcgtgatttggtaaagcgtaatggagaaagctacagaaaggaggatgcttttgaattgggctttaaaggaggctttggcagaaagagggggggaggaaagagatgaaacatttccaggacctgaactccatttctttcgactcatttgaggatgaaatggcaacaaaaaggtgtttaaaaactcaaattaaaaaatgcttgttccagcaactgcagagtagctcattagacccccttatggatgacgtgtctgtcatgttatggtcatgccatttctcttgtgcaacattgacggtgaaagagcaaaaatacaaaatgagaaccagaagttcagaaaggccttccaaaaaaacggcgctgttgccagagggaggagattgttttccatctctgtgagccaagaggccagaccagagcaatagctgcaatagctggtctatgatggaaattttaacacacaaacaaccatttacagagagaaaactcacacacacagaaatctagcttccattattttaatcgcttctgggttttttcaactgacttccccaaatcccaactggatgcctgttactagagccagaatttagttattctgaattaataaaatggaaactacaaaaagacttaattacgtgctggtcagacactatcccgccttgatgagaggaatgggtttgaaaagatcccattggaaaccaaatgcatcctttattatttcaccctctgggcaaaacaaaatatttcagatctggaaataaaatatacagtgggagaagggaccatttgcttaaaggagtgagaccatttgcccgtgcaaacatggggaatcaacctgaagagttctggctgtattttacaacttgatttcagtcttccatttttattttgagtctgagtctccatgcagaaaaggagatttcaaacgagtgattgaatatagaaatggaaatgatagatttgggagaaatcaacatggagatgtataggaagcccagggtatttgttaagtcaacagggagcatgtgtgtagtgagaagaggaagtaggaacactaagaggtgattgtggctgggcacggtggctcaggcctataatctcagctactcaggaggctgaggcaggagaatcactagaacccgggaggcggagtttgcagtgagctgggatcgcaccattgcattccagcctgggtgacgaagtgagaccctgtctaaaaaaaaaaaaaaaggtgactgtgtcatgggagccaagggaagagcagtcgagagaggttgtggttcagaagggtcccttggagatcaatgtgactctggtcagagcagtgtttgtggggcgagagcaggaaccagacagtgtaaagaggtacaaagaggagagtgagtgtagactgaagtctaggtccctgaattctgaggctctctgtaacaaaccagagtaagtgatggcttcttttctccaatccttatccttcatttccctaactggtcctcatctagttcacgtgtgtgggacacactcctttgcatgttctcttgtatgtcagtgcctctttaaatgtggccccagaattggatgcaacagttcaactaaacctggctaggcccaagtaggttggaaccgtattatccagttcatatatttctggtggtctatgctgaagttaaatggggtttattgtagctaagtcatgatattggcctatatcaagatttataatctccatatcacttttacatgaattattatgaatttatgattatatgatttttaagaatctaaacagagatatttttcctaataaatcagatttgattttgtctgagaatcccaacacatcatgacctccctaaatcttcattcattgcttttcagagcattattcatttgcatacagactcattggccactgacctagtacttcttcaaaaataattgataaaaatgtcaaacaagattgcatctatttcaaatactcttaaatgataagttcttttggttaaaattgatctattattaagtgcttttggaatagcactattcaaactactaggtaataaaagctaatatttattcagcatgtattatttgccaggtaattctcacagcaaccctgtattataagaaatattatccccattcgttaggtgagaaaagtgaggcagatataggttgttcatattcagaaagattataagtgtcaaggccggctttctagcaggcactgtaactccacaccgatgctctcagccataacaccacataccccgggagcactctcacagtgtcctgtcaccctcacagggatcatggggaagtgttcctgctgcccccaagtctaccattctattgacactgccgcaaagagaaatcaatgttttgcatgactccatagataagcaggtgccatttattataatcacctctttctttgcttcatgttgacaaattatttttagtgtctaatttagaatttttccaaaaattactgttaatcttactgatctacgagattctagaatgaatctttccccatcttggaagctggaacgttttcccttcagccccctggcagccctgctggttctccttgtctgggctcgcactcttggtggtggcaccgaaacacaatctgagccacatgaagaggacaggcgcatgtgacaggctggttactttgagaaggctcacacctccccacacacaggagaggctgagaagcctggagaaggtgggaagccaagagagtgaggcagattctccactcccacttcctaaggctctgctcctgctccctgactgttcccatccattcccatccctctccccaaaggcttcctctgagtttcagcaacctcggaattttagcttcaacaacatgaccaccccagccttgaccctacaggatcatttacctcaagtgcttgcatacaaccagactttcccttggtgacaaatccccagcacagggagctcatgtgtttgagctcgacagcaaatgcatgggtctagcctgcctatggacgatactcattagggcagtgtagccaagccctctagccggtgatgttcacagattatgttctgggcagaagcagaacttgtgagcaggggcatagattccgctggaatgctaaaactttttttttttaatttaactttcaagttcagggtatgtgcactaccctgatagtagtacacataccctgaacttatttattatgtaggtaaacttgtgtcatgggtgtttgttgcacagatcatttcatcacctaggtattaagcctagttctcattatttttttggatcctctccctcctcccaccctccaccctcaggtaggccccagtgcctgctgtttccctgtcctgtgtccatgtgttctcagcacttagctcccacatataagtgagaacatgcagtacttggttttctgtttcctgcattagtttgctgaggaaaatggcctccagctccattcacattcttgcaaaggacctgatcttgctcttttttatggctgcgttgaaaacattaaccatgaactatgcacccatgaattcaccaagattacaaaatcagctctgtaatcactatacctttcagtgctgtggcatataattcccttaagcctggaaaagttcattgaaaagagttgactcttttatcttctaaactggaattccatgtctcttcttccagtttcaaaatcaaactaggcatgtttctacctcctcttcattgacatcacactctcttctgaaagcatccatgccatccttgtttccctctttcatttgccctagtcacagccttaaaattagacattttttctaatgttcaacaatatttttctgtgccatttcccaaagtttagctagttcgtatgtgtacccataaaatggtcagaaagttccatggagcctcttggatttctgcttagattgatttctttagagggttctccttttttgcaccccccaaaattattcctgattttgtagtgagaatttagtttttcagaatttgccaattttctagaatgttctttcctttttcaattgcgttttcatttgtttttttttttttttatccataggtttatatcttgttttgaagtttgaatccccaaaaccttagtccggttaagtggtcagccatcacaggctctaagttaaggcaaggtgatcactgtctcctattgtcttggtgacttccatattaacaaccacttctttgctagccagaattagtccagagttgcacttctcttcactgtctcctttatatgaagagagcatataaagaattcaacaaatgctacattttttgggggaacaagacatctcatgggtgtccagattgttgaaacagtctccccgtcgccactcctgtagatctcttttggtacattagtgtttatagatttcctttacaaaagattgcagtctctactgaaaagaagctgaggtgggaggataaagtccttataactggctaccaaatctggctgcattccagaatcatctggggatcttgttagaaaaatttattcctagtcctcatcccagacttaaccaaatccttgaggattccccaagagcaagctttgcacaagcccctggtccagcacttgagaccactgttcatagcccacttccaccaagatagcctgttttatcctcacttcaatgctctctcctggggagggaaaagtatcttaataggcatcttgttaacatacatttgcctgctattaaatgttactttccagtgaggacttactcttccattgctatggctgagttatgtattttatctcaccaaggcctggtcatacagttgatattatgtttacctcattatattaaaaatgtcagattcactttacagtttttgtattctgattctaaactttctcccccttttccttatcgggcaccttgaccactatcatcttccattaaatcatttccttattccttccccttttccactaaagtccatttcaagtcctcgtgatagtgtgggggacttcagtcaaaggcatttccctccagtctttataacatgcatttcatctcttgccaaatccttgctgatgtcatcctgttcaccccagatgcttatatcacagtttgttgcactcccgtatcctcctttcagttgcaaaataatgcattccaagaggaagaatggataaaaaacatcaccagtatccctgaatcttgcagtgtcacatccatattctccatgtctacagcctaaacaacattttccatataccacgactgagaaacatcgggctcatgggatattgtcaatacttaaagtgatgctagctgttatggagaactcatacattctcagttgcttactgcaacacaggttatttctaatcacatcagagtaaaaggcaggtgttcctggcttccatgtggtagttcatgaaaccaaaggaaggggaagtcaatttgcagaagccacataactgtctctgccacaaatgttggtagatgtttcacaaatagagacctatattctaataaatctgcgatatgccaaattaaaacacaattaagcagggtttgttgttttgttttgcgtttgctgtggtatttcctcaggctgtcactatcctaaatatgcattcttcattcctttatccatgtatccagtcagtaggatatattttagacacttaggctatggacatgtgactgttttagcatcagttttccttgtcatgatggaggaaacacaccttaatcaatttatcacacaataaaaatttaaccacaggcagcgttaagtgctgggagggacaattatagtgcacccagaaggcatgagatgggaactgagctcctttgtgggtcaggaaaggcctccctgaggatgaataacacaccaggtgccaggaggcttgagatgtgagggactggaaggagagcagtgtgaggctctcaggtggacagggacctggcctgcagagcagggtgggcacattaagagtttcagagacctcctggagagcagcaggaggtctttcaaggatgtggtcagatctgcacttttaaaacaatcactctggctaccagaataaactggagggaggtaagagtaacggtggagacccagtaaggggattgctataggccaagggagagagaactccaggtcttcaccattgctggggaggaagcatgagatcgaatgatttcagagcacttaggaggtacaattgacagagatggataacaacaggatgaaggaaagggagacatcagaatatagcctgatagatagaactggacgcagggaaaaccaccaggggagattagtcccaaagagattatccttgcccagaagtctgattaatgaacatctattggacatttgtattccatagaacattctgaggaaaacattattctagagatattttccaagtttatttcattttcccctcatacaaacaagcaaactttgaagttcatgaggcattagagagttattcgcatctcagatgttattttgagaattacagtaatatttgtcattaatggaatgcccatcatgtgctagacactactaccaatactttgatagatataattgtctgtcctcatagtagtccagtaactgagtataagtatgctcacaggagaacagggattgagatggggaaccatactcagtgcaggaagtgtcatcactacatgaagtgatgaaactacgttcacactcagtgctgcacgaatacagtgtgggctctggagtccacctggctccaaagctctttaccagctgtgatcttgggcaaggaatttaacgtctggctgctttggttctctcgtgtgtaaaatgaagataataatccacacacctggaaaatattgagtcctcaggaaatgcttattactcccctccacgccccttctggagagagcccagctcctgcctggtcattcagcttcttcctgggacacttcaggaaatggtttctcacccttacaccagctgacctccatctcttgcaaatgccatctccattccttgtgccctgccagttaggagcagtggctcctccctggcgaggtctatcttcctctccaggcagagttcacattttgttttctttctcttccgagttccctaactcgatccatggacttctccataagggctttgctttctctctgtgctctccgaatctgtttaaaggcaaatttcttctgtccttggaaagaccttgcatccgctctaataagtgaagcgtaaatcagtgtttgtgtttgcagtgcacgtcactgctggtcacatgatggcataacagattccaaacaggtgccaaggatgattcttcaatttccaaattgcttggtttaaaggtaaacgccagtctttagctccctattgaaaacagctccaggcactgtgctttctattgttctagaggggagtcactggaattagaactgcctcagccagcactcttctatctggtgactaccatgggatgctaatgacaaagatgtagtaagtcctctagcactcgttcgcaagagaatgtcttctaggcacccagacatatgatagaatgtgctaaattggtagtctctgtacctgcttcagagtgaagcaggtaacttcagaatgaagtttaaacccaaactccactacttagtagctaggtgaccttgggcaagttccttagtgtctatgtgcctcactttccctttctgtaaaacggagtaataagagtcaatgaatccatatatgtaaagagccaaaacaaggtctggcaaatagagaacaaatctataaatgttcactgttattatttgcactgatgctgatgtaagagaaacatctcagtaaggtatagagaaattcacaaatagagagccttcaattctttaggttgagatataattaatgattcatttctcaagacatttaattttcctcttgttttctgcctgcagcctgcatggttaatgcattttgacacttctcactaaggataaatgacaaatgataaaaccaacaatttttgtccacttattttactcaaagctccgttaagaaaaataatgaaaaaaattttaatttcagtgactaacaggagtgttcgtattgtccctatcattttaaaaattgttttggttactctctattattacagagaataaagactttctgtatcctggagtttaacaactcttattttattttattttatttttgagacagagtcttactctgtcgcccgggctggagtgcagtggcgtaatcttggctcactgcaacctgtgcctcccgggttccaatgattctcctgcctcagcctcccgagtagctggggccacaggcacccaccaccacacctggctaatttttgtatttttagtagaaatggggtttcaccatgttggtcaggctggtctcgaactgccgacctcaggtgatccacacacctcggcttcccaaagtgcagggattacaggcatgagccaccacgcccgaccaacaatgcttattcttaagaaaagaactgccacagaaggaaataggaaaaattcttcttcagtagttgatgcctttcaaaatattaaattactaaacctctacctacctcagtttccagaactctaaaatgaagataacaatactacctgcattacagagctgctaggatttttaaattagaataatgaccagcatggaataagtgctaatacatattatctatggttattttaacataaacatagtctcatggattatttttttgtgctctgaagcaggagaccccaatctttttggcaccagggactgtttttgtggaagacagtttttccacggaccgggggtggggtgggagggtggtttcaggatgattcaagtgcattgtatttattgtgcattttatttccattagtcttacattgtaatatatagtgaaataattatacaagtcaccatcatgtagaatcagtgggagccctgagcttggtttcctgcattagacagtaccactggggggtgatgggaaacaatgacagattatcaggcattcgattctcataaggagcacgcaacctagatccctcgcgtgtgcagttcacaatagggttcatgctcctatgagagtttgatgccaccagtactggtctggggactggggctcttgctctgtagcattttgtggtaaataaatctgtggtttccagagcagccttcccagttgtaattaacatcaattggccccactgtgttgaaagcagtgctgcttctcctgcctcccagttttcctacaaaagccactgggattgtagataaaatcctgttttccagttggcgagatgcagagaagcagatgagattttgtctgagcagcggtggatctgagccgactttgattatggctccaccgccaacgcttcctgggcagatgagtcatgcttcctggaactgtctgtcagaggaagtttgcttctgggacttttgcattttgcttagagcttagagataagctattacaattctaagttcagctgctattcaaaaacatgcataaaagctgggaagagtttaccaaacatttcaatttataacttgataccagatatgagtctagcaccgtactaagcatgatacctggattcaaaaaaagtttagaatgaagtatatccattagttagcgaagccagatgctttgtagtgtcgttgagtttagcatgaggcattttagaagaaattttggttttaagattgcctgagtaaaatgtgattttttagttataaaaaattgaaagaagaaatgttatttcagtgtgatcagaatccctttccttaaaaagaaatgctgatcttttctgaccatctttcacaatgaaggattttcgtatgattgcattaatttgcagcagttaatgaaccaacgttccaaccttcaaaagagcctctgctctcagattcaaaagaaactctgcgtgtttcctctcttcaaacatgaaggacagaattaggatgaataataatcaaacctaaaataatttctgaactaccctgaagcagtaaaaattccattagatgctcagaacttgaattgtcctatgcacactgcctttcctggttgacctcaggttgctctgctcctcagactggcgaaaggcagggcaaccgaaaggtctcttccactatcagacaggctcatggtatgaataagcatgcattgagcaaaatgctaaattttaaacactggtaatcacagttgtgggtttcagttaactatattgactttctactttttaaaatgggaaagatttccaattgcaacattacagaattttgtttaaacacgtctttaccctgcagttcctacattggctctttatttatttatttattattttttctttctttctttctttttttttttgagacagagtctcactctgttgcccaggcttgagtgcagtgttgcattctcagttcactgcaacctccgcctcccagattcaagtcattctcctccctcagcctcctgagtagctgggattacatgcgcccaccaccacgcctggcgaatttttgtatttttagtagagacagggtttcgccttgatggccagtgtggtctcgggctcctggcctcacgtgatccacccacttcggcctcccaaagtgctgggattacaggcgtgaaccatcgcacccggcaggctctttatttaatagactttcttttcctgatctcactgtcttcagggagagcccggatggcagtcctctggcttcttccagctcaaaggtctatgatttcacgttgttctatgaaccaggttcttctctgttcctgagaccatctgcagcaggtggtgagaattttaagaggcataataataataataataataataataataataataaatgtttagtgttttactgtagcaggataattggcagagggaaggctgaggtttatggaattaaattttcatgtatacacaggagagtatgcttagctttcaaagcatttcacttaccactagggagggatttaggagcccttgctccatcagtgactatcgaaacatatgtttacatgaaaccgtcagtccctgaacatctgaagacattattatttttaaaatttttaatttttgtgggtaattaataggtgtatatattatggggtacatggtgtgttttgatacaggcgtgcaatgtgtgatagtcacatcatgggaataaagaaataattttttgtaaataattagcctaattaataataaaaatctagttatgataaaaggaagcattataggcaaaatatgattttaaattaatgctggagcagattaccttacatggtaacatttcagtggattaatttttacatataaccttgagatacttaagaaaagattatggagatagacaatttaatatttttagtaggccaggtgtttatttgacagtctaaaagggtatgaaattctgagattggagaagcattactaatgcatatctctactgccatgtcaataggtccccaaagatattgctttaaaaataaatttatcagatcacaaaggaatttatagtcattataggaaattgggaaaatgtagaaaaagctagattaaaaaatcctaaattatatcattattactaatatttggtggtattgatttcctgtcatcgctccttgtatatttattttattttaatattcgaaggagattattcagtacatactaacccataatgacttttttcacctaacaatagcttgtgactatttccccatgttatttattatgtcattttcaacattgctcatcccatcatcacaatacagccaccaattcctgttgtgaaacacttagaatcttttcaaatcttcaccattagaaacagttctgagataagtatctttgtagttaaatgttttcccacacccatgattggacaatgatttaaaaaataaaaagactcaaattgtggcttctaataggagtaatatatagaaagcagaataaaaatgtaaattctagtaagagcagacagcaactagccaccacatagaaaggaaacgctggtttttatatgagacagacctgtaactcagggtgacaccaagtaactcaaaatgtggtatttcgatgggttttttgctctcatgcaaagcccaacattatgagtaattgttacttttagatgatatttcatatttcctgccccaccctgtcagcacatggcaaggcggctttttctgtgcctatgtcagggagcatgctatgagtggccatgtgccttatggaggggacttagcctcccaagggccatcttggagtcggctgggatcaaccatgctctgcttatcagccttcctctacatttgcctcatttatccaccatgatttgattttgcatttgcccccttgggctttgcttatccacaatggaagcgctgtatctcctctgtgattcttattatttatttatttatttttttttttgagagaatcttgctctgtttcccaggctggagtgcagtggtgcgatctcggctcactgcaagctccacctcctggggttcaagtgattctcctgcctcagtcttccaagtagctgggactacaggcgtacgccaccacacccggctaattttttatatttttagtagagacagggttttgccatgttgcccaggctggtcttgaactcctggcctcaagtgatcacccgcttcggcttccctaagggctgggattacaggcgtgagccaccacaaccagcctctgtgattcttgctttgcaatttctactgttgttacaggaacatttcaaagcccttcaaatttaaagtaacctgaacttggataaagttccaagtttttccaggagatgtgagtgcaaacctcagcaacaacatttttaacaatcaccctaatgaggcctctccacagatcctgctgtggtggttgtttggggtggggaacatctgagcagatgccctgagaattccctaggtcccatccttctggatctccagtgattcagcagcaggaactacagggctgggtaggacccaaaggggaagggaggctgcaacaggaagagatgctgctcacttttagcatgagagccactttgcttgccagtggactctatccacctcaccgtggcagccttaacagcctctggtttcctaactctctttgctgctgtcccctgcatgatctgtcctcccgcaatcccttccacacacacagcatgcttatctccaccccacacaggatgattcgccttggtttctgcatggctgtccgggatgcctcagtctccacaatgcccaagttgtcatagcaacacactgcgaggattggcctccacctcctcactgaattcatcacttccccatctgccctaccagtgacgatttctgtgaactcttttatgtgagtcagctcctgttctctaatccccaacatctttcttttctcatagctattttgggtggtttctctggaaaaaaatgttgattccctttgcctctgacaaagagttagagtaacaatttgagcacattccacatgccaggcctcatagcaaaccttttacgtggtttatctcatttgctgttggcaacaatattatgagataagtaccattatggtgccagatttatagataaagacattttagcttgaagaagttcaataattttcacaaaattgtgttctctaaattttagagctgggctatgaacacagagcctggctctggccacattgacattagtcaagtacattctacaataaaattgctttcctgcttgtgattgaaatataatcttctattagtgacactcacttcaaaatgccactctataaactgattgagtatagttctcaaaaattgaacgatcatcttttcattgagtagaatttttattctatagaaagaataggggattctctactacacccaaaatttctcctcacagcagatgaattatttcaattacatattaagctctaaagaatagaggttttatggaatttgcaaagatttataattggaaatggaccaaattattctccagaagtttctccatgttttaatgatatcatcctaaagaaactcttgagttgctttttctacatgaactatatttaattaattcttaaaattgatctcctataaaaaagaattttcttccagaagaccttccaggaaataaaagaaacaacatttacaaacagtatgaattagatgtcaatctaaaacagaaagggctgagttttaattgtcactcactgtgattctaaaatgagtttggggctgggcatggtggctcgcacttgtaatctcagctctttgggaagccgaggtgggcagattgcttgagcccaggagttcgagaccagcctgggcaacatggcgaaactctgtctctacaaaaaatacaaaaaaagtagctgggcatggtactgcatgcctgtagtttcagccatcaggaggcttaggcaggaggattgcttgagcctgggagggtgaggctacagttaaccttattgcaccactgcactccagcctgtgcaacagagcaagatcctgtctcaaacaaacaaaaaaatagttaagaaaaaaagttaatctctacatcccaagctcatatatataagataattacttgtaattttaatttattacagttttaaatttttagccatgaaacaatttagcaagcaaggcacttgaaagacatatttttgttcttggagatcctgcagttcataaagttgatttctactgaggggacaggtggggtgtctgggtctctgctcacttagaacttgactttcagtgactcctaagtaccctcaatcttacaaaaaaattggatctctatcagtgattgaccacacgtggtgtctttagtgttatatcctcccctttgttatgggtccttcctatttagaagtccacggatcacttcctattgcaactggagtctgaattcactaatggtattgtaaagtatgtgccaaattatcaaacccgcacaaaggaagtagaaactggtaagtatggctaaggcaagagatttccttcctctctgagtgtgtcaagaggagttgagatatttgggggtagggtgggggtggggggacctaagccacgaaaatcctaaatgaataatctctttaagagaataacaaaagatttcacagaggaaggttttgtaatatacacatctccgcatctgaagatatatttaatggccaatttgaaaatgtaagcattattttagtaatttagaaaaatacccctaaacacagttatagaaattagatctgcatattcaaggtgagaatcgcaatctttcttagtttttactagtttcctttctgtaactcaattagaacttcaagtattgttcactctgagtagatcttcaggctctctaaaagcagggccactccagcttgcttgtcagtagttgcaatgagtcacagctggaacgtcctgtggttaacattctgctctgaaaacagaatcagaatcagtgagacggctttccatggtaacctgtatttgtatactttgaaaaatgactgttcctttttgtgtggttttgggtggtcaatttgcgcgggaatgaattgtagaggtgacgttacccatctgtgtgaatataaacaaaaaacctgattttattaacggcaaactttaaaaaacgaggtatgagtttttttttttttccttttcgagacattgttctacacatttattactagattggacattatatttaagcattttcataaatgtctatttgatgcttattttaatgcataattttctccccccaaaggcaaaaagaaactaattgtcattcatcagtgttgccccccaaacctactgcctagcccctccacccccacccagtacttttacaatgtgttattaaagaccactgaacagctgagatccaggggtctccttcaatgcgtaatcccatccagaaggaaggaaaaaaaagaaatctctttaagtcacgtgaaaatgccacatttcttaatcttgcagagctgacaggcaaaaatgctatgctgttcatgaccttgtgcaggattgaaatataattccgcaacatgctgcgacctagtattccgtaagacacatcgagcttagggtgattatagttatggagaaatcttacctatgttttgttggataagggttatgatgacttagcctgggctcagaggcctgacagaaatgaaataatttatgctttggtcactaaattacaatccaaaggttaagatttggggagtgaaagatggtagagcatttgcttgctaattactccactacttgggagcagtatgtttgtttctgtgctaattagtttagaactgtacttcatgccctagaattaagaaaaactctaaagctgagatgaatctcctgcagggaagcagggatttagaagcacaggctgcaaggttggcctctcgccctccggtttctccgcctgcaggagagggtgggactgaacgctaaggtgaaaagcttctgttccgtttcgtttccctcttcattttctgttgctttattcttctcttattctcccctattcattataggggaggcttctgataaatgtgtagaatattagaaacttgataataaatatacacattcaaagcagcagtacgaaaaacagaaaaaaaggaagctacagcagtaagcctgaaaaataaaactcatctttattcatttgcttaaaatgcttaggtttagtgctttggggtgaatgacataataggcttctgagcttgtctttttaaaaatatctgctgaccttccctgaaatctcacaagcacttatgatgagcagccgatttgagaactcagcgagacaggccaaggtttaaaaatctgcgatttatcataaccttaaacaaggccctcacctggttctcccttctacggagtggcacaaagggtccaaatcctttatggtctaagaggagcctgttgaaattgaggattgtatggcactactacctatctaactgtacagagtgcaaataatcgtgcagattgggtcctaagtaaaataaatacagctggcgggggaaatcactgcgttcattcattggagatgcatggggaacctgcctttatcaaagccctgctctgggcagtgaggggaaggccagaggtggtctgtgctttaaggcgactcacaatcagtaggggaggtaagacacacaagcccataacaagaatgcctggggatgtgatcatttccacaaaagaagcacagatgaaaagcaagggctttcaaaggcagactaatttatgcctgactgcagggattaggggcggctccatggaggtgctttgtaacatttggtggtaaagttctccacactcaaatcaatatgtttcaaacaatatttcatgtcataacattttttttcaatgaaaataatttgatcagtctggaattcattgaatccagattatacatttatgcacggacacgtgcaaacacacagacactcacacatactcttaagtagatgtactctccaagggcatcctcgaggaaatccatgagtccattaccaggtattttatgtttcgttgtcatgggcagcttatcccaagggtaactggaacaaagtgtttaaagggaacatgaaggcgattaggtgaaaatgtaatggccttagtcctgaggaagccagtcttgttggattgccattatctttctcaagtgaagagatatagtagagagatttttgtgttttttaatttttatttttcagtttggagatatacagctgataaaatcattaaatgaggtaggttaaggggacacaaccttgcaccctccatttctccttgaagatgtataaatacctcaatggaaaaatggacgaagacatcagtaaacaatttacaagagaagaaatctaaatgcccctaaacatgaaaaaaaaaatccttcaatgtcaaagtaattaaaataacacaagttaagacaattacaaaaaggcagtttttcactgtcagtactagtttaaaacatgatcgtcatcataattgacaaagctccactgaaagaaacacctctgttaactgcttgtgggaggataggttggtataaactttctggtaagaaatttaataatattttataaagagccatatgattatactgtttgttattccctttctaggaatcttttaaaagaaacatttgaagtatcaaacagctatttatatcagcaaaagattggaaatatcttaaatgaaacaacaatagaattataatataaatacattatatttgtggcattttacaccaaggtttacacaattaagtgatatgttcaatgaaaaacaagaaacacaattaaatacatagctcaaatgtataaacacatatatacacctgcacaaataggtatattacacatatatacaaatgaaaaaagtatcaagagaaatttttggatttaatgaaatattaacagtgtttgtctttagtcgaatcaatatttgtattttcctttttcatatatttctaaaatgtctgattattttacaggtagcatttattttaaaaattacctcttgaagggatggctaccccattttctatgatgtgattattatacattgcatgcctgtgtcaaagtatctcatgtaccctataaatatatacacctactatgtacccataaacatttaaaaatatttttaaattatatcttacaattataatagctgctattcattgagcccccctatgtgttgttaatatgtgaatgcctactatttccgtattctgagcctgaattatactttggacttgctaggttgacataaaaccaaaagttactagttgggtttccaaatttattgggcttaggaatcagatccatctctaataccctctctatgcaattatcaatttttaattcttatgttgagttctgtgtactcaacccacctcagcagatttacctctaacttttgaaccaaggaacagcttttgctacttgtgtagacttggatttttccatcccacaaaccatgtgtttttatatgggaaagtttctcttcaatttcagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggtaagccaggtgctgatctcagttgtatttgcagttgctatttggccaagaattttttctttttcagttccaaacttagaaacaataccatgaacaaataatggaacccaggtagtaatctcatgcaagggtttaagaaatatacttagatattggtggaacttggagagttaagtctgttaggattaagagaggaagtgacatcaaagtggaaagaatttggttaattgtaggtgtagtaataaattgccttagataaagaaagaagcagaatgaagtttctagggatgaagagttgaacctgggtatagcaagctaactgcaagttggggtgggagtatctcaggtgcaatggaatagaatgagacttaaggctcaccttgacgttaagcagagaaagggtagggatagactagaaagaatgaaagtcagacagggatggggaaaaggaaggggtagggttggcctgagaggaggagaatttgagctgcgatgcacaaagccaggggcatgtgttgtacttgtcaaacaggaaggggcacatctggatcccacctacgaattggtggttcaggaagcaggtagggatcatcattcctctgaagatgaaaggtcttctttaacaagagatctgaaatgtcttcaaatctcaggtgggccaatctgcaagtggagagccccagagcagtggttcccaaaatgtggtccctagagagcagcgtcagcattacctggaacctgttagaaattcaaattcttgggccccatcccaggcctacagaatcacaaactttgaagtggagcccagtaatctgtgtcttaactggtctccctggtgattaaagtttggaaactactgagaggtgaagccggctgagcttctgggtcaggtggggacttggagaacttttctgtctagctaaaggtttgtaaatgcaccaatcagcgctctgtgtctagctaaaggtttgtaaatgcaccaatcagcactctgtaaaaacccaccaatcagcgctctgtgtctagctaaaggtttgtaaatgtaccaatcagcggtctgtaaaaacggaccaatcagtgctctgtaaaatgtatgaatcagtgctctgtaaaatggaccaatcagtgctctgtaaaatggaccaatcagcaggacgtgggcagggccaaataagggaataaaagctggccaccctagccagcagcggcaacccactcgggtccccttccacactgtggaagctttgttctttcactcttcacaatgaatcttgctgctgctcactctttgggtccacactaccttaatgagctgtagcactcactgcgaaggtctgcggcttcattcctgaagtcagcgagaccatgaacccaccggaaggaaaaaactgtggacgcatctgaacatctgaacaaacaaaatccggacacaccatctttaagaactataacactcaccacgagggtccgcagcttcattcttgaagtcagcgagaccaagaacccactggaaggaataaattccggacacattttggtgacccagatgggacaatcaccaagcggtgagtaccactggacccctttcgcttgctattctgtcctatttttccttagaatttgggggctatataccgggcacctgttggccagttaaaagtgactagcatggccgccagactaaagacacgggtgtcaggctttctgggaaacggctctctaacaacccccaactcttcggagttgggagcgttggttggcctggaaccagcttccgcttttcctgtacttctgggctgagctgagggttgacagagaggaaagccattcagctctggggtcccaacaacaagttggttggccctgcagccatgagtaaaactctcaaagtcatgtcacccaagcaagacttgcccatctatcctatctatcctgacccttgcctcctgggtcctaatgcctgtcagacaaatttcctctcgcctctcttctctgaggctagtcccgcttctaaaaaccactccctgtctctgttgcttttctaggttctcctgtaagaatgatttctaatataaactccaggactctgttaccttctttaggcacctgggttcaccaatcagaaagacataatctttgcccaaagccccattgtagggggtactatctggaattttaggatccctcctcagacaagcaggcctatcaatagctattcctgaagctaggatatgggtagcatcagaaattgtatccttcctattcatataagtgaggacaaaaggcatcactcttccaactctggagatcccttcccttcctcaggatatggccctctgcttcatttttggggcataacacctttatacgatgcgggtaaggtcccagtactaacaagagaatgcttaggactctaacaggttttcaagaatgtgtcagtaagggccactaaatccaatttttcttggtcctccttgtggtctaggaggacaggcaagggtgcaggttttggagaatacattgataagggccactaaatctgaccttcctcagtcctccttgtggtctaggaggaaaactagtgtttctgctgctgcgttggtgagtgcaactattctgatcagcagggtccagggactgttgcgggttcttgggcagagggagaaacaaaacaaaccaaaagcacgggcagttttgtctttcagatgggaaacactcaggcatcaacaggctcacccttgaaatgtgtcctaagccattgggaccaatttgacccgcaaaccctgaaaaagaggtggctcatttttttctgcactatggcctggccccaatattctctctctgatggggaaaaatggccacctgagggaagtataaattacaatactatcctgcagcttgaccttttctgtaagagggaaggcaaatggagtgaaataccttatgtccaagctttcttttcattgaaggagaatacacaactatgcaaagcttgcaatttacatcccacaggaggacctttcagcttacccccatatcctagcctccctatagctccgctccctattaatgataagcctcctctaatctcccccacccagaaggaaataagcaaagaaatctccaagggaccacaaaaacccccgggatattggttatgtacccttcaagctgtaggggaaggagaatttggcccaacccaggtacatgtccccttctccctctctgatttaaagcagatcaacgcagacctggggaagttttcagatgatcctgataggtacatagatgtcctacagggtctagggcaaacctttgatctcacttgaagagatatcttgctattgttagatcaaaccctggcctttaatgaaaagaatgtggctttagctgcagcccaagagtttggagatacctggtgtcttagtgaagtaaatgataggatgacagctgaagaaagggacaaattctctactggtcaaaaagccttccccagtatggatccccactgggacctcgactcagattatggggactggagttgtaaacatccaatgacctgtgctctagaaggactaaggagaattaggaaaaagcccatgaattattcaatgatgtccaccataactcagggaaaggaagaaaatccttctgccttcctcaagtggctatgggaggccttaagaaaatatactcccctgtcacctgactcactcgagggtcaattgatcctaaaagataagtttattacccaatcagctgcagatatcaggagagggctccagaagcgagccctgggtcctgaacaaaatctggaggcattattaaacctggtaacctcggtgttctataatagggatcaagaggaacagacccaaaaggaaaagtgagatcagagaaaggccacagccttagtcatggtcctcagacaaacaaaccttggtggttcagaaaggacaaaaaatggagcaggccaatcacctgggagggcttgttatcagtgtggtttacaaggacactttaaaaaagattgtccagtgagaaacaagccgccccctcgtccatgtccactatgctgaggcaatcactggaaggtgcactgcccctgagtgcagtggttctctgggcaagaagtccccaaccagatgatccaacaacaggactgagggtgcccagggcaagtgccagctcatgttatgacccttattgagccccggttacatttaaccattgagggccaggaaattgacttcctcctggacactggcatggccttctcagtgttaatctcttgtcctggatgactgtcctcaaggttttaccatccaaggaatcctgggacatcctgtaaccaggtatttctcctacctcctcagttgtaattgggagactttgctcttttcacatgccttcttgttatgcctgaaagtcccacacccttattagggaggaatatattagccaaagctggagctattatctacatgaatatggggaacaatttacccatttgttttcccctacttgaggagggaatcaaccctggagtctggacactggaaggacaatttggaagggtaaaaaatgcccacccagtccaaatcaggctaaaagaccccaccacttttccttatcaaaggcaatatccctcaaggcctgaagctcataaaggattacaggatattgttaaacatttaaaagctcaaggcttagtaaggaaatgcagcagtccctgcaacaccccaattctaggagtacaataatcaaaaggtcattggagactagtgcaggatcttggactcatcaatgaggtggtggttcctctatgtccagttgtactgaacccctgtaccctgctctctcaaatgccaagggaggcagattggtttgctgttctggacctcaaggatgccttcttctgtattctcctgcactctgactcccagtttctctttgcctttgaggataccacagaccacacgtcccaacttacatggatagttgtgccccaagggtttagggatagccttcatctgtttgctcaggcactggcccaagatctaggtaacttctcaagtccaggcactctggtccttcaatatgtggatgatttacttttggctacctgtttggaagcctcatcccagcaggcgactctagatctcttgaaatttctagctaatcaagggtacaaggcatctaggtcgaagacccagctttgcctacagcaggccaaatatctaggcctaatcttagccagagggaccagggccctcagcaaggaacgaaagcagcctacactggattatgctcaccctaagacattaaaacagttgtgggggttccttggaatcatcggcttttgctgactgtggatccccagatacaaggagatagccaggcccctctatactctaatcaaggagacccagagggcaaatactcatctagtagaatgggaaccaggggcagaaacagccttcaaaaccttaaagcagaccctagtaaaagctccagctttaagctttcccacaggacaaaacttttctttatacatcacagagagagcaggaatagctcttggggtccttagactcatgggacaaccccacaaccagtggcatacctaagtaagaaaattgatatagtagcaatagtcagaggctatcaaaataatacaaggaaaggatctcactgtctggactactcatgatgtaaatggcatactaggtgccaaaggaagtttatggctatcagacaaccgcctacttagataccaggtgctactccttgagggaccagtgcttcagatacgtacatgcacggccctcaaccctgccacttttctcccagaggatggggaaccaattgagcatgactgccaacaaattatagtccagatttatgcagcctgagatgatcttttacaagtccccttagctaatcctgaccttaacctatatactgatgaaagttcatttgtggaaaatgggatacaaaaggcaggttgtgccatagttagtgatgtaaccatactgaagtaagcctcttcccccagggaccagcaactagttagcagaactagtggcacttactcgagccttagaactgggaaagggaaaaagaataaatgtgtatacagatagcaagtatgcttatctaatcctacatgcccgtgctgcaatatggaaagaaagggagttcctaacctctgggggatcccctattaaataccacaaggaaatcatggagttattgcactcagtgccaaaacccaaggaggtggcagtcttacactgctgaagccatcaaaaaggggaaggagagaggagaacagcagcataagtggctggcagaggcagggaaagaccagcagaaaggaaagaaagagacagaaagtcagacagagagacagagagaggaagagagagacaaagagggagtcagagagaaagagaaagaaagagaaggagacagagagatagaaagtcagagagtgagagagaagaagagacagagagacagagagagaaagagaaagataggaagtcaaaagaaggagacaggaagagacagagagaaagtcagagagagagagaggaagagacagacaaagtcagagaaggaaagagaggaagagacaaaggagtcaaagagagagaaagggatagaagtagtaaagaaaaaacagtgtaccctattcctttaaaagccagggtaaatttaaaacctataatagataattgaaggtcttctctgtaactctgtaacactccaataccaccttgttgtcagtgtaaacaagggcataacctgaaagcactgaggccactgacaacccatagcattcctatcaaacatccttaacccagcaagtttcctaacaggggatctaaatcttaattaccatacaaaggtcccaccagacataggaggagctcccttcaggacaggatatagatggttcctcccaggtgattaaggaaaaagacacaatgggtattcaggaaactcttatggaagcagagttaggaaaattgcccaataattggtctgctcaaatgtgcaagttgttttcactcagccaaatcttaaagtacttacagaatcaggaaggagccatctataccaattctaagttaatatggatggaatgaggttttattaatagcaaagaaaaattaaaatcccaaacttacaaggttttctactaacgtagagtttgctaaaagttaacagtgtaacatgcattatcctactaccacacactctcaaagcatttctcagacagtttgcaagaaataacaaaatctgtccagtaaggatagtaactacaatcccaaatagactcttcggcagcagtgactctccaaaactgctgaggcctagaccctcctcactgctgagaaaggaggactttgcaccttctttgggaaagagtgttgcttttacactaaccagtcagggatagtacgagatgccacgcagcatttacaggaaaaagcttctgatatcagacaatgcctttcaaactcttataccaacctctggagttgggcaatatggcttctcccctttctaggtcccatggcagccatcttgctattacttgccttcgggccctgtatttttaacctccttgtcaaatttgtttcctctagaatcaaggccatcaggctacagatggtcttacaaatggaaccccaaatgagctcaactaacaacttctatcaaggacccctggaccgacccactggccctttcattagcctaaagagttcccctctggaggacactacaacttcagggccccttctttgcccctatccagcgggaagtagctagagtggtcatcacccaattcccagcagcagttggggtgtcctgtttagaggggggattaagaggtgaagccagctgagcttctgggtcaggtggggacttggagaacttttctgtctagctaaaggtttgtaaatgcaccaatcagcgctctgtgtctagctaaaggtttgtaaatgcaccaatcagcactttgtaaaaacacaccaatctgcgctctgtgtctaactaaaggtttgtaaacgcaccgatcagcactctgtaaaaatggaccaatctgcgctctgtaaaatggaccaatcagtgctctgtaaaatggaccaatcagcaggacgtgggcagggccaaataagggaataaaagctggccacccgagctagcagcggcaacctgctcgggtccccttccacgctgtggaagctttgttctctcactcttcacaataaatcttgctgctgctcactctgggttcacactacctttatgagctgtaacactcactgtgaaggtttgcggcttcattcctgaagtcagcaagaccacgaacccaccgggaggaacaaataactccgcactacctttaagggccgtaacactcatggtgaaggtctgcagcttcactcctaaagtcagcgagaccacgaacccactggaaggacgaaactgcggacacatctgaacatctgaacaaactctggacacaccatctttaagaactgtaacactcactgtgagggtccgtggcttcattcttgaaatcagcgagaccaagaacccaccagaaggaataaattccagacacactactgtcttagagtgatctagccctggaacatgtagtgcttgtgggtctcatagcagtagttctcaaccatgatgctagagctcattggtgtatttcaatcaactggaaagagaagtggagttccaagattataccaggaaccaagcatagacatctaagctgtggccctgctgtcaaaatcagggctgagctctagctgagcacacatgaatgtgtgcagtggttgactcttaacattgttcacattctggtgcactcattataggaatgtcagagctacttataactgaatagccctattatacacttaggagtgctaggcgttctgagattataaactgggctctgagtgtatgtctgttaaaatatgtatggggctttcagtatttaaaaatagtcagtggtcatccacagagctacttgcagcttgaaacgtacattaggaattcccaaagtaaatgagttgtgataactaagcttgtagaagttctggaccttcctcttcatcaagtgagtagatatttatatatttatttatttatttatcaagataggatcttgctctgtcatccaaactggagtgcagtgtcctggtcatagctcactggagccttgagctctgaggcttaagtgattctctcacttcagcctcttgagtagctgagactacaggtgtgtaccactgcacctggcatttttttttttttagtagagttgaggtcttgctatgttgcccagtctgatcttgaacttctgagctcaagcagtcctcctgccttggcctcccaaagtgatgggattacaggtgtgagccactgcacctggcccaagtgggtagattcaacctaagtcaactcatggatccgttaaatgcagggattggattgattcatctctataatacagatgatctgtagtattccgtgattctgaaacacatgattctaactagagacagtgtgaaaagagacagaaaggtcaggagaatcctgggaaatggcccagaatttcaagggctggggcattctccagagcatacgtgctacccagatgctcctgtgcacatgaaccctggggatcttgttggatagaggatggggtctggggcaaggcccgtgaatctgcatttctaacaagctcccgggtaatgctgctggtgctgctctatggaccgctctgaggaacaaggtgagagcaagtgttgagactggagaaatgagatggtagaaagacagtatccctagagactggagaatccttctgagatgttgaaagggcacattgtactgtttgttttaatgacagtaggataatagcaagatctaaagcagagagaactttcccccagggacagaagtgtagaaggtaagaaatgttaaccaggaagcctgggctcagggccctggagagtgttctcagtcctagatgcaccattggaattgcctgggagttttaaaaagtgcccatgcctgggttccaatatccagagacaggattcagttggtctgcagtggggccctgactattgctaatttctaaatgctccttaagtgattcatccgtacagtcaggatggagagtttgggagggcagtgattttgctgattactttctcctaagtggctgcttcctctcccctccaggctgttctagccttactagcccaaggccactctaaggagcttgattgaacggtcatggcaggctgtgcccagattactgtatcaatgggctcttccagccaatgtgctgaatattctggtgaaatctctgagttttatgttgggaacatttttttctaccagttctacttggaatctgtcttcctttgggagagtcaaaggcaccctctgtctattctgctttcctgtttactatttcaaaactttctcccagttgctggaaacttggagccagagttatgcaacaaaatgttgccagctgggaccagaaccgaaatataaaattgttttttaactctgtgctgctcacaatatgtaaattatacttgggaggaaacttctggaaaggaatttttagtcatttagatctgtgcaaaattgactatcatattctacaggtatgcaatgccacaggtacacagagttcaatactctgcatctgaagtaggtctttagtttgagataacctgagaaggggagcccacagagagggcgagctcttccatgggagaggtcccgccatttttgatccattggagttaaatgcaagacgtaaatcatgatgtatcattcacgcatttgttcattccacagacactaaggatgtcttttgtgccaggtactgtgctgagacgggggacacagagtgactcagaccagcaggcctggtttctactctacagagctaggctaggtgggagaagcagacatcacgcaaaaacacacttaaataaatagaaaatcaaaaccatgagtagtgccaagcgggcacacacagggcatctgacttgggcccagcaggaggtcagggatgatctccacgcaaatgagacctctgaaccaaaacctaaaaaataagcaggagttaactaggcaagcaggataaggaaaaggattccaggtagaagaaagaccctgtgataggagggagtggggagagcccgagggacctgagaagtcaagaggatggaactgagtcgaagagaaacagcgctgccaaggtggctgcagagctaagcacataatgtggctaagcgcgcacacacacacacacacacacacacacacacacacgagcagggattctgcagccatggggccaaaataaatttaaaaattactctcaatgctcaagacacacacacacaccacacacacacacacacacggggagggactctacagccacaggactaaataaatgtaaaaattactctcagtgctcaagagacacaccacacacacacacacacacacacacacaccacacacgggcagggactctacagccatggggctaaataaatgtaaaaattactctcaatgctcaagtgtaattgtaattttttttttgagacgaggtgtcattctatttcccaggctagagtgcagtggcgcaatctcagctcactgcagcctcagccttttgataaggtgatcctcccacctcatcctcttgagtagctgggactacaggggtgcaccacttcacccagttaacttttgtattttttgtagagatagggtttctctgttttccaggctggtctcaaactcctgagctaagcaatttgcttgcttcggcctctcaaaatgctgggattacaggcatgagccactgagctggtcataacattcttaaatgcatttgtgtgagtgtgtgtaacatatcagaaggaaaataattagaaaggcttctccttgcacagccccgcaagggatgttctcagaatcaggtggagggctcaggacagccccgctaacgctggtcctggagttgctcttcgtgccctggccaggtcaagtggctttaaactcctagcctcttttcctcagaatcctatcaccttgcaatcccttccccctgccccaccctccccactggactcttttctaaactgtgcagtacgatctccaaacaccaagcagagagttcaaacttggcagcgacatcatttcctgagcactgcttctgaggaagagttcctacacacttcattcatttccccagttcatacacaaacgcatttacaaaatatgcttctttgtgaacgacacaaaccttctattggctttaagaaaacggatctacaacgaggctttatctgtgggctctttctgaacatggccatgcagacatgagacaaagtaacattgcagggccttttatgcgggtcctcaaagagggccccaccctggaaataaagaaatggccacagttgccctgtctctaatcggttcatggtattcagccttgacagcattgtccagcggctgaattcagccttggaggcctccatctgggttgcagggggagggggtgggggataggggtggggaatacagaagtttccgcaggctgtgtgaaaagtggcctcccaaccagctgcacagaccccctcgcctcttctggtcgttgctcccagaagccttctttcacttagtgatggaatccagcatacaaacaaggtcaaggagctttgtgagcgagagagtgacatttgcaaagggagcgaacccttcagctgggagcttgcaggagcagggctaaggggcatgtgatcaggaggtgatgtcacccaggatttccacaaaggaaaaagtggccttttctttgggaagatagatgacatcagcctctcaaatgggggctgggtccattttatcttccttttagctattaaggagatttctcaagccttgagaagtttcagaaattagaagagaacattttaaaaaccgtgtcaacatcttttatgactggctcggtttggatgtaagccagtgccttcttgactacctgtgggcatgaggcactgtaccaaagggcttttaaaaaacatctttagagcactggcagaaaaccgccatgaggtcggcagtgtttctcttaaagttagatctttgctccaggtctctttctctcgagtggtctttcattagcctttgtttatcactggtctttcgggggaattccttctcattcaaaaattttattccttttgtgacttagagtacatgtagtacgatttctgggaggttcaccctttaaagacaaaggttttatcttttgtaattctgttatccacttgtcttgtgtgagagaaaatgccttagggtgtgagggtgagtaagctgggctctaggagaagatctgctggacccagcctataatgaacaggcagctacaactgtgaatcatgttaattacatgattatttatatgtcaattacacataacctctgccagcagatattttttgagaagaagtttttcattcattcaaccaaccatccagcatatattttgggcttgttgtctaaatatagagagtattaatttgcttgggctgtcgtaacaaaaatgccacagattgggaggcttaagcagcagaagtgtgctgtctcctggaggctggaagtccaaggtcaaggtgtcggcagggttggtttctcctgaggcctctctccttggcttgcggatgctgccttttccctgtgtcctcacatggtgttttctctgtgtgtgttcatcctgatagctctgtgtgtccaaatttgctccttataaggacaccagtcagattggattacagtccattcagcttcattttaacttaattgcctctttttaaaggccctatccccgaggacagtcacattctgaggtctgggagttagaacttcaacatatgaattttggcagagatacaattcagcccataccagaaaggaaggagatcacattcttgactttggggagttagtcatagagtaggcaaggcaggtaaaccaagtgtagaaatatatacataatccaggacgccatgggaacacagaaaaaaatagctaggacagcctgcggaagttcaaagagacctccaggcagctttgacatttgaactgagttttaaagaatgggcaagaattgatcagacaaatatctgggagaggaaggcttttctaagtagaagcagcaaggtgtgagggcacaaaagttttgcaaagagcaagtccttcagctagaccacacattctctgcattctccattggggcagtatcaactccaaggaggtaaaattggctcttggtagggggattaagaaattcttactctttaatgtataaagcataaagatatacagtacataacagatatgcaatatacttgtggtattaaattttcatggttgagaatttggaaaaaaatgtccgaacaatctccttagggggctgataatgaacaaaaggtgagaaacactagggaaagggagtgatagaagttgacgcaggacacgttatcagaaaccaactgataggaaacatcacaagaatttggattttatcctgccatcagggaaagaccaccaatggatttttaagtgggaaatttagtgatgcaaacagaagtacactttagaataagagttctggcaagtagagggatgcccaagaagaggaagagactgagagtttggtgactagtcagagcagggagaaaggaaatgagtagtgggtgaggcagcgtattaaagagctgtttagggctgggtgcagtggctcacacctataatcccagcacttcgggaggccaaggcaggtggaccatgaggtcaggagtttgagactggcctggcccaccccatctctactaaaaattcaaaaattagccagctgtggtggtgcgtgcctgtaatcctagctactcaggaggctgaggcaggagaatagcttgaaactgggaggcagaggttgcagtgagccaagatggcaccactgcgctccagcctgggcaatagagtgagattctgctaaaaaaaaaaaaaaagagctatttagaaggtaggatgggcagatctgatggtggagtagatgtgtgtcaatctgggagacagaagaaggaatcatggatagctcccgttttcctgcggtgtatgatttggtgcatggtggtgccattattcatagataggaaatcccagataaagaccatgtttgggggaaaattgtgagcttctatttgaacatgctgaatttgagatgttcaggggatgtatcctttcagcaattgctggtgtcagtataaaaattaggtgaggttttgggccagagaaagagactttggaataaactacatgttggtgaatttggagttgtgagcatgatgaaatatatatccaaaactgtgcaaggtatttttaggcatatgaaagaaataccacgttagtctttgtcttcaagctgagcatgatcagttaggaagcaggtgtagaaaactaacagaagtgctgaactgtgaggtgcctattgcaaggctagtaaggaggctggaagtcattggggaaaatcttcacggactctgtgagattttagagcccttgaagaatgatcaggacaagaaatgacagatggtgcctggataagcatgagccaagaaagagagagaaacaagcctgatgtaatgaagacagtgggatatgaggcttcgtagacctcctgggctagattctttagaattctcaaagccagctagactagtgtgaacttaacgtagtaaggaaaagggaaccactgttgttttagacaatggagtgggaaatgtcaagggaggagattacaactggagacatcatagatcacagtgacagaggcaaccccaggggaccattctgggtcctggttactaagagcgaggaatagcggtctgcagagacaagacaactgatgatccaaggtgagtaacattctgatgaatcctcagcaaagacactcaagggctatgtggccagtgctgtgataaatcctggcacagaaaatattagatcaattgccgcattctctcttcctaataatttcttcaaagttataactttgaaatacagactcatgattacctaagttttccagtttgaaaatgattttagggctcttttttgttattgaacaaaaaacttttgttgaacgaaaaaattttattgaacaaaaaatgttcaatttaaaatttttattattgtgtgtccttgctgccacgtggtgaaaaaattcacaacaatctggaagtatgatgttggcaatgaaagtgatttatgaattgtggtcagcaaagattctagcgcaggttcacagggctgggctgtgaatcacactgtctggttctaatctcaggcgcagaccttctctccgttggtaatggaattgctttcacagtgtcgcttcctgctaggctgtgatagacataatgtcacacagagagaaatggtaaagcacccatccatccgcctccaaagtaacctcaagaatttgatgtcagataaggaaatcctgcttggttttggtagaaatttaagtaaaagagaagcttttaaaaacaactagctctgtttaagttaagagatatttccctaaatgctgactattctttctctcacatttatacatgctatatcccatcctgtttatgatggctttttcagcctatttgatattttgggcttttgtctttgtgatactcttaaaatatttttaagcatggagactggaaatgagttccttcttagtgtggaaccaaagcacaggtttctgcatcgtgatactgagtctgatttgtatttatgacaaattttcacttatatcttttctgcaaagaaattcttaatggacgatgctcatttctaagaaatctgtttctaaataactccttgttgtaaagttgggatagtgactaagaaaatcccacagctcttttggccttgacttcagagtttctccagcaaggtcccaatgatcagaggcagcattaaagctgtgcatatgcagacctttcagaatgagtggaaaagctcactcctgacatttctgcctccttgacgacagcagtaaatacacatccacacagttgaccttcatctcatgttggctctgagtctcttcaccagcaagggcctctcaggagtctcgcctccccattcccatgtcgccactgtttgaaaaagttggagttctatttctattgccactctttgaaacagttataaaaagaaaaaaaaataaccctcaaaccaccatgaccttcccaaatcacagattgcacaatttgtaataacagtccttgagatctgggccaaagaaagggctttctcgaaacttctgtttgtgttctggttccctggcaacaatatccccaatagaggaatgcatgtactttgcaggggattccacactttttcgtatgacacaaaaaccaaaaccacacttttttttttcagtttcaaatatcatagcagccaaaaatgaagtgtagaaacttgagttctaagccaactcagaacaaatgtgacgttcagcgtagaacctgaatttttgtccccagaggtttctcttttcgaccattgacttaaatgttgccatatttgtttcaaacattacatatccaaggacttgttttgtgtgaatgcactgtgtactcagaggaacagaggaagcagtgccaggtggcagcagcattgtctcacaaacagaacaaatctggtggaggacagtaactaccacttataagagttagtagaatttgataatctgtagatcagtaatgacaataatatactctgtccctgatttttttctcctcctagttccacaggctactcaaatatagactattttgaccctgtgtaccaaaataatgaaattgaaggaatgcaggataaataatatagattttaccacctaaatgtaatcttaaatttgtctgaagatattatgataaaaataaactatcttgccatgtaaagagtgaatgaaaatatgattaaacgcttagtgcattggtttaattgacatctcattcactattactgttgttgatgttatcattttaaaacatgactcaacatgtgtaatttaaaaatatgatcttgagaagtgaagccagctggacttcctgggtccagtggggactcggagaacttttctgtctagcttgaagcattgtaaatgcgccagtcggcgctctgtggctagctaaaagtttgtaaatgcaccaatcagcactctgtaaaaacagaccaatcagcaccctgtaaaacggaccaatcagcactctgtaaagtggaccaaccagcgctctgtaaaatggaccaatcagcaggatgtgggcggggccaaataagggaataaaagctggcctcctgcgcaccagtggcaatccactggggttgccctgcacgctgtggaagctttgttcttttgctcttcacaataaatcttgctgctgctcactctttgggtccgcactacgtttatgagctgtaacactcactccaaaggtctccaccttcactcctgaagccagcgagaccagaaacccaccgggaagaatgaacaactctgcacacaccacctttaagagctgtaacactcactgtgaaggtctgcagcttgacacctgaagtcagcaagatcacgaacgcaccagaaggaagaaactccggacacatctgaacatttgaaggagcaaactccggacacaccatctttaagaactgtaacactcactgttcaggtccgtggcttcattcttgaagtcagcgagaccaagaacccaccggaagaaaccaattccgaacacaatctcatgtctcatcccaataattttcttaaatgagcattatcattcccttattatggatgagaaaactgaggaagaagcctgagacaagttaagtgatgtgtccaaacttacacatccactaagcaatggaatcagaacacaaaactcagtgtgtgatgtcaaactcaaaggccgtgcaataagtagcacgatggtgcctgaaagcaaatattttttccccacagcttttcattgcaaaaaaaggtcaaatgatattgcaatgcaaagaaggtcagagcttatagtaggtaattttataaattcccgtaataataaatgtttttaaaaagatgtgtgcaatcttacccaagtaaatggtgatccagtttcaaaggcttcccactaagtgacacaattcattctttctttaggttcaagtagcaataatatgtgggttggggcggaggggcgcattgctaggcaaaagacaagttcgaaatagctgatgttatttgcaatccttaaacacaatttctgctttattactcatttataaagtgctgttctggagctgctatatatgttgctgatggaatccaccgatctgggagaaaccacggagatcatctggtcagttgccaaggtttagttatacaaactcgcttacaagagggagaagttatattaaagtgaagagtaaaagggtagctgctcccagaacaacttggccgggctagagtggaccatgggaatggggtggagcatgtgaggatttgggtaatttagttgtttttcttcccctaagctaaggacccaggctggctggatgcaggatttgccctgcgaggggcctgcagcatgggatgttgtaatcagagaaaacaaccttgaggctcagatttggacagagtttaaagggtcacagaacaccactgccatggacgtggtgctgcccacctgtgtccatttctccgggtggagtcctctccctgcagagggaaggttagaggttggaggaggtgagggaaggaatcagggagaggcctgcaatgtaggtccctggaggctctttgagcttttccctgcaagagccctgtgtaccaaaataatgaaattgaaggaatgcaggtttgaataatatttctaaatagaagtatgactgttgaacttggaaactgcctacagagaacatgttttctctgtctttgtttgtttgagggatttcataaagaagctttcagtagccttaggcatgactgcttatttcagggaaggttagtacagttatcttagtctcatttctttccttgtacctttttatactaaactttgtttagaagtcttcaatcatttcaaaaacatccaaggagagggaaaagagattgatcaaatgattgatttctcctgaagaattgtaagcaagggatttctactgggaaaccattttttaatttgattgaaattagtagcttaaaaggaaactgataaagttaatcaaagtgaaaagatgacaagattggctaacttctctaggttaagacgaaagatagtatccttttgtatacaggaaattaaaatttatattacacagaaactccaaaattatggcttctttggatttctttctctttgatgatgtactaaagggaaacacatcagtatttagatctaggccatcttagatagtcagatggctatgacagtcttaactttgagtatttatatgacatcttgaataggaatgtaaaggtcattatatagcggtccacagcattgatttctaagcttcttgtatctgttttccaagtcactgacttcatgcaataacttattctttcactgttttttattgtatctctaccattgaaacccgatgctctactttatatccactgctgtatagaaattagtcgaataaaatggattatcacaaaatatggggcaaggatgaagtctccatggaacatgaaactttctaaacgttcattgactctccaacactaaaaatcgttatgacttaactccctggttcttgggtttacctgtttcttcctgatgtgatacctggccctgtatttgctgctagttttctcaacaatagaccttttctgttttcatgaaaatcttacccttgaccaaccatcctctaaacctcaagatgacaaataggaagtaataattacaagatggaatacagaaagtttacaaatgtgcactccttgaataccacacaaatagttgttaccattttgtacctacctgggagtttggccacctcaattatcagggaaagaatgaggatacattagcttcttagggctactgtaactaagtaccacaaactgggtggcatgggacaacagaaatttgttctctttattctggaggctggaattccaaagtcaaggtgttggcagggtcatccctctgacggctctagggaagacccttccttgctgcttctagcttctgttgattgatggctgtctttggctttctaagccttgtagatgcataactccaatttctgcctctatccacacatgaccttcttccttcttggtgtctgggaccaaatttccctcttcgtataaggataccaagaatattggatttcagttccaccccaatccagtatgatctcattttaacttgactgcatctgccaaggccctttcctccaaaaaggtcacagtcacaggttcctggtaggcataagtctcgggggacagtgttcaacccaatacagggacaactctctcctctcctggagtcacgatgttttgtcctcttcttccttttcactctcttctttcttccttcttttttctcaaggaaattttatgttccttggcctttatattacttgattttcttctttgatttcatctcgtgatcactccagtttgtgtccccttcctcacagaatacatgctatctgactaaatccctcagaaaaatccatctgcacatgcttcatgtccttatgaatttgaggagctccacccttggccttgtgttcagagaggactagtgaccctagtaggacagatgcctatcacttggccacatacctgtgaaatgttggggaattaactggtaacatcaaaccaggaattactgactttttgtggttctcattacatgccagtcacctttggacaactttggccattttaaggagcacatattcctgtccacttccccaccctccctgacctgaaagtttctgttcaaaatccttgtaattacgtttttttatgtttcatagatgtatcggaagtgaggcctgtatactcactccaggaaatagttcactttgccttgggttgggccttccccagattctgagctcttagttaccaattcacatcacacctgccttaccaaaagggtccttgctggcagtttctcttctgtgtcctcccttcctccacaagctgcctttttttttttttttttagatggagtctcactctgttgccaggctggagtgcagtggtgtgatctcagctcactgcaacctccacttcttgggttcaagtgattctcctgcctcagcctcctgagtagctgggactacaggtgcctgccaccacgcccagctaattttttatatttttaatagagacagggtttcaccatgtttgccaggatggtctcgatctccagaccttgtgatcggcctgcctttgcctccctaagtgctgggattacaggcatgagccactgcgcccagcccacaagccgcctttttacacaatgaaggcaaactggccttgccaatgaagcacatctcaaggtcttatagagcagaaagagtttttattgttaagttatagaaaaaaagctattaaaatataaattgagcattttaatgaagcacgtgaacatcctcactaattacttttaaaatttaattctctttcactgtgccttggcttttggcttcgttttaacagcaactgttgatttcccaggcatttcctttaggaatgaagggataagggtgggagggtgtcggtgatgaatcacttctctcttccttttctgccatcctctttgggctttagccatgtgtatttcaagatgttattcctcctgatgccatcagtttatggcatatagtttcaggaaaatgccagccagcaaagcgctgactgcatttgagcagtcgccgggcaatacagcatttactttttaaattttgtgccttggattccatttagctgtttcattactggtttgcttttattaaagctcttataaaaaaaacacacagatacgaacttaaagatagtacctacataggagattattattaaatgtttcagtactggaattttataactcatggcttgttttggacaaaaaccaaaacaatattagtgaagttcttttatgaaggtattttaagttatctacacaagtaagcaggtttagcaacagcttgtaactcttggttgttatgagttcagcagatcaatgtgcttcctgcagataaagcaagcacttcctttcggcagatgagtgagagtttggaggaaaatcaaggcaaacagatgatcagtcaccagctctaaaacttttataaagattaactctttaaaactgaaaaacataggcttctcttcagggcattattttattccagttcagctgatgtctaatgatgtattctgttagattttgcctcaaagtcaattaaaagatttttgctttgtttacgttttccaggttgctatggtgattgtctttagtggagggacaggacagtaatgagggcagcattcaacattgttagttccgtgcctttgagctgaagttctcggcaaggcatgggggagagagaacacagaagtggaggtcaggatcggggagggtgggtgtcacaatagggttttgtacccacatctgccattcactaagtgatatgagcatgttccacagctttcttgaacctcactttgctcacctctacaatgggcctgacatcattgttacctgcctcccgttgtcatgattaatttcaaataaaataatgcatttcaaataaaaataattcaaataaaataaaagcacttgagaactgaactaccataaaaatatggattgtcttttaaaaaatttttgtgcaccttaatgaaaaaccaatttcttacctcttctctagctattcatgatagctttttaaccagtaattcctcttctagctccaagtctttgtctcaaatctggggataaagtcttgtgaggatacaaaacacggccaggtgtggtggctcatacctgtaatcccagcactttgggagggaaaggtggatcacttgagcctaggagttcaagaccagcctgggcaatatagcaagatcctgtttcaaaagaaaagagtaaaaaaaaaatgtaaagatagaatacacagcatgtgtgaaaggattatgatatgcacaacatttagctaaaaactttggattgtttcattcattctatgtaacaaccctatgaagtaagtattcatacagctatagatgaaagaaaggttagattacttacctaggaactatcacagccagtttaggaacccatttgtctgaactacagcccatgcttcctctgttacactataatgtttccaaaagttttgcaatctaacatgccaattaagcagttctaaaatcgtgtctactccatgaaaactttctcttaccaaagtgacaaagagccactgtgtctatttctctcaaaactctttattcctcatgtcactgttcctttcttggttggtattttcatctttttcatttttgagacggggtcttgctctgtcgcccaggctggagagcagtgctgtgatctcggctcaatgcgacttccacctcctgggttcaagcaattctcctgcctcagtctcctgaatagttgagattacaggcgcataccaccacgcccagctaatttttgcatttttagtagagacagggtttcaccatgttgggacaggctggtctcgaactcatgacctcaggtgatctgcccaccttggtctcctaaagtgttgggattacaggtgtgaactaccacgcctggctggtattttcatcttttaaattatcttcttttatcttcttttgaaaggcttttctaaatcattgtcatctattttagattatgaatgaccggtgttaaaaacttctgtatttcttttacattttattgttcattcaaccagacaggtaaccggatgacgacaaggatgttggtggtctaaacatccctgcctgtgttatttcctgatgggtattggtttatataacttctttcctctccagacttgtgtattctccatctctttttcccttccctgtttgttatccctttgtcatgcatccagagtcgcaaatatgactggtaatggcaggatgagttatttattcttatttgtaacttaccagtgattaacatgtaaaggatagaatagtattcaggttgttttcttcaaataaaaacttattgaaattactcttagtaaactgaaggagaagcaaaaagggtttaataacttgcaagaagacatgtgggcaataacactttttatgtctataaatgtctttctttttttcaagagatattaaatatgcttggcttctatagcactgcttgtattatgggcagatgctcaataaacacttatgagtgaatgaaggaataaataaatggaactgggaagctattttacctctttcaaattttagaaatacgaagacagttaagtttctaccgtaattaccagaattacaacgtgcaggtttgttacatatgtatgcatatgccatgttggtgtgctgcaccctcctagtactgtataattttgaccagaaagtaccactaaattaatctatcctattttgcatttgctgtgaacttttaattcaaatgtttccttttgatatgttaatcctcagaggtagtgagagcatgaaggagaaaaagaaaacttcagagatttcaagccctaactgtttctttccctctttctcatgatcatacaatatttttcctgacagagtatcactgataaaattgaaatttctcagctgggcatggtggctcacacctgtaatcccagcactttgggaggccaaggcgggtggatcacctaaggtcaggagttcgagacaagcctggccaacatggtgatgaaaccccatctctactaaaaaaaaaaaaagaaaagaaaaagaaatttttctttaagaagcatacatatatgtgctattaacaagatatacttaaaagtaaaattttgctctttttattaaagaaaaccttgtggattatttgctttaaatactaggaaaaaagacattgtgggtccatataactatactgtaatttttttaaagcattactgaatgccccgaatctgtattaccattccagtttacagcgacaatttaagggtattagtatcctgttatttgcgaaggaattcacaaggaaacgtaaaacaattggaaaagacaatggaaaaatgttacacagagttttatgtgaatcaactaagataaaaaaattgaatcagattggctgatgaacgaatgctaaataaaaatgcagaaatgagctatctaaactttcatttccttcttatcttttatatcatgtggccataaagttattttcctctagattttttccattggataatttatttgatactactgatagaaagaaccatctgagctgaaaatgcaagttgagaaaaaaatttcagtaacaggctttgcttacctgtaatgtattttagtaaaaggtggtacatcttaacacgagttacatgaggcactgtgttgtaccactccggaagcatcctgttatagaatgtcctgtgagcggtgctccctggagttgggcattggtacaggagatacggacaatctgtgatgattttggcttcaggaatatttgccatgtgttgttgtagtcggacaaatattttctcatcttttacggtacttgtgtttttttaagattcatcatagtctctaaacaatgtcagcacatctaattttaaacagctttttcgtaggctttagaaataaaagccggaactttttaggacacaggaaagatattgctctgtgcaatacatttaaagtctgaaaacgcagaggttttcaagtgaaaggagactgagaagtcaagaagatagtagtgctttgagctagagtcagatttctctgccgaatcaagattcttagaattctcagtgcttctcagtgcagtggggaattctgcacggagattttttttttaactccttaacttttaaaagcttttcttctaactcactgtacaggaggaatttgcatagagtggacagtagacaagatctcagacttggtgtcttactttagaagccatggtagtttaatgttatgtgaaaaatgcacgtttactcataatggagtgaggaggcactgttacttttattttattttttattattatactttaagttctagggtacatgtgcacaatgtgcaggtttgtcacatatgtatgcatgtgccatgttggtgtgctgcacccattaactcgtcatttacattaggtattcctcctaatgctatccctccccccttcccccaccccatgacagaccttggtgtgtgatgttccccaccctgtgtccaagtgttctcattgttgaattcccacctatgagtgagaacatgtggtgtttggttttctgtccttgtgacagtttgctcagaatgatggtttccagcttcatccatgtccctaaaaaggatatgaactcatcattttttatggctgcatagtattccatggtgtatatgtgccacattttcttaatccggtctatcattgttggacatttgggttggttccaagtctttgctcttgtgaatagtgcgggaataaacatacatgtgcatgtgtctttatagcagcatgatttatattcctttgggtatatacccagtaatgggatggctgggtcaaatggtatttgtagttctagatccctgaggaattgccacactgacttccacaatggttgaactagtttacagtcccaccaacagtgtaaaagtgttcctatttctccacatcctctccagcacttgttgtttcctgactttttaatgatcgcacataaaaagccttgatgaagaataagagaaggtaattggaagaatttaccaaccaataaagaatattaaaaaaaaaaaaaaaaagaaaaagaggcccagaaatgttaagagcaaaaaatgttttgttaatcaccaaaaattgctgttggaaaacaagataatttcttttctaattgtgtctctcataagccttcctcaaattttacctcttctgcaaagttttctcttcctctccatactgaaatctctgtctgaattcctgcaaacgatttgagagcctgtgtggtatagtaatgaagtattaagatacaaccagatcacctcagttagtatcctagcatcaattaaccttggaaaatccacaccacctctgtttgcactgatttgctcatttaagaattggatcctaacagtacctacctcatgtggtccttatgagtacggaaacagaaaacacatggaaagcccatatgaggactcaatgaaaggtggcattattctactgtgtgccgcaggctacagcatttgattatttgttgtcatggtctgcctgaatggctttctaaggcatgacatatcaagattctgaaacacatgctgttgtctttttccttggttggatttttctatatccattgtatttttttaatgtaaatttgctgagttaggaactatataatttacttgtttatttcttacagtctttggtacaaagctaaggatttttagcccttaaaattctagttcttagatctgcacgggactgcagaataatgtattagctacaaggacactgaaggcccagggacctgaagttcacgaccacggctcacacggtccattgtacttccgactatgttatgtaattcttaccttattataataaagaaaatctaaaattagaatgacttttttttaaagtacgaaggtttgatatggtaagaaaaaggatcgagcattattgtactaaattatatataatccagtgtttttgaaaggataaacttaataagttgtagccatgatttttttctcattgttttataactgcataattataactttattgtaacttaacggttttctcctaaattaagcattgtatatttttgatggcctttcggtgagttgaatttggaattattttccacgggctgttgcccactttgaactgactgaacctttctgttttaacaggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggaggtaggaagtgagatggttttttcagcacattccaaagtttggggtagaacaggaaatcactctgccaagattccgaattctttccagtagtcagcagtgttctattcttagacattttaatgagcatcagcccttcggtgatcatttggtagacatgggattaatgtgtggtttgggttttcctgaagcaatgcctgagggccttgcagcagctgagttaggaggtaatgccaggaagccggagcccaggacgagtgagtgaaggaaaggaggagggggaaccagcagagggagcccctgggggcaacttgggctccatccgctgggaccttctgaaggaccacagtggaggcactggtccgccaactctggttcccattggtaaggactgcacttgggatggctaacacctcacacttgcagtctgagaaagctcccccagaaagagcattcgtgtggcggagcatagagactgggcactgccaacaagcacagggacggcctaccagggctgccgctgctcttcaaggggccgccagggccatctgccgcagagcgcttttgtaaaaaaatggccacctaggtagcatgaggcatttgaagatgaaaattttcccagcacttctgcgaagggtgtgtcttggatcattaaaacagtctttgagaatcttgagcccaaaagtttattataatcaatgtttaattgcaggaatttagtcattagaatatgtgtgtgtgtgtgtgtatatatatatatattttaaatatatagctttaaaatattttgttgtagtttataaaattatataattcattataattatataatgtactatatagttacattatttatgtaatattcttatataattttataacatatatagatatgtcccagatatatgtaatatattatgtagtatattatatacttacactataaattataataattaatcattacaataattaatatttattataacagattattatattatatattttaatgtaagtatataatacactacatattatgtaatatgttatatatagttacatgtatgtaacacatttattatgtatactttgaactttgacctgtctgcaaactttaatatcttccaaatacacacaaaaatcctgtgacctcagctctagggactgctgtagcacagcatgacaaggattctatatccagtagaacctaaattccatgaggctagatgtttgtttgctttgttttactgctatattcccagctccacagagtacctggcaaagagtaaacactcaatagatgtttgtggaatgaatgaaagcatcaacgtctctgattgtcacaccataataatgcacatttagggcactgtacagaggaatttttacctccatgttctcatttaaacattaaatcgttccatgaggtaagaggggaattttattcccattttacagtggtcaaaactaacgctcaaaaaggttaatgggcttttccatgaccacatggaaggggagtggaagagctaataactgaagccagtcactgctcaacactccagtaaatcctgagaccatagatgggtgcagggtgcaaggggtcgatacgaatagtatggacgttacaggaaactttaacaaaaactttaattataaaacaagttcttaccttgaaaagaaatggaattatcccctcagtgagagtcactaggaattacttttagtaattcatcacttttagtaatttagtaaagtcatccttctcagtgagagtcacaaggaattacttttagtggctctaaaagacttaccatttctatctctgatttcatttactgtagctctacagacaatttactattgtaattgtaaatgaaatcagatagaactggaaagtcttcacggaaggactgttgccaagtcatgactccatctcagaggagaaacaaggtgcctcctgaaattcacactcacagcacaaagtaggactagcatccatgtgcagaatgttcagatggcctcgctcgcctgcaaggatattgcttggttgcataagaccccttatcacttacaaagggctggaggtggatcttccacagctatgtgcaatgttccaaaccctttattttcatactccaaagtgcatgtgattgttgcccacttggcaaattataaatgggccaattgtgtttcgggttgtgtcatacccattacgggagaaagtagagacaggggctgttccctacaagcaggcctggggcctcagggacgaaatcagggactccaggcagaagcggctttcaaggagagccctatgcctgacagaaatggctgtgagaagacgcacagtctgcttggggcttatttttattatgacaagctgacattgcagtggcctcccgtgttccaccaaaagcagggtttgggggactgttctgaggctcttaaatatttggggaaagtttttttctgaaagctaaaaggagcaaccctctgacattttgttcaaaagccttgttttgcttttctgcaaatgttcatttggaaaacgctgtaataaaattgggctaatggtggtggaatggtttttttcacccctccctagctgctgataacatgttagtagtgggtttaaaagtttgttacccatgatgggcatgtgatctaaaaactttgctgactttctcagcctgcatgtgagtgtagtcaagtggggccttacagccactaagtattgggcttacctgggtttcacaaaatttattcagaagccatttttcccttgaaaaatcagagtccggaaagtggcccattgcaaaaagcagcagctgtttggttactcataaccccggaatgctgacttgattgtaacaataaatggagctaacagagcagaaagaaatgttcaaaacagattaaaaccataggctttgaaatgtcctccatcctgagcatttgctaaaacacatttttaaatctctgatcatcagaccacttctttttcccccaaagtttagtcatatgctgtagttgaatgaaccatgccctgaaattctttccatctttttcttcttttgaagagtcatgtactatcggttttatttgtggaagccagaaggaccattgtttcggtcatggaaacactctgcctgattttactttaatctctgagaaagtctttagagagattctgaactggcattaggcagaaaaggaaatccactccttggagcagtaaaccaggacaattgcttggtgtggacagttacctcagtctggcctctctgcgataggcttttgtgagctcagccttgcaagaagggaagtaaataatgtccaaagtggcagtgtttattcttctagaggcttctgggtccagccaactcatacccattatgtttgtgatctcaaggggatgtttgagcagagaaaacaaagaatattttgccgacgtgcgagttttctttgttagaacttaacacttggcgttcagtggtctttccaaatatgtgctgttgattgggcttgggtgattgggagcacatgctgtcagtttcatgctgtggggactgtgccctaggcgagggggtagggagatcttgaaaatgggaaagaaagctggctctacacaccatgcaagcttgcttctgccatttgcatatgtgtacgtgtcaggggccacacagggctcttcctaaagccctgcttttgatgggacttggggggagtgcacaaacatcagctcctcctaataaaaataagcctgaagcagtcggtatgcttcattcctttgcaattactgtccttgtgctcagccctctgtgtaacagccgtttcattcattttggcctttaccggatggctggggggaattaatcagacaaagaaatcattatagattcaaatcacacactcctccccaaagtaggcttcttgttctcactccctctccccagagaacacttgagtgattttcctatcagtcagcagtgggtcctgagggtgggcaagggccgggggtgctgaggaatgggggcagagtgtcccgaggtgggggaaaggcacagagggagggtgggagggcgctgtgcccagatccccctgagagccgccttcctggctctggtcctgagtgcctgtacatggatggctgcagttgcagttatgaaggtctcagataccaactctttgaaaactgtctcccaaagatggtctttcttttacaaatcgaagtttgaaaagacctgaagatgaggagtcagcatcttctatttgattcccatcctgccttcgccaccctccccagccccacacatacacacaggagataaacaggacccagaggagactgagaaacctgtctgtgaggcctcctggaggcctggcctaggctctccttgcctgcaagatgccctccgtgagcccaaggagactctttccagaggactatgtcactggggtattggattccagtcagacagacagtttgggagatttggaggagcctacgtggtctgaagtcatgtgtgatagatctagaagtgaaacaagagagttccctgaccaccccgtcgcaggacctgtgacaggggtgtggcacatctgttcggctgtggtgccctcaaaccccttatgggagggggagcatgcagattggcaggtgcaggaacccaggcaagatgctacccacagtacggtctagtggtgggtgcctgtgactctcaaagcccccatgggcaggctacagtattcttttagctctgccatccacagagggctcaagtgttaaccagctcagtgactcttggtacccgacttcctgtctggcatccaggaagaatcaggtcacacacggacttgaaggatggtgaatgtggggattttattgggcgatggaggtagctgtcattggaatggatggggaactggaaaggggatggagtgtgaagatgatcttccccatagagtttcgctgtgctgtggatgatcaactgtctgaccatccccggccaaactcctctcaacgttcagatgctccttctctctccttctctgccacgttgttcttctcctcctctgctcttctattcatctgcccatctgctcgtggagcctggagttggaggtttatatgggtacaggagatggggacgtggcaggccaaaaggcaacatctgggtgtggaaacaagaatgcctgttcccgtttagggccgtgggtttccaggcttggggatggggcctttgccagggaacctccctcttctacccagtgtttccctgtctgctgtctatatcagaaggagccatctggagactaaggcagagtctagggcaatccctgagcagaaaagtgggatgcacttagtcaggttcctgggcatgggcgtgctgggagcaggcacagggagggtgcatagcatccccttccttaggctccaaaacacacccagagagctggtatttccactcctcctaaagaagcatacgtgttatattcaatgtgtggtcttagaaaacattcagtttgcagggtaggtggaaattcctaaaaatataactgggatattggtagccttcagtgaactcaactttcataacaaaatggctttatgctaagactaatcatatgtgccagagttagaaaatcagacatttctttttttaaaggtccccctaaaattcagaaaatcgacttaatattgtatgatctgtaatgtttctgctagagaaagcaggaaagcccacaaagacatgaaaaagacaaaaagaggagatagggaagattctggaataatctactccgtcctcctctgcaattctggctgatgaaacaagcaggcattttatgggtgattgaacttgtgtgttcctaaggcacagggagtgcctttgaaaactcagctcaagtttatagtgcatccccacccagggaggctgagatttcaatctccaataatcatagaacccaaggagccgggggtcaaaatgagccagagcaagggcctgtaattgcttaaaatattttttaaagtcttttttcctacatcccatgttagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggtgagtgagaaaaggaggtttcctaaagtacttaagccgagccctcgttaaatttcatgaaatgcttgggaaaacgtatgaaggctacacactgataacttagtgacatcccaaagggcagcctactgagacctgacatatacccttccctaaaatacgtgataaagtttaacttcctaagggtcaccacatatgtgaaagcaagaatgtaagtgtgtaagtccatggtgagagcagaactagggtgataggccagacccactctccaagggctcatacctcttaaccagcctccatacctcatgccatagtacagacctttagattcttggcaaatatcaaacttgcaaacattaaatttgtgaatcccaaggaattactgtgtgttctatggtgactttctgcccaagattttaggtagtctaaataaattgcctgttgtatatttttaaactataacaaaaatctatggcacaaaatagtgtaacagatgttagcatatgcaactactagagatagccacatttgcagaatgcttactgtgtactaggcacttttctaactattttatgaggattatctctagtccttacaaccaccctgtgagggaagtccgcttcatatcctcatcttaccagtgtggacactgaagcttagaaaggttagtggcttgcccaaagttccacagctagaaaacgtcaaagcacatatgtgattccagactacgttatggccacacttcttcaactctatcataaccaaggtatctatataagagctctcccctaaagttaattatgtaggaatttaaataaacacacacacacacacagacacacacatttagtgtttagattacccctgaatgattctccattattagaaaatagtgccaaagttttctattattggcttatattatcataaatccaagaaatggtgggtcatagagaagacattgaactaacaggtatttgataacatcaaaggaatttttaaaaacctaagtaactgtactatatccgaatattaaatttttaaagggtagatattaaattatttttaaatgcatgcactactagattatcacaattctggaaggaaacatattattcttccagtatgctatatttttagaggacaatgaagaagcagcattccatggctttgtgaaaacgtgatttcatttgcgtttccttttaattatttttaaaataaattttggcatctgtatttaaagtgtttgaagtattctcttagtatcatccatgtcatcccttcttattctgttgggataaatggcttaatgtggatatcaaattcttcagtgtttttagcatcgactaactgattcaagcaaagtaatgtattgatctatacaaccaggtaatggattattttcgagcatccatgattcctctcatgaaataattgtgttccccacttccaggttgtggtgggattttccaggctcccagtggagagatacattctccaaattaccccagtccttataggagcaacacagactgttcttgggtcattcgggttgacagaaatcatcgtgttctcttgaacttcactgactttgatcttgaatcacaagactcttgtattatggtaagtgacataaatttcaagcattgtctccagtcaaacctcggtcaaaacactgccatataagcatatttagtgaatatattacttatgggtgtttttaatgtcgaatcataggaaaccaaactattggcaacttaaaatataaggacatttattttttacctaaaaacaaatcaggaagtagataatctctaggttttttagcaagtcagtttctgcgctaccattattagcctgttggcttttcattttgttgttacttcatggtcaaaaaatggctgcagtggtttttatctgaatgtcctacctgagtctacctctgaaaaaaggaagaagcaatagtgttaactatttctgttttgtttgtgtttcttttaataaggaaagcaaattttccaaaaaagcccctgatatatcattagccagaactgactacaaaagagatccagaaagtatcgtggaatagatttatcataaatgttttagatcaattattattattaagcatctgggattttcacaggattctgcttctcttgagacaaggatatcttgatttgctacttgaacaaatccatgttctgatagaacaggttgggagatgggagtggaggagaaggaatatggctatgaattggtcagatgacaaaaagagtttctgctactgagatgggaaagtttcctggactcctttacaggacttgcgaagggggtggcttatttgcttggctgcctagctgaattcaggagggagcacacgaatagacgaatgcaggaaccggggtgaacgaaccctagaactggctggtccctcctctctggtggaagcaggctctgtgcacggcccacggcagcgtccaagcttcttacaatgctcttttagctctgccatctcggagagggtgtctgcgaccccaagagccccaaagggcatgtgttgcaatcagtgctcttttagcatttgccgtccatggacagctaagtgttaaccagctcagtggagggtcagggtgacagccttttacaccctgacctcttgggtacccaagttcttgtccagtgtccaggaagaatcaggtcacacgaacaaattgaagggtggtgaatgtggataactttattaagaggtagaagtggctctcagcaggaaggcgagcttgaaagaggttggaggaagtgggttgcaggagtctggccttccttggctgaactcctctctgaccatagtctccgatgtccagctccttcttctcctcttgacgttcagacacttctctcttctgtgtgtgtgtgtgtgtgtgtgtgtgtgtgtgtgtgtgtgtctgctgagtctggggcttggagttcttatgggcaccagatgggcgcagggcaggccaaaaggcaacatttgggtgggaaaacagggatggttctcactttgagtggcagatccaggcttgagggtggagcactcaccagggacctcaacctcttctaccaagcattttcctgccttctggcccatcactactaccaacacttttaatgaattcctacctgaaactaatgctttgcgcttcatataagagtgaatgaagttctattttgaagggtttttttttctttctgtttttaaattttttggctacctaattttcttttattattgttattattattatactttaagttctgggatacatgtgtagaagctgcaggtttgttacataggtatacacgtgccatggtggtttgctgcactcatcaacccgtcatctacataaggtatttctcctaatgctatccctcccttagccccccacccctcgacaggcaccggtgtgtgatgttcccctccctgtgtccatgcgttctcattgttcaactcccacttacgagtgagaatatgcggtgtttggttttttgttcctgtgttagtttgctgataatgatggtttccagcttcatccatgtcccttcaaagtacatgaactcatccttttttatggctacaaagtattccatggtgtataggtgccacattttctttatccagtctatcattgatgcacatttgggttggttccaagtctttgccattgtgaatagtgctgcagtaaacatacgtgtgcatctgtctttatagtagaatgatttataatcctttgggtatatacccagtaatgggattgctgagtcaaatggtatttctggttctagatccttgaggaattgccacattgtcttccacaatggttgaactaatttacactcccaccaacgagtaaaaacgttcctatttctccacatccttgccagcatctgttgtttcctgactttttaataattgccattctaactggcgtgagatggtatctcattgtggttttgatttacatttctctaaggaccagtgatggtgaactttttttttcatatgtttgttggctgcataaatgtcttcttttaagtgtctgttcatatcctttgcccactttttgatgaggttgtttatttttttcttgtaaatttgtttaagtttcttgtagattctggatattagccctttgtcagctggatagattgcaaaaattttctcctattctgtagattgcctgttcactctggtgatagtttcttttgctatgaagaagctctttagtttaattagatgccatttgttaattttggcttttgttaccattgctcttggtgtttaagtcatgaagtctttgcccatgcctatgtcctgaatggtattgcctgggttttcttctagggtttttatgattttaggttttacatttaagtctttaatccatcttgagttaatttttgtataaggtgtaaggaaggggtccaatttcagttttctgcatatggctagccagttttcccaacaccatttattaaatagggaatcctttcctcattgcttgtttttgtcaggtttgttaaagatcagatggttgtagatgtgtggcgttatttctgaggcctttcttctgttccattggtctgtatatctcttttggtaccagtaccatgctgttttggttactgtaggcttgtagtatagtttgaagtcaggtaacgttatgtctccagctttgttctttttgcttaggattgtcttggctgtacaggctctttttttgttccacatgaaatttagagttttttttctaattccgtgaagaaagtcaatggtagcttgatgggtatagcattgaatctataaattactttggacattatggccattttcatgatattaattcttcctatccatgagcgtggaatgtttttccatttgtttgtgtcctctcttatttccttgagcagtggtttataattctccttgaagagatccttcacatcccttgtaagttgtattcctaggtattttattctctttgtagcaattgcgaatggcagttcactcatgatttggctttctgtttggctattactggtgtataggaatgcttgtgatttttgcacattgattttgtgtcctgagactttgctgaagttgcctctgtctcagcttaagaagattttgggctgcgacgatggggttttctaaatatacaatcatgtcatctgcaacagagacaatttgacttcctctctatttgaatatgctttgtttctttctcttgcctgattgctgtgacctgaacttccaatactatgttgaataggagtggttagagagggcacccttgtcttgttccgggctacctgattttctaacaaaaagtttttcatctttcatttgtgtatatcaacatttcattcaaatacaaaccagattctcttggttactggatctttcaatgttagtgtcctgatagtttcctacacaagatccaactggctagcttctttcaaatttaacccaagaaaactcaaaggtttgtttacatttttccaagtagtccattttaatggtatgatttcaatattattttacaagattaggttattaatgaaagttaagtttatttatcactgtatattaaccatccaaatgagtcttcagagtctaagttggctaagcatcatgcagactgaaagcgtagaacatccagctactctcctgacaaagaccatttcgaaattttggatgacatttacaaacatctttctaaaagtagccagtggttcatgaggtagtgtgaagtttctgagtgaatatctgagagaggtgtgagtccagtctttgggaccattttttcctgcagggcctttactgatccacaaaggtttagcagctcttctgagagcctctcaggacaaagaggaccaaagtttgagtccagagctttgttagagtggcagtcttggtaagccattcgtatcttaggtaaaatgaaaggaaaacagccttcactgagactgcattcaatatttgagttacctgagtgaatccccaaaatctgaagccatgaaataatgagagtgaatcttgtatttctcgtgcatctaggcactggacatccagcaaaagcaatttaaaatcttcttcaaagagagatattaacattctagacatcatttctacctataatttttcatgtgtaatagccgattaaataagagagttccctgacctccgttacaggacattcaacaggggtgtgtctcatctgttcaagtgctgcatgttcaaaccccttatgggcagggaaacatgcagacaggggtgcaggagccggggagagtgcttctggactccgggccccatggtagcatctaggggtgggtgcctacaactcccagagccctagtgggcatgctacagtgctcttttagctctgccatcctcagatggcttaagttttaaccagctcagtgtcctcttggtacccatcttcttgtttggtgtccaggaagaatcaggtcacacatggacttgaaggatggtgaatgcaggggttttactggatgatggagacagctcccagtgggatggatggggagctggaaagggggtggaaagggaagatgatcctccccctggagttcactgtcccatggccgatttcttctttgactgaccctggctgaactcctctcaatgttcagatgctccttctcttctctctttctctgctgtactgctcttctgctcctctgctcttctatttatctgctcatctgcttgtctacttttgaagcctgggtttaggggtttatatgaatacaggataagggggtgtggcaggccaaaaggcaaaatttgggtgtggaaacaggaatgcctgttcccatttagggccatgggtttccaggcttgagagtggggcctttgctggggaactgccctcttctacctagtatttccctgtatcctgtgtgtatcaccaacacactatcaaagatagtcatgtacttgaggggacaatataacaaaaatgagatgtaatatgagtaagagacaatagaaacaaatccactaatatgccagatagtaaagttacctggcacacttgctgtacaactgtgattactcaactcatggaaataaaagtcaaactgagaactttcagcaaggaactgcatactatagaaagtgacattgcaatatgaagaagacccaactacaaatttgagaactgataaataccatagctaaaattaacacctcagcagaaggctttttggggggactaggcagagatgaagagataaatagtgactacagagaaacagtgaactggaagataagtcaagaatctactcagaaaaaagtatggataaaaaaaggatgaaaaatatataagagaggttaagacacatagaacacactcagaaaatatataacacacagttaattggagtctcacaaggaaaagagagatatatggaacagaagcaaactttgaagagctactgactaaaatttttccaaaactggtggaagtcatcattaaaaaaatagaatctcaaggaacccaaacagcaaagcaggataaatagaatgacgtacttttctaaaaaaaaaataataataacaaagataaagagaaaatgttacagtcagctagaggagtaggtaggtggggaacagattgcttgttagaaagtagagactaaatgctgacttttcaaccaggattggaagtaaaaaaaatttttttaaagacaatagactgatatattcagattaaagaaaaaaaagtaactaccggccaggaactctatgctctcctaaaattcctttaagaatgaaggtgaggatgtgtatggtagatcacacctgtaatttcagcactttgggagcatgaggcaagaggatcacttgagcccaggagtttgagaccagcctgggcaatgtagtgagaccctgtctctacaaaacagttaaaaaattagccaagcatggtggcacagacctgtaatcccagctacttgggaggctgaggtgaaaggatcacttgagggtggaaggcaggagttgcagtgagcacagatcttgccactgcacttcagcctaggcaacaagcaagaccctgtctgttaaaaaaaaaaaaaaaaaggaataaaggtgaaataaatattgaagcaaaagaagggtcttggcctggcgtggtggctcacaactgtaatcccagcactttgggaggcctaggcaggcagatcatgaagtcaggaggtcgagaccatcctggccaacatggtgaaaccccatctctattaaaaatacaaaaactagctgggtgtggtggtgtgtgcttgtaatcccagcgacttgggaggctgaggcatgagaatcgcttgaacccaggaggtggaggttgcagtgagccaagattgcgccactgcactccagcctggcaacacagcgagactccttctcaaaaaaaaaaaaaaaaaaaaaaaaaagaaggtctttaagagaagtttgaatgggccagagacaaagctacttatagttttgaccatggtgggtattgctctaccccttgtttcctccctcgtctgcatggtgttcttttgtttgatacagtgcagaatccatggaatttaacatacaaagtgtgtcaccaaaccaaagcctaggtcaacagcatgccagcatggctaggattttccctcttgtggtcatgaggagggttttccacctacatgggacataaacacacagacaaggttttctatgaacactgccatatttcagcatgcagctgggcttggcttaacaaagtgcagcaggaggaaacagcaggagtgaaacctcaaatgtgatcgggtcttaggcacggagatggaaaataaactcaaaaacaagtgctgggaggagtttgggctggtaggtaaggcaaaatataaaatgtaataatagtccaaacaagttgtcagaatcagataatgctgtatgaagtacagttgactcttgaacaatgctgggattagggtcattggccccctgcttccctgtcgtgcagtgaaaaatctacatacaactttcaagtcccccaaaacttaactactaatacctatgacggacagaaggcttaccattaacataaacagtcaattaacagatattttatatgttttatatattacatactgtattctttcaacaaagtaagctagagaaaataaaatgctatcaagaaaattgtaaagaagagaaaatatatttactatttattaagtggaagttgatcatcataaaggtcttcatcctcatcatcttcacattgagtgggttggggaggaagagggagggggcgctagtcttgctgtctcaggggtggcagagacggaagaaaatctgtgtttaagtggacccaggcagttcaaacctctgttgttcaagagttaactgtaggccgggcgcggtggctcacgcctgtaatcccagcactttaggaggccgaggcggggggatcacgaggtcaggagatcgagaccatcctggctaacatggtgaaaccccgtctctactaaaaatataaaaagcagccaggcatggcgggaactcgggaggcagagcttgcattgagccaagatcacgccactgcactccagcctgggcgacagagtgagactccctctcaaaaaaaaaaaagagttaattgtagttggaaaatcccagccagtgggcagaagagacattagaagcaaatacctctaagaacccaggcaagacattaaaataagaagtgagccacaccgatagtgtgagtcagcacagtgcttcagctaagaaatctagctctaatatagggtggttctggggctgagcctggactttgtgatattctagctgtgttctttggaagaaagttaacctttcagcttcagtttccttaatggaaatggggataataagaggacctaggtcagatttattgttaggtatttgagataatatagatgacctgcttgctgtcacatagagagttctccacttgtgctagccattatgatgctgctgatggtgagtgttttgggggaggttcatttaatgaggactagaagaagagacagcgcggaatactaggagcagaaatgcacttagaagtcagagtcagacatgcatgcccgtgttcatcgcggcactgtccacaatagcaaaggcatggaatcaacctagatgcccatcaatggtggatgggatgaagaaaacgtgctacgtatacaccagggaatgtgacacagccacaagaatgaacaagaccatgtccttttcagcaacatggatggagctggaggccataatcctaaatgaagtaacacaggaacagaaaactaaatactgcatgttctcactcaggagtgggagctaaacactgagtacatatggacacaaagaagggaacaacaggcgccagggcctacttgaggttggaagctgggaggagggagcaagttgaaaacctacccatcacgttctttgctcattacctgggtgacaaaatagactgtacaccaaacccccatgacaggcaatttacctctatagcaaacctgcacatggacccttgaacctaaggtgaaaggtttttagaaaaagaagtcagggtcaggacttgccgtctgtaattctgggcctcaagctcttaagcagaagagcccactttcgaatcttcctcgtagtatagcacctaggatttagcatatctagggctcagtgctctggaatcattgtgaaaatggccgacatcattcatttgggcctggaagccagggaagcgttcacactggaggcgacatttaagtggcagagtctcgccagtagaaatgcagcagtgaggccacgaggggaggctgcaagggaaggatggggaaatggtgcacgcacatttgggaataaaaaatgagagtgttgtccctggagcgtgaagaaatgctggggagcatgtggagaccaaggggctacagaagacatctgagctctcttctgctccagttaagaatttgaaattatcctataggtagtatggagtcagtgaaaattttctgtaaaacgggaataacatactcagagctgtattctacagtgacaacaggcagcagtgtgtgaagaatggcttggcagagaaaaagaaagatggtagcatgtctgtttgggaagcaatggaaaaagcttggatcagaggtgataaggtctcatagtaggcagtggtcttgggacacatggagagcgcagggacacgtggagaactgtcacggtggcagtcactagaattagaggctaattacatggtggtgggtggggctggtgatagagatggtggggggaagcctatttgcttgaagaatgaatgaatggccgggagtgatggctcatacctgtaattccagcactttgggaggccgagacaggagaattgtttgagctcaggagtttgacaccagcctggaccccatctctgcaaaaaaattaaaaaattagcctggccaagtggcacatacctgtattcccagtaactcaggaggttgaggtgggaggatggtcttgagcatgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatattgggtggttattaaagttgtgggagtaggtatgatcacttttaggagtattttaccaagagaaaggggccaagccaactcttggggaaacactgccatgtaacgggtggatgaaagatcagaggagaggaggctgaggaggtgcgctgagtgcttggtggagaaccagaagagagtggtagcattcaaaccacgagggaagctgaatttcaagggtgggtgatcaaaggtatcaaatcccatgcaggatgccaacgagcgtgaggattgcaacaaagcccctggattccgtctttaataacctgcaaggagcaggattgtggcgggtggtggtggaagactcaaggtcacagtggttaggaggtgcaggagcttctgagcttttccccagagttacggaaatgagtggcataaggagaaaatgggcagtaaccaatgggttaaccaaaatcagtggagagttggtttttaaaaaaaaatggagaaatataagttgtgtgaagagggcaggtggaaaaagagcagctgaatgtgagagccaggcgaacagtagagaaaatcatgttttcagcacagagacaccaagaagcgccagattggttctatgaatgttgtattttttagaataagaaattgaaacccatggcttggcacaagatttttctgatttataaattcattatgttaaaaattgcataaattgtatacaaactaagtcattttttcttggatgatttataaatcaactttacaaaaagataaggaagttttaaaagaaaacaagactgtccaggtaagttggggtagagatctgctatatatttgccaaatgtgcccacttaaggggacaggaggtctgcagaggtttggaaccagaccaggcaatgccctggcaaggctggaagcttgttagttagttgtccagggattcatgaaggccggagttgaagcaccagccctctatctttacagccagatggacactggacgggaaacgtaccccaaagtccaacatcttacataatatctctgcagtctcagttcatataaagccaatccttcattttggagacattcaagttaatgtcctgttcctgttgcttagacagagttattagcaaagagaaaaatattcagttgccagtgatgctgtcagataatgttggggttcaggagatttttaatagagttcaagtgtactctttaaataccagtgaaaattatgctggaatgggaccagccatcctgttttttcaaaacttctataacaatttgggttgttagaagaagaaatagtaatttagctgtatgttaaatatgatttcacatatgattaactgtcataaacctatagatacatagaatgttaaggttggaagaagaaagcttagagttcgtttgctgttgtcacctaatttttttaaaaaagacattgaggtggaggtggggcagtgcaaaaaataaaaattaattaaaaaataaaaaagatactgagatccagaaatgtcagggtcaaggctaagtagaaattaacagcaggatcagcactaaaacgaaagccttatgcttcctacgaagtgaataagtattttggtaaaatataaaaattgcagttatgtacaggaaacggaatggcagactagaaaaatagagggagaaaataaacttagggtcaggctggagccactttgattttttttttttttttgagatggagtttcactcttgttgcccaggctggagtgcaaaggcgtgatctcagctcactgcgacctccacctcccaggttcaagcaattctcctgcctcagcctcccaagtagctgggattacaggcatgtgccaccatgcccggctaatattttgtgtttttagtggagatggggtttcaccatgttggccaggctggttttgaacttctgacctcaggtgatccacccgcctcggcctctgattacaggtgtgaatgctgggattataggcgtgagccaccgtgcccagcccactttcacttctatatctgataagcccagccttcatttgtcaatagaaggaaaagtgttaagaattcaaatatgaaatggaaagtgtccttgctttgaagtcaggaggtcagggtttccttcattactttccccttcggtgccaaatatgtaccagacactgccaggcgcttgtttctggacgtgtaccacccctcaccctcttcatggcttggggttcttagtttgcttatttagaaaatcaggtgcctggggaacagaagcagaaagaagaaaactaaggaagaggattcagttaggagttgcatttgtgggtaagaaaaggaggacaagatggcagatgaaatggccactgagggcccagtgacgtcagtggtggtttcatcctcaaagttgaagtcaacctcaggcagccaccaggcttcacatgatctctgggttacaagactatccccatactcttctgggaatacaatagaaagctcttcttagagtaggcctagtccctataggttccaaattgaggcaagctaagcccacatgtaacagccattactcttggtgtcatggaaacaaaggcaaaattcgccaagtagaagaaacaaatgaacatttaaaaatggaacagtagactgggctcagtggctcacgcctgtaatcccagcactttgggatgccaaggcaggcggatcatgaggtctagagattgagaccatcctggccaacatgatgaaaccccgtctctactaaaaatacaaaaattagctgggttttgtggtgcatacctgtagtcccagctactcgggaggctaaggcaggagaatcacttgaaccccggaggcggaggctgcagtgagctgagatcgtgccactgcactccagcctggcaactgagcaagactccatctaaaaaaaaaaaaaatggagcagtaatacacagcctccatcctctttcacagaacccacagcagtagtctttatatcgccaaagcaccaatgtttttgatgcatgaattgttaatagctgaataaatgaatttttgtcatctctgctcctgcaatgctcagtgctttggtggaaaatctcagaggacaccatcgggaatgtgctgtactgagttcactccctggcattgttattgatatacaatcttcgtgttgtgagccacatgagcacttagataacatcacagaagtgcgttttctagaattgcatgctgctataatgagaaaagggaaaaactggattttttgacttctgttgaaattgtgatggcatcgagcggagctaatcaggaagctggacttgaaggcaggtttcaacacatttggtaatatatttgcactttctgctcagtcaccttcaagtgtctggtgtaattaaccttgggctctcctcaatgacacatcaggagcatttcttgctaaggaagctgtgggacccatcggctgggcatggccttgtctggtcagcacgcaagtggcttcattacgtttcctttcacgaaggctgagtattaaagtgacctctggctgacagtttaattgcttaattagagcctttcttctaagtcttcgattcatgtagctctgcaagctcttattgatctcctagaaaggctgcttgtagctcagtgtgagagcaggaagaggaaagtccgttcagcagcaccagctggcccctggagattcctgacctctgcttccagcatcctctttgctcagatcattggaatgtctgctttgtgagaatcagcaaggagcagctcaaagcaagccgaccatggtccaggtcctgcctctcatttggaggaaaacacaaacgagggctaacagagcctggtaccaaaaagcaaaagcaaaagcaatatgattagtaacttctgaagctttttgtggctatctaggagaaagaaagaaaagtgtctgatgtgatccggaaaaaaaaaaaattccctgtgctcccacccaaagctgcaatgtctgttgttgttccattattcgacaataaaatgcagggtggaacagggcagatacctaacgcagcatcctcttttgttgtatttttgtaatacaccacccatgatgtgtttccttttaaaacactgatggtttccaaagcagagcaaacagacacaggaataatagaactctgggtttcaaagagatgatggaaacaagtcttctttaaatatttactgttttacaaacaaatccatgacagaaaccagtctctctctctcccctcctcttcctctctccctctcttttcctctctctctctctcttttcctctctctctctccctgtctttctgtccctctttctttccctcttcctcttgctctctctccctctcttcctctttccccctctctctccctctgtctctccttctctctctctccctgtctctccttctctctctctccgtctctccttctctctctctccctctgtctctccttctttctctctccgtctctccttctctctctttctccctccttctcttcttatctttccctttctttgttcttctctctccctctccctttttgtctctttctctctctcctccctgtatctctctctcactctctctttcttccctccctcctttatgccccacgacaggaatttttgtttccatctgatacttgaggatgatctttttcaaacgtttatcttgtgacttgcatttgtattaacatgcttagctactttgcttcctggtgcgggtgtcttattaacaaccaaatgctgagccagtgctttgaatctgcaagatgaaggaagagttgagttgaagccacagctctcaatctgtggacacgggtttggtttggcttggtttccatttcagctcagactctccttaaatgtttatttgtgaaagtaaaacgagcatcttagatttcttctcatgtcaacatttccaggaatctttgagtcagtgctcgcaacaactgcaaatttttagagtttatagtctcttgtaagatgtgaagactgagtgggagagtgtagcacaaagaaataggggtgaacgcatcgtgatatgagatgtggggttgtgaattgaacttagtattgaatttccaaggagcgtaactggaaaaaaatcactgacaaaggaaactgatgcttcctccttcctcagccccaagaaaagatgctataatgagtaatattttcatttccttccgcattcacatttatgactgtaacagcttgtataatttcctgagggatttccctccctatcacttaatgtttcctctattttggagaagttcgtattccaaagtgggaattccattagcagctataccgccatattataacatgtgaaaatacctcatggactctcaatcctcaaaatcactttgcacctccatgtgaattatctctcctgtgccctaaatgtcttattcttcaccacatttttgcaccctgctaagatcaaaggcaatccagggcaggagacctgtgttaccatctggagttaaaaatgtagcaaagcgggactggcacagtggctcatgcctgtaatcccagcactttgaaaggccaaggtgggtggatcatttgaggtcaagagttcaagaccagcctggccaacatggtgagaccctgtctctactaaaaatatgaaatgtagctgggtgtactggtgcatgcctgtaatcccagctactttggaggctgagacatgagaattgcttgaacctgggagacagaggctacagtgagccgagattgcaccactgcactccattctgggcgacagagcgagactctgtctcagaaaaaaaaaaaatgtagtaaagcataagggtccaggtgagaaagaggccacactagaccagagaatggcggttggaccagagaaggacaaggaggagcttcatatctgaatccaggaatagaatcaagtttatgtggcaacgatagaagttgtgggtttatgtattgaccccagacactgcgctctttgttacccattctgctaagtgagccatgctgggaatcccatgcacgttcactggaatggaatgcaggacagatgccaaccacttggaaagccacaggagcccagtacaagactttctcaaatgctactgaggatgcttgattgcaggttcagatgcaaaggatgggggactcccaccctatttccagagctgctgtggttttctttcttggagaccgtgaatatctcacttagcttcacagaatcatggtctctcaacattctaactgaatgaatacaacttgatttcaccttttctctaggtttaatcatacttggtcggacgtcagacagatggggtttgtatattggctctgcactgctaagcgtgtgattgggcaagtcatgtatgttttcagagctcagttttccctgctgcaaagtggaactgttaagaatcaaatgtaaacaaatgtatttaaagtacctatcagtgtctggttcagataagtatttgctgctattcctaatttttctattacaatgactcctgcttctattactattaactctatgttaaagatcttaaggaatcttttaaaaaaattttctccctgagcaagatgaaacttagtaaacaagataaaaaatccagtagaaaaaaattcctcacttcctactttccaacaatctcagggaatatattcctgtttttttttttttttttttagaaataaaaatacagatattactgaggaagctacaattcatttccccctcattcatgaggggtgcaaacgatgactgacatttcagtcaggtggtcacgagccatttaatcaccccagggttttgattacagcagagaggggcagccgctgaagtgctctgcatcacgtccatgtcaatcacgtggtctttagtgcttaggcaaagcatgcgtgattactggtctttatttcgtgcaatttaaaaatgtatgctcagctttactttagtatgtgatgttacattttagaaagcgcacgctgtgcactgagttgttttgagactgaatggaaggaagacacaaatggaaggcaggggaaatttcagggtgttgtagtggcctaggcaagatgtaatgaggccccacaccaagacaccagagagggacatggatgaagtagagggaaggagccaagcgatacatcggacaaacagatgttagaacatgctgatccactacatgtagcagggatgggggcggttccccaaacggtctggccgttgggtacatgcttccggcatttactgtggcaagaaatgtaggtaagggagaaatgagagggacaggaagagggcttcagtttgagacactgattttcggggtttgtggaacatggaagagatgatgtctacgatacagttgtctatacaagcctagggcttaggggagagggctggggcacagttgtagatattaggcaatgaacagatgctttggagatcttaaaacagaagccacgtccattaaacttgatacattcctggcggcagcaagaggctagattaactggcgttagtagccatctggcttgggtactgcagtgctgttatatgaatagtgccctttcatgtctgtatgtaatcacttatgcatccgagtgatgaaacactaaagaacttttaatatagattttatttttaaaccttacatgctcctcatattaaatttgtagaatacagaaaagaagaaataagaaattaatgccatccttagtattacaatatagatacaagctattgaaattttggtttatttccctcacaaacacacacatacaaatatatacacgcactcatgtacacacaaacatgcatagttaagataatattatatataattttgtatcttgcctttttcacttcatattattcgaaattttcttaaatagtttctttggctagtcaatgaaatggacgtgctgtaattcagttagccacggtttattattaaccatttggattattaatgggttttttcttttcttgttataacaatgctatgaggagtatctttatatgtgaatcttagtacatttcctattatttcctttatatagcttttcttttctttattgaacactctactatgaaatattttaagtatgtagagaaataccgactatataatgcatacaaagtatataacatacaaaaacttctccctgtccagactggccaaatcttcatattttgccacatttgcttcaagttcttttgttttctcccaaacagaaatgaactgttcaagacacaggtgaagtcccacgtgctcctatcattgatcccatgccctgttccccgtcccagaggaaactgctaatgagatttctggtttgtgattcccatgaaggtttttatagttttttcattatatgcatatatccatacacactatgaaatattattttgcatattttaagactttatgtacatcatgtcacacgctacatatccttcttcaacttgctctattcactcattattctgtttttcacattttctacattgtaatgcatacagatctaatgcattcttttagtcactacacattctattttatatatgcaccacaagtcatttgcccattctcctgttaatgaacatttaagttgcttgcaatatttttccttagcaactttttgtaccgaatattcttgaagcaatatctgtatgtaaccacctaagactttctctagtgtaaacctgcagaagtggaattgctagcttttaacttttctgtatgttaaatttcgttagaaatttatatatgaggccgggcacagtggctcatgcctgtaatcccagcactttgggaggctgaggtggatggattgcttgaggtcaggagttcgaaaatagcctggccaacatggagaaaacctgtccctactacaaatacaaaaaattagctgggcgtggtggtgtgtacctgtaatcccagctgcttgggaggctgaggcaggagaatcacttgaacctggaaggcagaggttgcagtgagcaccactgcactccaacctgggtgacagagtgagactctgtctcaaaaaaaaaaaaaaaaaaaaaagaaaagaaaagaaaaaagaaatgtatatatgagaatttctggaacgaaatgagaaaaacttaccttcatacttgtaatcagtttccacaaaactttcaatacattgtcttatttgatctttacaataaccttatgaggctgcaaggggagtttacctaccctcatttttagatgaggtctctgaggtggttactgcaaagagcagtacagcatgtgacttgaatacagcactggacagcctcattcttcggaagcctttgttcttcattccacacccgcagacttaccccagaacttaccagcttaagacaacaacatttacagtttccgtgggtcaggaagccaggtgccactcacctgcgtgcttcctggctcactcatgtgaatgtacacagggttcagttccttgcaggctgttggctgaggcctcccttgactccctgccacacaggcctcgccacggagtatctcagaacatggcaccttgctcaccagggcaagcaatagagaggacaagagagagtccaacaagacagaaagtgctagcaagagggcaggaaccatcttttctcacctcattatggaggtgacagactatcacttccattgtattctgttaattagaacaaatcacgaggtctatcccatacgccagggaggagattacacagaggcatgaataccaggacgtggggctcactgagagctgggtcagaagttgcctaccaccccccacccctacaatctccagttggaaaattttcatttcttatctctcccactcctacctacccatatttctggacaacccccaccccaccccttggttctcttttcttttttgcctccatagctttctaattccctacttcatttcttacacagcaatttagctcccactttgtctcactttgatactagaggctaacatctatcacatgcttactacatgccagccactctcctaagtattgtatcttttaacttattcttgtgaacagtatgagctatatattcatattaatccaattttgcagattaagaaatttagcaacagatgagaaagcaaagagaagggggcaacttgtccccaacaacataaaataacacctcccctactatactcatgttctgagagcctatgaagatattttcgtcaataaagattgcttttccggccgggcgccgtggctcacgcctgtaatcccagcactttgggaggctgaggcgggcggatcacgaggtcaggagatggagaccatcctggctaacacggtgaaaccttgtctctactgaaaatacaaaaaaattagccgggcgcggtggtgggcgcctgtagtcctagctactcaggaggctgaggcaggagaatggcgtgaacccgggaggcggaggttgcagtgagtcgagatcgcgccactgcactccagcctgggccacagagcgagactccgtctcaaaaaaaaaaaaaaaaaaaaaaagggattgcttttccctctaaaaggaatcctgccaccaacttttaaataatgcaacatgcttttaaataatgcttatttataggacaaaggtgtgtatgagaattaaaaagttccctttgcttggcttctttattttcccacattaccgttctttagaactatgatcacaggcctccagaactagaaatgccaccaggaagggatgttggtctcacacttgaatggttttcctcctgtgtcacttgacatgtgacaaagttgaacacatgttaactttagaaatgatggacatttatgcaaatctcctcaaggtatcgaagcatcaggtatgaaaattaaggccgggcactgtggctcatgcctataatcccagcactttgggaggctgaggtggcaggatcgcttgagccaggagttccacactaggcaatacagcaaaatcccctctctacaaaacatttaaaaattagccaagtgtggtggtgcacacctgtagtcccagctatttgggaggctgaggtgggaggatcccttgagcccaggaggtcaaggctgcagtgagctgtcacaccactgtatgccagcctgggtgacagggtaagaccctgactacaaaaataacaattataatactaattaaaagaaatttcataaatgtttggcttagttctcacttctggctagagctgaggatgtggaggggacttgatagcaccataatatatcatgtgttcagaatactctgggccttggggacgggtccaatgtcctctgcccacattctgcctctgccttctctcaccctgttggtgaagggcccctgggagcggagtgcatgacattggctgtgccctgtggttgggccccttcattctccttcagacctggcatataggaagcctgcccagaaagcagccgagctgacctccgtccccctgtgactaacctcttacccacaattgtgtctactatgtgtttacagcattgaatctatgagggcaaggacagctgtttcttaactaagggttttcctcaaccctagttctcaatttttagagaccagcaactgtcatacatattcatttattcatttgttcatcaaacatttattgcctgtatgtgccaggttctgtactttttaaaaagtctcctatttttatataataaagttaagctttttgtttttgtgggggttttttgtttgttttgttttgagatggagtcttattctgtcacccaggctggagtacagtggcaccatctccactcattgtagcctctgcctcctgggttcaagcaattctcgtgcctcagcctcccaggtagctgggattacaggcacacgtcactacgcctggctaatttttgtatttttaatagagatggggtttcaccatgttggccagactggtctcaaactcctgacctcaggtgatccacctgcctcggtctcccaaagtgctgggattacaggcgtgagccactgcacccggcctcatatgtattttgaatatgtgtgttagtatcttggcattttataaaattctggatattttacaaaaagactggtcaacttttctgtagaaattaaatgaccactccattagatctgcctctgttttaagagcttcggcagttagaattctctgggggacagtggccactttttattttgtggcttcaacttcaaatttttattttattactatcatctagaaatgaattagttgacatgtacaaagttttattttgtttgtatattgccctgacttttaccacttaagtaacgatcagaaaatcaatgctgaggcctagcaaactcttggcagtagacttaagtaagaattatatgttatattaatatatgtgtatccaatagtaatatcatttgctagctttgccttgggaactaaatggaagttaaggtgaaattcatatcgataatttttatgactttagaattgtaaatgaatgggagcaaggtttctcatattttcttccttgaagtgcttttcttgtggaattttataaattgaaactttaaatgtgagttgttttttgtctttttttttttttgagacggagttttgctcttgttgcccaggctggagtgcagtggcactatctcagctcaccacaacctctgcctcctgggttcaagtgattctcctgcctcagcctcctgagtagctgggattacaggcatgtgccactacatctggctaattttgtatttttagtagagatggagcttctccatgctggtcaggctggtcttgaactcccgacttcaggtgatctgcccacctcagcttcccaaagtctgggattacaggcgtgaaccaccacacgaagcctgagaataatgatttgatattataagtgttaaaaacactcaaatgaaagaatttatatttcaaaatctgttaaaaatattctccctccttgatagcctgaggtttcaaaatttcataaaatgacaattaggtacataaaacttaataactataatgctacggtttgaatgtgtcccctccaagttcatgtgctggaagcttaatacctcctctagtgtcaggaggtatggcctttgggtggtgttcaggtactgaaagccttgccatcatgaatggattaatgttgctataaaaagggcttgcaacaacaggttctctctcttctgcacttctgccacttggtgacatgatgttcctccccacaagaggatgcaccattcaaggtaccaccttgaagcagagagacccggctgtaacttgctggcagcttgttcttggacttcccagccttctgaactgttagaaataaatttctgctctttataaatcacctggcctcaggtattctatggtatcacaaagaagcagactgaggtgtgtcatgagcattttaaagagaagtaacatggtaaatctagaatttggagagagaagacgctgctactcactagtgatgtgaacttggatgacttactagcctacattgaatgagacagtagtttaatagcttagcacttgcctccctgtctttatttttatagaaaatcacacaggttaggatgtttgtgatggagcttgtaaaattataacatgctcatcacatttggggtgtcattggtatataatttgaattccgggacacatgaaaaccttctttttattgagatggagtctcactctgtcacccatgatggagtgcagtggtgcaatcgcagctcactgcaacctctgcctcctgggttgaagcaaatctcatgcctcagcctcctgagtagctgggattacaggtgcccaccaccatgcctggctaattgttttttgtatttttagtagagacatggttttgtcatgttggccaggctggtcttgagaaaaccttctatttttgatccattccttgtgaagtattacttcagccagatgaattttagcagaggtcttgtaattccaggacctcaggggctgggggtaggggaaatagctgggaagtctgtaaagcttctaggtgtgcccctttcaaaggacccccaaggaaatgggtgattcgggtgattttctgaagatttcagccttaatattttagtttacttttgttccccttatttcctcttgtcccttgagaggattccaaccactcagactgaaaacaaggactgtgagagggaagaaacaatatgtacttattccttggacctttgaatttcggagaaaatttttttaaaaccagaagagtcttattttgtgagtccatggacttgcaaaatcttagagttttttcttttttttttttttgagaagtctataaacaccatagaacccattgttccactagtttaaaaaattaagaaatgctagacacttaggttgattccatattttggctattgtgactagtgcttcagttaacaaggaaatgcagatatattcaacatacttatttaatttcctttgtctgcttatcccaggagtgagactgttggatcatatggtagctctatttttgattttttgagaaatgtccatactgtttttcataatggctgtatcaatttacattcccatcaatagtgtgtaaaggttcccttttccccacatccacaccagcccttattattttctaattgggattaagtggtatttcactgtggctttgatttggatttcactggtgattagtgatgttgagcattttttcatttacctgttggtcatttgtatgtcttctcttgaagacaaaaagacttatcaatggatgaatggatttttaaaatgtgatatatataaacaatgggatggtacttagcaatagaaatgaacacaatcctgtcatttgtggcatcatggatgagcctgaaggactttatgttcatggaaataagccaggcacagaaagataaatattgcatgatgtcactcatttgtggagtgtaaaaatgctgatctcgcacaagtacagggtagaatagtggttaccagaggctggggacggtagcagggaggaaattatggggagatatttgtcaaagggtatacaattacagttaggtaagaggaataagttctgatgttctataacacagtagggcacccacagtaaacaatattctggtttataaatattatagtgtgttaaaagtaactagaagagaggattcttaatggtctcaccacaaataaatgataaatgtttgaattgatggacatgctgaataccatgatttgataattacacaatgtatatgtgtattgaaacatcacactatccctcatacatgtgttcaattattatgcatcacttaaaaccaaaataaaaaataaatataaactgtatatattcataaaattgaatcttaaacttttataaaaatgaaaaaatgctattctaaacaaataaatgaataaattatcttgagagaagtaaatagtctgtgccttaagattcaattggtgtattctccatactctgtaaccacagatgttctaagaaggtattcattatcctttgatattaaaactaagacagtattaatagaatattactacaagcttaggacactgtatctataaccttaggacagcataaaaccaagtatagagataataaagacttgaattaaaccaatggtggtgatatttgagagtagactcaagtatgaatgtagtaagaggttttgtagtgatggtttaaatgtcattttgtctactgtttacagtgttcaacgtgttcaaaggaaggattcatactagattggaaattataatttgaattggttagaaaaatggaatttagtttttaatcaatctttgttgaatgaaaatcagtcatcaggtttcatttattggagatatatatatatatatttaaattttgaacattaaataataaaaaagaaaagatttgctgctccagaacagacccacatttgttttaaacttattattgtaagagctttagctcctcagaaagttaaaaatcctattgatatttgattcatgggcttgtataagccaaactgagaatatcctgccaatcatacctgtggctaaagagaacatgcagaatcatacctgtgtgctaaacagaacactgattataatcatcaccagatttttaaagtcacttgcgagtaacttccttacattgaatctccgaactttctatttttttccccaagattttcttatgaaatataaatggcaatttgtttttaatgaaatggccatattttaccttcatactttcagtcacattctaatggttggcaggttgatgcatgcgtcctgctcagttgataccttgcagtgaacaagaggaaagggtttcaattctggactctggaatctagtggtctgattcaacgtgacctgctccctcttaggaattgtgtgacttgggcccattacttaggctctctgtgcctctgttgtcctgttcttaaaaacagaaagaaatttgggaggataaaatgggacagtgtacgtgaagggctgaatccagttcctggcacatagtaagcactaatgaatgggagttattattaatcatccaagcaaaggaactcatttcccccctgatttacacataagagtattcaaaaattcatccagacactgagttccaagcaaattagtaagcttcaaattttacaaatcaatacagagatttcaggtatatgtgacatagattccatttcattacatgcctggagggtcagctaggtcccagcatggcactaggcaagacagagaccaacagttaaaaagagagaggtaattttcttttcctttttttttttttttttttttttttttgagacagaatctcgctctctgttgcccaggctggagtgcagtggtgggatctcagctcactgcaacctccgcctcccaggttcaagcaattctcctgcctcagcctcctgagtagctttgactacaggtgcacaccaccacacctggctaatttgtgtattttttattagagacgggggtctcgccatgttggccaggctggtcttgaactcctgacctcaggtgatccacccgcctcagcctcccaaagtgctgggattgtagatgtgagccaccatgcacgggcaaaaagagagagaggtagttttctaaatcagccttatatcacccctatcgtttgaaaagaattctgccatttctcttctcttgagcattaccctatcacgaaacttatgaagaacaaacaggtccaacaaatgttgggattctgacaacaaatgctcatcactcatcattatttctcgtctgttttctcatgtgtctattcttgcattacacatttccagcacatgttgtgggcatggcctgtgaggtgactacactggggttgggaaggaaggggagtgtggaagggacggcatttatgaagatatcaagaaatctaatagtggctctgacagaggaagtcctgctgaaattcacgtcagcatccctagaaatgaccaaagacttgttacagctgtgagaaaggacaataaagccagtttccctagatccagcaaacgtgtgattatccactagtatatcggcgtgcagacagttcgtggaatacaggccttctagatgtgaatctgaaccactgtttgccctgtctcctttcttgtaggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaaggcaagtaccctgtggatcttcccaggcacaagagaaatcttcagtgctctgtttggtgcaacagtgaaatgagacctgtgctcagaaattgatcacagccttctacttaacatgtaaaaaattaaatagaacaaaagaactgtgacttacaattatcccaactcctgatgcttgtaaccttctccttctctgacttcctttggacccgcatctctaacaagtttaaaagtgcttttaagactagaaacagtataaaaaagttttatccaaattcactgatctagcactacccaaggctttacactagaatgggatacactgctatcaattacaagacttgcttgtaatgtattcagatgccagcccctggaagcagtggtttccctcatttctgaatcctgccattgtccaactgaggagtcactgttgttttccatttatttttctttctttgttccctcccttcctcccctcttcttccccttcctctcctccccttccttttcctcatctctctttccctccccttccctttctttccacagggtctctctctgtcacccaggctggagtgcagtggtgcaatcacggctcactgaagcctcgacctcccaggctcaggcaatcctcccacctcagcctcctgagtagctgggactataggtgcacccccacgcctggctattttttttcttttttagagatgggatctgctctgttgcccgggctggtctcaaactcctggcctcaagtgattctcctgtcttagcctcccaccatacctggccatttttgttcttaaatcaccacttctccaagacctttttacccattgcctttcatctgctcgttctaagagatgaaccccttatcccatagtcagagatgacttgtattcagatgactcagaacattcactacaaatacatttagtctgtgtagtcattatgtctatcttagtcaactcgcttatattctgtagtaaagagctctggatggggacagtgcctggatcgaggtctcccaaatacgcaccatagacctttagactttggagcaagacagactatattcttgttgattttaaagaaaaactagtttcctaatagttcttttgcatgttattattcacttgtttgttgcttcatagtaaaaagtccctgctagctttcatccggactgtaacaacctcctgaaagtcacctacccttaccccatctctctccaaagtcgcctgtaaaagccctgctctgatcatgccattggaatgctcaatgtctgtcccgtctccacctggcctggagaataaagctcaagctcctgcagatgttaaccaagagccccagaacccaccctgacctctctccagcgtcagtcacccacatccctggggcaccccatgctccagctgagcctctatagatgctcctctgtgtctgctcaggcagtcccctccctggcctcccttttctcaccctccaagtcctagtttagcctcggcctcctcctcagcaagactcctcttacgccctccagcggtgaccgcctctccctcttcaagactcacatcgaattttgctcttctctagtaatctacagtcatccttatgaagccttattcaattgagtatttattttcctgaaaaaaagaggtcatttataagcagattatccctatgcctatgatttatgagtgggcagtgtaagtgaatccatgcaagaattttgtttgaatgacttaggcaattcatagacatttaatctgttgctttttgccacttcctacttcctgtagttgaagaataattgttaaaaatataaactgtgctcctgttttctcatggtttatgtacagctctccttatggagaactttcttggcgtgcattttagaaataagaagaaaaatcattgatggttttattcatcaaataattgttttgtacggtcagtagaaatgaaaagcatatgacatgtatgtgtgtttgtgtgttccccagcctgcggaggccacatcctcaccagctcatttgatactgtttcctctccacggttccctgccaattatccaaacaatcagaactgcagctggatcattcaagcgcaacctccatgtaagtaacaaaaatgaaaaagaaaaggcacacaggagagaaggtgtctgtgggaaggtcagtctatgagtaaccttcttatctcagtgctaacaatcgatggccttcctcttcatcttttgcaagtcccaattcctgatgtgcttaagaacaagcatttcctaatctgatagggaagtcatttctacagttgcttctaaatttaaaaacaatttcttttttttcatgtcaaggcctagcaaaggttaaaaaacacacacacgcacaacaacacaacacacctacaaccttgctgtattaacaggcgtatgcaggcgtatgagattgggggtaaaccaaaataatcgataaatagtttttgacatgtgtgccttgagtatagctgatgttcaagacagttgctgagtgaacaaatgaagaagagtcacagactggagaatcagtgactcacgggccagaatgcaatgcgcgcacctatccatcaaagcaaacattcataaaacctgggctctcctgcaaggtactattccagcacaggcctagaagaaacattgaataaacgcttactttcttttcttttttggaaccctagaatcttattttctgacctggtaacagtccgatggtaaggacttctgtcctcattttacagacagagaacatcaggaaatgcccctcaaggacatgacagaatggctgcaaagcgggtgatgctggggcccttctgaatcctgtttcagaggagccctgccctcctttgaggtttgcaggaaaatacagtttcaggcataatgtaggaaagtctttaagttcttcactctgcacagtaattaatcgcctgtgtgaaaatagggaagtcacttaagctaatcaggccatgaaaaagtaatctgcaaaatgaagagtttggcttaaatattctctagcactttcccctgggatgtcaggagttaacaaattgctagtatcttcattgacatgcataagatgtggcagccgatgatgtcatccttagccaattcaaacggggaggtggagccccaaagaaagttgccagccagccagaaactgagctgtagataaagaagccccctcccttgaactgagaagtttgtgcctgaggattattttctaatgagttgtaaagcatttagatgaaagatctcactggttcaagaacagcaataggaaaagatcctattctgaagattagggagcttaaagaacaacaaaaagaaaatgtatccaggtgcttgctgttctgcaagtaattcaaaactttcttgataaatgtctctgaaccttagggcactagctctagcctgaaaataaaactgagtgagctaaaatgtgggctccagggagaaaagaatgccttatttacaagcacatgcaaagaatccgaatttaaggaaatgagtctattgagaaaaatgcttctgcgaggaacacagcaatggtgatataaaaactggaaagacggcattttccaacaagatattcccttatagtgcctggaatgaacctacccaggagtcctcttatttaccactgccagtgtttcagatgccacaggcagtttcaaaagcatctattccgttactcttcaaaggaaaccatctattctattactcttcaaaggaaaccatctaggatagaagttgtccccttcccttgctttatcccttcaaccatgtgcaaatccgcctcattcattacttctctgctggagaacccttacatgaaattaccagaagtaaaatttatctccctgtatgttttttaattttaattttattttgtaaaaaaattttattgttaatttttgtgggtacatagtagatgtatatatgtatggggtacatgagatgttttgatacaggcatgcaatgtgaaataatcccatcatggaaatggggtatccatcccttcaagcatttatcctttgtgttacaaataatccaattctactcttttaattatttttaaatgtacaataagttattatcgactacaattaccctgttgtgctatcaaacaggtcttactcattccttctattttttatagtcattaaccatccccacctccccgtcttgccccatctccctgtatgttttatttgccagtactttacgagagagtcttctcttttttcttccagtaaatcatatcaccctctcttttacccactttgaacttgaaagaagcacaacgtgtgcacgtgactttgtagaaattttggatggcggccacgaagacgcgcccctccgaggtacctcagcgttcactcatctacatctgtggtcttggctgtgctttatttatagatccgcatatttataggctgccattctaggttgcaatgtttccaataaatagaaagagcagcctaagccaaataaagatgattagagggtaagaaagcaggcttgaatgtggggttcagggaactcagcctgtttattaatatattcaaacgtgtgaatagtttgtgtatatgttttaaaacatttaaaaattgcagctgctttaaagaatagtggaatgcaacccatcccagcattaggtagcattctatcagaaatttcttgttaatatttgaccaagttcttacattcacatggagtatgtttctttcagccttgtccttagtggaagcgaaaaaaaaagcacttaattagataattaattaattaattccattaaaaatctgtctttttgtttgttagacatcccaataaaattaaagagtgccgctatctagtttctgaaatgctctcaggcaaaacaaacaaacacacacacactacacacacacacacacacacacacacacaccaggccatttaagctttctccgtaaatttcctaacttttgaattttgttgtaaaaacttctcatcctgcactagaagacaaggtctgtcagagaggagactgtttggcctgttgcctaattcccagtgcccaggacagtgtctgagacaatagtgaacaatcaatgaactctccacaccctatgcacacctctcacagcatttgttagtaagcatttgaccaaggataagggtatattatttaacaagctgttacatagcaataccttgcgctgagtactgttctcagtatgttataaatagtaggtcaatccttgtaatcttatgagataggtttcattattttcaatatgcccctttttccaagtgaggaaactgaggcaccaagcacgtaagtcacttgcctaggatcacacaactagcaaatggctgagccaggggctgaatccaggtagcctggctccagcatccacacttttctgtgctacaaaatagtggatattagtgcatttatttgtatgggtccgactgggctggagatttttgctttaggtacatgtgtcccttggtcatctaagtttttcctctggtcctattgttcttgatcatgtttataaatcacctctcctatatatagctcctatatatagtttattttaaatcatcaggtattgtctcaaacattgaccctgaatgaagtggttctcctagtggcaatttcttcactttgttttggtctcttgtaattcgagtaaagatgtgtttcctagaaacagcggtctctgccatgttgtcattcattctccttgtcattatcttcattatttaggccgttactgtggcaccgacatgccccatcctatcacatccttcagcagcgccctgacgctgagattcgtctctgattctagcatcagtgctgggggtttccacaccacggtcaccgcatcagtgtcgggtaagaaaccctagcacctgactctagcggttaaaagggatgtggtagaaattcttggtttgttattggggactctgaccttcgtagttgggagccagtttcctgagatcacctctgggccaaatcttaccttcttcccaattaagtgatcgtgttgtcaattctagcaataatgaactctggaagtgtggaggattggttggaaatgtagctgtcttttcagctacatgccatgctatcagatgacttggtgttcttttgttgtttttgagatggagtctcacttggtcgcccaggttggagtgcaatggcacggtcttggctcactgcaacctctgcctccccaattcaagcgattctcctgcctcagcctcctgagtagctgggattacaggcacttgccaccacacctggctaatttttgtatttttagtagagacgaggtttcactatgttggccagactggtctcaaactcctgacctcgtgatccaccagcctcggcctcccaaagtggtgggattacaggtgtgagccacctcgctcaccctggtgttctttttggcttgtttgttaaggcagccctaacctggggaggagaggaacgaggagctacccaggactgggtttcttagcctcttagcccagagagtgctgttggtcactgccatcttccttgtttttagtggttaaaagctacagaacacctagaagattggtgtgtgcatttcggtgctctactgagagggaaagcaagcatgctgcgttgggttctaggccagggttgaatagaatcctggtcacaaaagccaagtggctgtaggatggtaaacaagtcttttattcttcaaagttaccgttcacaggaagaaacggctttgagaaaagacattgcagaaattccttctaatccaccacactgcatggcccttggtcttcagtttgcagaattgttcccttattttatatgacatgaatgttttaaaatgtgagatggaaatactatctattcttttacattgataatggctctagcgttctttctcctttattttatagtgtctgatgcagtctttgctctgatactcactttatttctattttcttccagcttgtggtggaacgttctacatggctgaaggcatcttcaacagccctggctacccagacatttatccccctaatgtggaatgtgtctggaacatcgtcagttcccctggcaaccggctccagctgtcttttatgtaaatccttttttatggtgtattgtttcagtgctaatgaatctgtaggaaagaagttctggtgctaataggatgggcaactcatagtgtacgtgaaatttaggaagtatttttccaaatttcctctgtttcagtcatagtttgagttataaatagcatgaagtttctctcgaccatggttcttgggtcctgtctaacatttccaaaagtacattcttgagtccttggtgaatgaatgaatctgtggcgcattcatgttcagagtacaggaatcttatctttttttttggaattagacacattaaggttcttccagggaatcactagtattgtttattccagcagagccctcccatctcaattaagcattctttacgcttttatcttatccctacctcaatccacctttccttctatttctgtcagaagaatggttctggggctgggtgtagtggctcatgcctgtaatcccgcactttgggaggccaaggcgggtggatcacttgagatcaagagttcgagaccagcccggccaacatgacgaaaccccgtctctactaaaaatacaaaaattagccaggagtggtggcgggcacctgtaatcccagctgcttgggaggctgaggcaggagaatgccctgaacctgggaggtggaggttgtggtgcactgagattgagccactgcactccagcttgggcaacagagtgagactccatcttaaaaaaaaaaaaaaaaaaaaaaaggaatggttttggaagtttttttaacttccaaacttaaacttacttaaactttaaacttaattttttagaacactttcatattcctcattgcactataacactttttgaaatggactataaatatggaattagtagtaggatcctatcacattctgagtggtcttagattaaattagacagcaacaataatatgtcctagagtagatgtaaaaagcacacattttaatcaactgatagagaggtatatgtgacacgtcacactgataatggatgcttattatatattgagagataagatcctggaatttaaattgccgttttgaattgaaatttatttaccagtctattttacatattactaggctgtggttgggattgctaattctgttttgaagcgaatataagtaacttatggttgagagaagaggattgttttgaggaccctgtcctgtttatttaaaagtcttacttttcttccaagacttgctaatctgtgcatcaggaactgattaaaaatatgggacaactatcctatttgtggaccaagttcaaacatctcaagttgctttttttaatccatcaatcagacagagcctcttcagggtataagtggccttgtgttaaaacaaagacaccctctgcatgccgaaaggcaatgcaagtttaagctgcctcacaggaaggaggttttggtttgtctttttttttttttttttttttttggagacacagtctggctctgttgcccaggctggagtgcaatggagtgacctcagctcactgaaacgtcgcctccggggtttaagctattctcctgcctcagcctcctgagtagctaggattacaggcacatgccaccatcccaggctagtttttatatttttagtagtgatggagtttcaccatgttggccaagctggtctcgaactcccaacttcaagtaattcacccaccttggcctcccaaagtgctgggattacaggcatgagccaccgtgcctggcctggtttgtctttgtcttcactaagagcacagcgttctggatgggaagaaatctatatactttataatgtttaccagacatatatttattctttcactcaacagatatttattaagctcctaatatgtgctaggcatgtagttggcacatgctactctcctatgaggtgccttctatatattgatcaataaaacaccatcattgtccttagaataaaatccaaagcccttcgcacagctttagtaggcctatcagaattgccaaataaaatgatttttttttttggtcttttcctgtttgtctctaccacattcacattgttgactgctctcattcagtggttgccaggaactgagctaggtgttcaagacagataagatttcaggtcttgacaaattactcataagccaacattaagaagctatttaattaaattcattttatttctgtgggataataataacaagtttctataaacaaatttatagtaatttcaaatttctaggactgtgaaggttaaagaagatgtcaaatttaaaacgcataccacacagctagtgcatagcaaatgtttggtgacttaattctctcaatctttaccatttctgaagtatcttctgtgatagctcacaaataaatccaaacgggcagcactaggctctccttccagaggatgggagattacacacacagaaagcaagtttcatctatttcagtgcttaatagacattacattttaattaccatatagaacatcgtaatgactcagctatttcctttctcgcctgtaagaagttaattttgattcctctgagttacttgcttgagttttatttttaaaatggacgttttaggctgcaagatgcctctttttttgcagttgattaatgagaaggcaaggcctgtgagttatttctgccctggtctaaattctatccagatggatgcttggaaacattaccctggggtgtgtgagagcgtatgagaagcatgtgtatcacatcaagttctaaaacatggggctgggattgtggtgaaactgagtagggaagaagactggagaaattatggttgaatctgcaacaaaaaggaacggggagaaataaaacctaaaaaggagttttttgtaagacatatatttaaccatttattacccataatatgaccaaaaatgtgaatatggtaaattgttttcttctgcttctcagaaagcagaaagggaagaaagggagatcattttcctcagaaggtaaattacatgcagttgtctctaaaatctttctattcaaagtgcagtgcaatctttctgaccagttacttcacccctgcggtttggtgggcagggaattgacagaaattgtattttatacttgcagagtgcttttagaaagtgataggtctcagttcaagaatcagaatgagataataagaaacagtgattgtactatttttgttccacatcctacatttactaacagatctaagccaaagggtgtagttgcttataaaatgtaccagcctaaagcaaagacttccaagcataataaagctttttttatagtttaatttaatccttctaggtatttgcctaccaccatgtccaacggaatgtcttttctgccatctagcactggattgcagtagtcaagtacttagaaaagaccttcactttgtaatcttctggagcatcggacagaatgctaatgtgcatgttgatcatctaggatcttgctgaaattcactttctcactgagttggttggtggggccagattccttgtttcaaacaagctctccggtgatgccgatgttgctggattatgcactttgcatagaaagattttagaggcaacttcgtgtaatttacgttctgaggaaaatgatctccctttcttccctttctgctttctgagaagcagaagaaaacaattttgcgtatttcacattgttgatcatattatgagtaataaaattgagcctgaatgtatacacaaaagttggcagccatcccaaagatggatttagaccaattccttgcaaaataaaaaaaagattgaagatagaaatattgtgttataaatcatcagattgtcaaaggagacaaatatgtggtttgttttgtctgatgtggatatatcctgatttcaattatcagttatagcttgctgtgaaaattccatctagtctagtccagatggtctatactgtagtgacccaccttggtgggattctgagagccaccagcttaccaccaggcttactgatttggttagagacctaccaatgctagtatctggcttgagagctaggttagagcagagctgaccagttacttcacccctgtggtctggtaggcagggagtgaccagagatgtgcctggtatattgattagtggtagggcttgaggtggtcagagcctccaggctggttatctctaactattctcctccattagctgagatagagccccaggggagcactatacttagcataaagtaaaatcttgccatggataatgttgagcattaacagaaagatacacatgacagagaagtacatttttcctttcctttccccttccccttccccttgccttccgttcccctcccttcccttcccttcctttcccttccccttccccttcccccttcccttccttttcccttcccttcccttccttttcccttcccttcccttccctttttcctttaccctttcccctttcctgtttgttcatgctttcatttcattggggtataaacctagaagtgaaattgctggttcatatgataatactatgtttaactttttgaggaaccaccaaacttttttatagggatggactattttacattcccgttagtaatgcgtaagagttctaatttctccatatcctcatcagcacttcttattttctatttttaaataatagtcttcctggtggtttgtagtgttatctctttgtggttttgatttgcatttctctaatgactaataatgtttgaaaatcttttcatgtttttattggccattcataaatcttctttggagaaatgtgtattcggtttgttttccattttaattgggttatttgtttttaattttcgagttgcaggagttattttatattcaggatactaccttggtcatgtgtttttattttctttgggtatatatttaggggtggaatttctgggcattaattggatgtacatttaattttatgagaaactcccaaataattattcaaagtggctatgtcagtatgcagtcccacgaggaatatataagacttcagttgctttgcacgcttgtcaacaattgatcttgtcagccttttaattttagcccttatgatgggtgtggaatgatatctgactgtggtatttaagttgcattgctctgatgactaatcatgcagagtacttttcacattcttggtagccattttcttgtcttcttttatgaatatctgttcaagccctttgtccacttttaatttggttgttttttcattatctgtaggaattccttttatatttcaactttgagtcccttgctagataaatgctttacgattatctcccatttccccaccccggtctgtaacttgccttttcatttttttaaatatatatatattttctggacagagtctcactctgttgcataggctggagtgagtggcacgatcacccctcacttcagcctctatctcccaggcttaagccatcttcctgcctcagcctcccaagtagctgggattataggcacaggccaccacacatagctacattttattttttgtagagagggggtttcactgtgttgctcaggctggtctcaaactcctgggttcaagtgatcctcccacctcagcctcccaaagtgctgagattatggttgtgagctaccacacgcagcctattcattttcttattcatgtctttaatgaaatgtttatttatgaattcaaatttattaattttttatcttgtggttagtgctttttgcattctatgtaagaaatatttgcccatcccaaggtcacaaagatttttctccgtgttttcttctaggatctttatgtttctagcctttatatttacatccttgagaaatattaagttagtttctgtgtacgaagataggcagaggtagaggttctttttttcctctctctccataaggatatccgttattgcatcaccatttgttaaaatgagttttccccttgatttgtcttggcaccatggattgaattggattgacagtgtatttgtgggtccccttctggaaattctttcctattccattcatccatttgtctacccttacaccaataccactttatcttgagtagctcatgtttttaagcagtaaggccaagttttgaaagtactcaactagcacctacatgttccagactctttagatatgttacctatgaacatcatatgaggtagatactatttcctatcctcgactccccaacacatcgtagttgcagaatataagacaagttgaataggtcacattcaagcaccagcgggtgttgttacaaatcccataattttgctgcctctccagaaattaagtacatacacctttgcagcgcatttaagtgccacctaaatgatcccatcatattgccccagttacatgttttaatggtttctttttttttattatttaccttcagccaacccacaccatgtcttagaggtactcagtgttttaaacaaaccaggtatctcgtggttttctgaatatgtcccgcccttctctgcacatgtgccttggtggcatgcttctttgcccaccatctatagtgcttacatccagctcacatgtatatttccatctcaaaaagtcttcccatcaagctattgcagagcaccacaatcaaatatgatgcctctgctttgcaattcttaaacgccactttataactctgatggcactcacactattctgccttatatattttttttctgtattctcgtccagttttgcccactaggaagaaaactccttgatggaagtgtattcgtcgtctttgtagctattggatacacatttcaacaagtccgagtgaaagaaattttttgagacagccaaataatgttgtgatcaaagttaaagaaagtttaaaaaagtgaacgggttaacctagcatgtgatccgggagaatcccaaagtctattctctcaatttaatccctttaaatatttttttccccaaatcagatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcggcacgggcttccaggccacatttatgaagagtaagttgtttctattttagtgatagcttccagaatatgtcttacaaactagaaataataattttctcagtaatatattaagcaagaacaatcctaaactctacactattttcctacattgtctttgtgaattaccttataacatattagaaaaactgaattgcatatgaatggctcaataagggcaagggagagcactctcaatggttctattgttctttttaagctctaatttctacctaatgttaaattagtttttttcatgacgttgtgttagagtctggtaatatattatagtttgggtttggtgtatttatatcaagtgtgtttcatttgatttcataaactctacgttcttcacatttaagacatttagtattactttgggattggcttaagtgctcacatataacaacaataggggattcttctaatagtataaaatgttaaatatttttattctctagctcaacttttccattattggctatttcatatgtaatttcaaactatcagtttttcttgtaaatttctttaaatgttccattcttttgaaaaacaaagtaaaatagataaaccaaaattagagagtggggctgctcaccccaccttcccatgtccccaagtcccctaggggctcagaaccccttttcacatgggaagttgtggcctcttttcacaccatgcaacgttttaaggaccttttctaaggaagtgatagcccagaaaccaaaaaggaggcagtatttctttccctagtcagaaaagaaatcacagtcaattaaaagtccatccttttcaacaccctttgccttttgtttttttcatttgattaaagagcaattctaagtgggtctgatttactactctgtcttccctcctagtatttggcaatgataatattgtgggaactcatgggaaagtcgcctctcctttctggcctgaaaactacccacataactccaattaccaatggacagtaaatgtgaatgcatctcacgttgtccatggtagaatcttggagatggacatagaagaaatacaaaactgctattatgacaaattaagggtgagtttccacatgcaatcaatgttcataaatattggtgaattgctattggtaaaaataaatccaaggtaacgtctattcaagcatttgcaaatcatgtgggatagtctgctctaaatcatgtttagagcagactgcctctagattacatggacaaaggcaatttcagtattgtatttattattttccatttcatatctaaggggttttttaggattattataattttcctgttgagctttgtctaagcatgcatgtatgtcctaaataagtatttattctgtcttatttcctactatcctctttgtttttatgttagagtattaaaaattttaatgatcatataaaaataaatataaatataaaaatcatggtgatcattgctatccagacattggctaccatatcagttccagaaacacaatcggatgcttacaggctatgaccccaccttattcatcttggattcttggtcatgaatagatcccagtgcctgatgggtgcccaatatgtatgggaatgactattacataatttgtttggtagagtattttataataactgttcatatgaatttgtcctgagctatttaaaaattatcacagaatatgcctcaaaataggtaatttgagattttaaaaccaaaggtaggagatttactaagtgctttgaacatggtgagccctacaagttttggctattttgttgtcattaattcttctttccttctgtggaaatatggactcctttaggatacctgtccactttctctcattaaagcttttctcttcttgttattttcccttctttcttcctaattcctccctttgaagccccaaagcacatttattaagtactgttggtaggcaaccatcctggttcctatttttccatccacaaattttactgtaaatcatcttatgagtgattcccacagtgcatgtttattaatataattctgcaacaaagatgcaaatgttttcaaaacattaaattaccttcaataatattttatattctctggcagtatgtgttttaagctaaaattaaatgtttactcatttgtcatttttttgttatgataacattgtaataatataaggcatcttttttattttatctttttatgaagaaaaatatagataatacaatgctctattatctgtttttatgtacagatctatgatgggcctagcattcacgcccgcctaattggagcttactgtggtacccagactgaatctttcagctccactggaaattctttgacatttcatttttactccgactcttcaatctcagggaagggattccttctggagtggtttgcagtggatgcacctgatggtgttttacctaccattgctccaggtgtgtttggtaataaatgaagttctttttaggactgatatgtgcaggccaatgtttcaaaggatcctatcataacaggggtcagatataaaaataagtacagccccaaagcccttccaccatatgttcagatgttgttttaaattcataaacactaccttttgtagaaattgtacgtttctttctaaaaaatgcaggtcccattatattttttatattaattaggggcttgatatccataagatcgtctacttacaatttctagagaccactttagaaatccctgaaaatttgatttgcagatactacacatgtacattcacacacacacacaatcagttagttaaggatcaactcataaaagtaactatttttcctctgcattttatttcaaatgtagcttcagaaatgcttcagtttctccttagctggttgtaaatttccatgtttcaaagtaaaatgggccgaattttaaacttttattttacttttttacattcctaatcccctcagtgaaagtgatattgagctagcattgtttggggagacttttttcttgaaaaatttttaaatgagaccgggtgcggtggctgatgcctgtaatcccagcatttttggaggcagaggtagacggatcacttgtggtcgggagttcgagactagcctggccaacatggcaaaaccccatctctactaaaaatacaaaaattagctgggcgtggtggagcgcgtctgtagcctcagctactcgggaggctgagacatgagaattgcctgaaccaggaggcagagtagagtttgtagtgagccgagaacatgccactgcgctccagcctgggcgacagagtgagactccgtttcgaaaagaaaagaaaagcaatttatttaaatgaatttgagcgtttcttatggatttcaggattgacatagaagaaattaatcagatatttcttggaggatattctaagtccttgaatgcttgattggaacacagaatcacggtatctcattgaagaatattcgaactctgaacttgttctatgacttaaaagattagcctatttgcttctaacttcttatatcagcagaagtcactaatgaagataatttgtacttatatttatttaatgtcccttagtattccattctgaaatgttgttcctacctctctaataaggtgctttcatgacactgaatacaaatctcttacttaaaatattgatctgtctatctaagagcaaagaaccatcagcaagactgacaaatgcaatttagaggcaacatttaaatctggatggatatatccagagctcttagaaataaacttgagttaagctttcttttatatttacaaccctcaaggtagaaaaggaattatttacttgtgtaaaatattataccaacaaattttcttctaatattttattacgaaatttcataattatatgatgtaagtggacaggtgaagaagagagccataaaccttatttttcttagtcaagaagaaaaagaaaaaaggaaagtaaggggtcaagagaattttagagtttactaattatctagatggcataagtgattatcctgtaatgataccacactgtgaaagtgtcattaaaacttaaaaaaccttaatattttgaaatatgtcaacttattgagcattgtcctatcagtatttctttctttttttttttctttttttttttttttttgagatggagtctcgctctgtcgcccaggctggagtgcagtggcacaatctcggctctctgcaagctccgcctcccgagttcataccattctcctgcctcagcctcccaagtagctaggactacaggtgcccaccaccacacctggctgatttttttgtatttttagtacagatggggtttcaccgtgttaggcaggatggtctcgatctcctgacctcatgatctgcccacctcggcctcccaaagtgctagaattacaggcgtgagccactgcatccgtcctgtcctatcagcatttcttatacacacatatatttattttaaatcaacgcatatttattgagaatttattatggatacactgagaagactaagaaaggaaaatgaggtacaatctctactctccaggagcttaaaagtaatgggaaccaggcacagtggctcatgcctataatcccagcactttgggaggctgaggcaggagggttgcttgaagcccaggagtttgagaccagcctgggcaacagagggagaccccatctctacaaaagattaaaaaaattaggtaggcatggtggtgcatgcctgtagtcccagctactcaggaggcagaggcaggggaatcacttgagcctacatgctgccagtgagcagtgatcatgacactgcactccagtgagaccctgtcctaaaaataaatacataaatagtaaaaataaataataaataaaagagattgggaaagaaaaaacactcatatgtgagttaagtaatggtatcgtaattaaatgggtacatgacaaagcaaatggtaacagtagcaaataagcaagggaagaaaaatgagcttactgtggactagggtcaactgaaggaaattcaatgtgtcaagtaggaaaagcagtcagtgtgtcagtcaggaaaagctcagccatatggcggtaacaaacaatttcaaactcttaggtgctgaaaacaacaggtctccttctacatgttcctctcgtgttaactgggtgcctctcatcatccatcacttcctaactcaggctgttggagctgccattgtctgcgatattgcctgagaccatggcagtaggcaaaagagcccttggatgtctcggtttaaaagtgctcactgtaaagtaacacatgccttttgctcatagttcattggccaaaactggtcaaatggcctctctcagccacttgcagaatgcagttctaccatgtgtttggaagtggagacaaaggaaatatttggcaaacagcactaatgacccacagtcattataaccatattttacaaattcaagataagaaatatttcacatagaggaaaaccttaaaatttgaagatactggataacattcagcattcagattttccatgtgaaattgctttaaaaaaatctgtagcctacatagtaatagggtaaagaaatcaggacctagttctacaacattttatattcacttcctgttggccctgataagattcaaacatattatggtgtacaagttgtaaacttctgaaatggtgaagattggatctctgaaatatattgctacataaaagtgatggcaaaaataattgttaaaatcaactttttgagaactctggaaatagaccaaagccttatagcaatctgcggcatatttattcaagaaaaatcactgaatctaagtaagagtcatttttgtggcattctcttcctattcccatctctctctctcctcctagctttgtagtagcctcatgaccacagtagctgtgaaaatgagcagctttaacagctgtgggtggtggggccgcagaggtccagaaaacagcgcatctcctcagcattgccattattccagttcagcaacttcctggaaaactgcattctcaggtcttgtcttcacaggacctgggcaagagctcactcttttgtaaacagccctgtccctggggtctttgccgaaaacaatcagcaacagctgtttcacatcacaaccgtgcaaggcagtgacaccagttacagctaatgagaaactgaccagtaaacttgaaaggaaaaaatggggaaggagatgcccactggggctttgaaaagctccgacatgtttctggaaatctagaaggccacacacatagcccagctgtgcacatgcccaaaaatagaccccgagaaggacctaatctgtcaactcaaaattgcctagatataaattacaaaagtaactacgcaaaaatgataaagaaacatgagaaacacaggaatgaatacagttctacctcagtaatacaggggatcctctacgtgtctttattgatgcctaaatagtcagcacttgatattaaatgggttatatagcaaaattatggtgaaaatggagaacacaatgcattttttttacatcaaagatcaattgcggaaattgcagctttccgaatcagtgggttacatacgatattcattgatttctctgagaaattgtttcaattggttgcttcttttcagtagagggctgtcactttcaagtgaaaaagtgctagctagcgtcttttccattagggctgtgtcaaagatgttgctttctattctacaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggtgagaacattataaagaatgctgagtttcaaccctgacacataattagttctagtccattatcatcagacttgcatactgcctccatccgtttggtttggaattacacagatattatggtcaaggaaggcatcagtaccagaaatggctacaacttctgaaggacatagaaagtattaaattaccggtcacagaatatcaggaatagcacatttctataaggaaaaaaggcttttttagaggcttaagaaggaaagaatagtctgaatgtcaacattgttcacctgtcctattgagatacctctgagataaatattgatattttatgtttctggctgaaaaaaatacttataattgtaatgtgactggacatagtggttcacaccataatcccagcactttgggaggtcgaggagaaggatcacttgagtccaagagttccagaccagcctgggcagcagaatgagaccctgtctctaaaataataataagaagaatataaaatagtaatgtattcatttctctttgtcccctgaatgtgggtagaataggtagagttaaggggtgatattgttgtattctttcctttgtacacaggcatggtgttgctatgtgacataaagttagagacataaatattgctgatgtatgccttatacaaaattgggcttcacagtctgcatggactggaatgaaggaggacagcagaaaggccacatcctccacgtcagtatttctcagtgtggcccccagatccacagcatcatttgttagatgtacatgttctcagcaaaaagaaacgtgtttgtctttggcccacaggttgctagtgtgcaagatcttgtctcccttatccctgatccctagacccctgccgagtgagaaaaatcgaatggtgaaggtgctttatgtcccttctgtagaggcagaacactaagtagagactcaaatcaatcatacacacatgatgagatgtcaaagcatgacactccccctttttcccatcagcaatcggctatcagcacgttgcacagaggagtatcaaagcaccagaatgccctcttcacatctaagccttcctgtgcatactgaaatttaaaacttttcatgtaatggaaaggatgtgcatccttgcacacatattctagtgttcagaacctactagaagttttaaaaaatatctttgaaaaaaatcttaagtaggtaactgcatctatgaagtaaattatggttattcttttaaaatcacattccattgagttgtttttgttccatcactaacttctcttggaagcagagagtctggggagcagtccttttttcctgtgtggctttgcacaggtcacaaagtggctccaaacccgttctacctgtgagatagacaaatacctccctcacaggctttttctgaggattaaggaaagtaataaatgaaatctttttagcaaaagtacaagcattttgtagatgatgaatttggaatagtttagatttcagtttacttagatggaaatttctaagagaggtttaatcagtgcccttgctcaggcacagggcggcttgaaagagctaaagaaactcaggtgcgtgccaaaacaacacaaatgttttaaagtggttatgcggcctttccgtatggattcctttttatgcactggcaatgtgagtagatgctcaataaggttccttccttcctcatttgtttaattatttattcaagaaatagttattgagtgcctagtctgtgtcagttggtgagtattgtagtcatttacacattgttaatatatttttatgactaaatttgatgtttttttttttttgagacggagtctcactcttttgtccaggccggactgcagtggcgctatcttggctcactgcaaactctgcctcccgggttcatgccattctcctgcctcagcctccctaatagctgggactataggcacccgccaccgcactcagctaattttttttttttttgtatttttagtagaggtggggtttcactgtgttaaccaggatggtcttgatctcctgacctcgtgatctgcccaccttggcctcccaaagtgctgtgattacaggtgtgagccaccacacctggcctatgactaaattttaaatcccacttcaattatttgttctttgcccagccagccttttgcttctgagtagcagaagcatgtaacattctgaagcaaatatctaaagccaactggccacagacaaagatacttataggctattcctgctcatgcaattggcctgtcatcacaggcctttggccgtatggaggctgtgaaccttcctgggctaccccagagagggtcatgcagcattcttgggagaactgagtcactgtcccacctgcttattcattttatagagttgccatggttcaaaatgaatcagtttcttccagaccacgcatctacccattctgtataccaaagatccctccaaactgagagtccatgaaactacattggtcctagcaaaacttttaaatagaaaagaaattgtataaaaaaatcagtaatcctttaatctagttccagatcttaagtgtactttcttcatgaccttagataaatcatttaatagcatggttttggggcatctgaggttaatctgcaaaggttaacatcactgttaacttctatctctatgcccttgcatacagcaaagtggcttgtaactcctgtaagattcagttcctcatatacaaaatggggataaaaataaatgcccacctaatagtgtcactgtgaagataaaatcagatagtacatgtgaagcacttaaaggggtatatagtaattgctcaataaatgtcagtcttgaataatcttggggcctcagtgtctatatctgtaaattgaagaggttggactagagaaagaattgccaagttgccttctagtgctagcctttactgttctttgacttcccctcctctttaaagattaggctcaagattaggctcaatctttctgcaatctatatgttgaggttttggaaggctccagaaataccccagtactcagtatgaagactgaaggggtggatgggcaagtaacaaaccatctgtgatttttgggtcatcttcccactaatgagtaggctaatcaacaagcacttattttgagataagcattgtttcaccagatgatctggagtgaattttagaaaagaaatcaaaatcaatagactcaactcactttcatccagtgataaaatatacacgtgaactaataacatataataaacttcaaaattttgtagtacaggtaatcagagaataagtcaacaaaaaataatattgggtgaaatgtgtagcaaaatagcataatgaagtgcacttactataaatgcaaaagaactataagagatacacttttgaattataaagaatgcaaaagtttccagcgatcagaaaccctccaaagaatgccattttgagcattttgtatttataactctgccattacatttgtaatcacaagaatagaaaataacttattttctaaagtggttaataatgaatgagtttcaagttgtagtcagtgccacaaagaatccatgtggctggttgtataaaagggcatatttactcatgtctcatattctatttttgttttttataaactcgaaatttattaattctctgccttaggacaaaagagaaaaaaacaacatattttcccagccacggcatccaagtctgctataatcccctttgctccattttggtttcagccggcacaggggctttgatcaaagcttatatccaagataatcaagatgaaaggagacgtgtggtgcccctgctgtcctttgtgtctctgtgggggtggggcacagttgctggaactcttctctcaccctccacacaaatgtgtggttgtttttataccaaaacaaacaaaagcaatgaacaaacacagatgaaaagttttgtttaaaaaaaccccactggcactgaagaaagggcacatacaattgcataccttttggtgaatgatattgtaacattagtgtaggatctgaggtcaaagagccaactgtttttttttttcttttacctacttgaccttcagcaatcagagtaactgaggtcagagtctctaatcgacagacatatcatcactgggtctccatcgcttcccaatcccaggtactctgattttgagttttagtgacagggagaactggcagccagtttttagaaagacggtggaaactgtcaaagacgtctttatcaaaaagggtaaagaacccagcactttgggaggctgaggagggcggatcacttgagatgaggagttcaagaccagcctggccaacatggtaaaacccctgcctctactaaaaatacaataattagtcagaagtggtggttcacccctataaaaccagctactcaggaggctgaggcaggagaatcacttgaaccccggaggcagaggctgcattaaaccgagactgtgccactgcactccagcctgcgcaacagaggaagactccatctcaaaaaaaaaaaaaaaaggggggggtggggtggggtgggggtaaagaaaagggcaggaagcaccattgcaagctggagccagaatgatatcacccctgaggggtccttctttttgaggatcccattatctcctacgagtcctgatgttctgagaaaaatgtgtgagctgctttggctaagctgcaaatgattgtagagtagattctcaagatgtattttcatgttgttccctttctttcaacgtaggagataataacttggcccagcagctagcagttctctgtggcagagagatccctgggcccatccggtctactggagagtacatgttcatccgcttcacctcggactccagtgtaaccagggcaggcttcaatgcatcctttcacaagagtaatgagttcaaatattttttaatcccatgttatctcatctcctctcttttcctctctctttctctcttcctaatataatgtttttgggcaccaggacacaagacaagtcagaggacatgggtctctgcccaggctctggatggctggctccccttacatcagtgctgagtcctcatccaaagcactggggccaagtcgtacaaaagtgtgctgccttcaggtctctggtgtggcatcttcgctccaaaggaggtgtgtccagggaatgcatgagagagagctttaaagcaatttttcagcctagctgagggctggaactagatagagcacagctcatatccataactcatcgaaggagcaaaacgtcatcatttattctcataaattacttggttgaagtcagccatctgagggttggcaggaagagtttgttgctcttgaaatatgaatttgatgagtcaaaagcaggcaccatatatgggataccatcatgcacagtatgattgagacttttcaaacttgacatgtgaagtccagtaacagccttaaatccaaactaactgaaaggtgataaagtagtccaaggaagagtgaaagactctcatgttttgatcaaaaaacataattttaaagtagattctcaatctaacattaaaaattaatctaatatttcctccatgcttatatataccttttataaagtagggagcaactgaagataagttgtgttcctcacgctcaagggaggcaggctgcatagtggcttaagagcatgggctttggaactagacctaagatacattttcacctctacaatttaactagctgtgtgagatgtctgcccttactgatgagcttctagtccctgacaactggagaattaatgcctcctccttttatcctcttcctttatctcctgccctctcactctcatgtatatattactatgtatcgcaactcattatacatacatacatgtatacacatgtatgtatatagtaagggtggaaccattggaattaatatgtgtgtttatatatgtatataatatatataaatatgtgtgtgtgtctatgtatatatacatacttggcagctcccggtctagaatgtatttcaaatttaacctgtgagtggtataatggactttggagactcagaagcggggaggatgggtggggtatgagggataaaaaactacatattaggtgtaatgtatactagtcagggaaccagcgcactaaaatatagacttcaccagtatgcaattcatccatgtaacgaaaaaccacttgtatcccaattagattagatagatagatagatagatagatagatagaaaaaaaaatttcacctttgaaagttgaacactttattcccacccttttccatgccaccaccccccaattctacactcctcataatctcagcaaatggaaagtacatttttctcattatttaagtcaaaatcttgatgttatttttgacttttctgtttgtctcacacttaaccatcaacaaatcacactggctctaccctcacaatgtatctagattccaaccacgcctctccatttctgttgctaccagcctagcccgtgcacctatcatctctccttggcctcaggcggtcccctccttattggacactctgctcctgtccttccctgtcctccaccccttacagtctaaggactgcacatagagtgacattttcaaacttaagtgagatcatgccattctgatgcccaaaacccttcaacatcttcctcttcttattcagaataagtcttttcagtttcctgcatgacctagccatgctacctttggaatctctcattctgcctcatccattctgacttccatgatgtacctctaacacatcaagcctttacactgttttctgaactggaatgttttctcccccataactatctggcttgatccttcatttcattcatgtctctgctaagatgttactccaatgacgtggcttttctaacttaactctaacaataaagtacccttctccctcctctcatccatttttctttatagaatttatcaccatctcacatatcatgtatttgtttattgtatgtcttccccagctataaagaaatctttatgaaagcaggtaatttgtcttgtttacttacctctgtatcccagatctcaatgaccaccacaaactgagtagccaatagcatgtgctcaatacatgcttgttatgataatcatttcctgcactctggctttattttcaagcatttttattgcctccactttgaaaaccccccaagaaaactaagaaagcataaaaatccagttgccaatgctatttaaataaccgacctttgtttctttgtgggaaggctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtggtaggtcttgctgctaccctttctaattacattttccatagacttcattcagaaaacaaaatgataatttttctctcctgggacataaatggataagaattgcgtactccttcttttgcaatgtaaaggagttgatgaaattttaatttgtctttccagctaagaaatggtcctgatatctattctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttaggtaagtattttcactgagaattatatctgcttttcctgcaattgcttgatcttctttgatataaaattttcttttctgaaccaacagtaatagaattaataagaatgcctactctcaagtacttattatatttgatacattcaatatctcatcgtgactacttttcaagtaaagtatcattatttccattttaaagataaataaaatgaggcttggacttttccaaggccacatacctaattagtgaccaaagtgaaattttccatgagtataaaataaactattcttcttgatccctggaattccttagacctttccattataagatgtctaattgtaagttaattctagttacagaaacattataagacttacatttgccttattttgtaataatttgtatgctgttttcaaaagaacacataattttttgattctattattactgatttaattatatattacatgatatctgtaattgcttgtacttaattacacttgattataattgcatttaattctactgtaatgatttgattttgatgacatttgctttttagtaatgtttaattgaataaataaataaataaataggcatcacttcaaaaaaagggagtaatgtcagtagaaagtaatataataataaatttttcctttgtcccaccagaagttagataatatagatttcaaaatgatcctatgacttgaatcccagattcatatatatatatatgtaaatgaaatcatatgttttattgcacattgtatgagatttaaagtcaacatggtttctttattttggtaaaagagatgaataagagtcttcaccaactgacacacaaaaataagcaaatagcttgagtaaggtccagaacaccagggaaggagctttggtcacttcccagagctctggcacaaggagggagctttaatgcagctctgtgggcacccgcgccattgctttctaagctgggaccttctcatccctccatctcttgatgctgagctttgcagctgagtcatgaatgggcagttttcacctggtaccaaagcatttcaagagtagcagtgtcctgagtctagtgagtagacgtcagcccatcctacccatcctacataactctactcttttgtttttgtttataatagactcagtcttttttttctttcttgagacagggtctctctgtcgcccaggctagagtacagcggcatgatctcagcctactgcaacctctgcctcccaggctcaagtgatttcctgacccagcctccctagtagctgggattataggcatgcaccatcatgcccagctaatttttgtacttttggtaaacatgggatttcaccatgttgcccaggctggtcttgaattcctgagctcaggtgagccacctgccttggcttcccaaagtgctaggattactggagtaagccaccgtcctcagccaatagactcagtttgatttatatttttaaagtcaacatttagtggtaattcagatacactaagagatacactaagggtgtgtttgacattgcacctcttctattcctttgtggattcactgttcatgcaagtatggttatggccattactttctccctgtctttcttgaagcttattatgactgctgttaacatcagacttaaaagtcttttgatttcacaacctgttcttggcaacctgaaacaacagcatcactgttatttctctctacttaccaactcaagattgttccataactatagccagccttctacttcccacgtctatctggctatcttcccaccatatctatttccatgccactcccacttctcagcctttaacctaggtccttttgtgaacattttttgacatcaaatcacctagttttataccatttttctccagagacactccttcgctatggttgattgagatttctaggaccctgtggtagatgccttttattctcacctgattaataggcctgttaattaattagtcaaacatttacaaggtgtttcacatcatgcaaaccaccgagttctgccaaggagttcacagtgtggtaaaggagacagacaagcaaaggcacaattagaacatgatataaggctgggcacggtggttcacgcctgtaatcccagcactttgagaagccaaggcaggaggatcacttgagcttaggagtttgagaccaacctgggcaacatagaaagaccttagttttcaaagtagctgaacatggtggcgcacttctgtggtttcagctgctcagtaagctgagttgggaggatcacttgagcccgggaagttgaggctgcagtgagccacgatcataccactgcactccagcctgagtgacaaagcgagaccctgtctcaaaggaaaaaaaaaaaaaaagaacatggtatatggtataataagtgctagaaagaggaatgcacagaacagaaacacctacttcagcccaggacatcagagagggttccaggggaagtggatgaagagatttgcccatcagtgataaaaagatgtgaatgcatagaaaatctcaatgttacaagtcatattcaataatttgaaagaattcactactgctagagatcagagtcaaaaagagataaacataatagtgatgaagcaggcaggaatcactctgctcagggccctggatgccaccctcagttagttaagatgttaatcaaaaggttatgggaggcattggaagtttttgctccaaagcctgaacagcgtgatcagattaaaaacactaatgtagctgcaacactgaaaacattggagatggggaaggctgaagagagagagaccagatgaaagagtaatttagggaaaaaatttactccctgaactaaggcaatggcagtaagaaggtaggagagagggcatatcaaagatattataaatacaggattgagtgaatttggcggtcagttggatgtgaggcaggagggaagggatgggaggagccttaggagcagttgttaggtttttggctgggtggatccattcttcccacagacatttatcaagaactttccatgggacagacactgtatcaggccccggggatgtggcagtaaacaaacaaaatccatgtcctcatggaacctaattctagtgttaagatgcagacaataaataagtaaaatatataatatgccatatggtgaaaggtatcaaggagaaaaataaggcagtaagagtggatgcagagtgtccataggaagaggggctgatgctgtcatcagcagactcaggtatggagctctggatgacgagcaaatgagaatgttcatttgagacaagttcagtttgaaatctctgaattacctccattggagatgcccagtaagtggtcggaacaggaatctcgaggtcagaacagggatctagactgaatctgtaaatacggaataatcaacagactgcttatcatttaagtcatgaggatgtatgacagcaattggggaattattcagagtgagatgaaaggcctacaggaggattcctgagggcctccagcaatgtcagggaagccctggagagatgcgcccaagggccagaggaagaatgacatgaagagtaaaaggaggagaagagcttggtgtcagaagccaagggacaaaaatgtaaagaagaacagtgtgatcaactgtgttaaatgctgtggatataaaataagaatttaaaaagttctttgggcatataactgtgaggtgacttgggagaacatgagtgctttcatagggttgaagaaggaagggcaaaaagagagaaggagagagacagacagacagatagggagagagagattaaatagggcaagatcctggaggagacagtaggatgggaacttgatccagagatacaggaagttaatgtacagagggaaaaatagagtgtagagatgcagattaatttattgaggatagtaataaattaggggtaacaaatggaagagattctcatctgatttcttctactttctttgtaaagtggagcctaatgtaatgtgcttagaatcaagaggaaatggggaaagtcaagggcttagggagtaaagttccaaacagccattgtagtttatatgaaaagtaatgggtgaattgcttggctgtgttgagatgggagaacatatatttgcaggggcatcaatttccttgaatgaatggcttgaattgaacacaaccacggagttggtattttgcaagggaagtttgaaggaaagacacgaagcaagggagttggagctcatcaaagggatttgcaatttagagtttcagagatgggggagttggaagtatgacagaattcaggatgtgactgtaagtggatgagtgacagtggacacaaatgttctagagttgagcagatcaagtatgtgtatggctaagtgattggacaggttaatttcattggcattgtaagtacttttactcctatctggtttgtttgttgaaaatgccaaagaatatttattgataatagaaaaatattttttgataatgctttggttttttagaaaagaaatattaaaaagctcctttatcctctggcataacattactaataaattatttcattccattgatcttggttctcaaatgcatctaaatcctgaagaaatctaatgaatgaatgctccccgagttgtgcaaagatatatctgcttagtcttttaaatataccaagatcatagctctgcatcattctgctgtactgaatgctcagtgggaagctgtaactgctagcatacttacatgcttatcgaagtggtggatatttattcatgcttctgtgatgttctgccccgtgcaccatgtgccataatcatttggttggctttaagaaagaatgaaatttccaatgagaatagataaatggtctggcaaaataaaaagtgtcacacctcgtagctccctcgatagcaaattgagaatttgtttgctggaaaagaaaatgaggatcataacagatgaaaggaaatggagacaaaatacagagaagtcgactttaaaagatgatttgtggccattgactgcatccccttcaccagatcatagactgatttaagtgtgtttgctcacagcctgtgggggcaacgtctacatccatgatgctgattctgctgggtatgtgacctcccccaaccaccctcataattatcccccgcacgctgattgcatttggatcttagcggctccaccggaaacacgcatacagctgcaatttgaagatcgattcgatattgaagtaacacccaagtatgtcacttccattttcatttttttcctaccccaagttagtattttttaaccgtcatgtctcaaaacagtccatttctttcagtagcacatactgcaaggaaatctaggggaaaagggaaatgcttaatggctcaggcctgaaaacacagtcggccagccactctcccatcagctgagccggttatgtacgtggatactgtcccttgtgaccctagacacttcctgcaagggacactgagggtggctacttgagattgatgttatccattcttcctcccacaggaaatatatcatgtttctgatagatgaatatttatttgaccagcctcatattcggtgtcacaaatgataaaatgtctgtttaacaaatgggaatttgtgtggtgtgtcaccaggggtcagcactgtcggaacagtactaaagcatgcacagtataatttctcagtctttatttaataagagttctgaaaggattacaaaacagtaagtcttactatgttgaagagaaagaaaaactatattgatcgtagaaaacatttttctctttccttgaacaaaagtatgtatacatttgcatgaatgcagctgtggtgcaaaacttggatataagatcttctgttgctatttctggcactgggtctaatactacttttccactcatggagcattaattggctaatgtgacttcctgaagaaacgttagatacatgcttatctacttttatggacacagaaaattccagttgggacgctccattagtcccaattacagagctgttagagaatttatctttgtcctgtgaaatgtatcaagtcattgtgtggaacaaaatatttgttgttttttgaaattcctagggactaatttgaaagcaacatttatgtttgtaaaaccaatacagaatatggaagggaagtaaatattcttgaatgtagaacatgtaaaacctgtcttttgagctactaataaaagaatgtattattaggaaaaatatcatacagcattttaaagtgacatggcttatgctgattctatcatagttttttatgctaagaaatgatgatttaataatatcttcaaagaaagtaagtaaggttgtcattatcaaaataagcatctgaccatgtaaatttaacagaattttgttcccacttcagctgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctataggtaataatttttttaaaacttttattttaggttcaggggtacatgtgcagatttgttatataggtaaattcgtgtttgggggtttgttgtagagattatttcatcagccaggtactatgcctagtacctaatagttattttttctgctcttctcccttctcccaccctccaccctatcaaatgaaagaaaattccgtgctcatggataggaagaatcaatattattaaaatggccatactgctccccaaaatttacagattcaatgggattcctatcaaactattatgacattctttgcagaactagaaaaaactattttaaaactcatatggaccccaaaaagaacccaaatagccaaggcaatcctaaacaaaaagaacaaagctaggggcatcacaatacctgacttgaaactatactacagggctacagtaaccaaaacagcatggtactggtacaaaaatagacacatagaccaatagaatggagtagagagctcagaaatacggtctcacacctacaggcatctgatcttcaacaaagctgacaaaagcaagcaatagggaaaagattccctatccaataaatgatgctgggagaactggccagcagtatacagaagattgaaactgtaccccttccttatatcatatacaaaaattaattcaagatggagtaaagacttaactgtaaaacacgaaactataaaaaccctgggaaacatttttatattaaataagagttattatagaatgaatatgttaaaacttttttaaaaaccatgactttttaaaaataagtctatttgcctaattttaaaaatattttaatgctagaaataagtaaggagtgtaaatgtttgaaactacagtcattaatcaactttaatttctcttttaattttcattttaaaaagtaatcttagtaaacttaaatattttatattttctctaacttatttgtgaagaaatatatgtggttaaatcaaactcctgtttcttcagcttactatgaaatacagtagttctctcttatccatggtttcatgttccatggtttcaatgcccttggtaaacagaggcccaaaaataggtgagtacagtacaccaagatattttgagagaccacatttacataacttttctaacagtatactattatgattcttctattttattattagttattgttgttaatctcttatgtctaatttatacagcaaactttatcataggtccatatatagagaaaaaaacagtctatatgtctgtatagggtttggtactatctgaggctttaggcactcactgggggtcttggaatgtatcccccaaggaaaaggaagaaatgcagtatgtttattactttaagtaataaaaccatttaagaaccaggtaactctatttagcacagtgtctttgaattcctcatcaaatataaaataattaaccttttttttctctgagtctctagtgccaaatcagtcactggataaaaagcaaacatgtcagtggggcatggtggctcatgcttgtaatcctagcactttgggaggctaaggcaggtggatcacgaggtcaggagttcaagaccagcctggccaagatggtgaaaccctgtctccactaaaaatacaaaaattagccaggcatggtggtgggcacctgtaattcctactactcaggaggctgaggcagagaattgcttgaacccaggaggcggaggttgcagtgagccgagattgcgccactgcactctaggctgggtgacagagcaagactctgtctcaaaaaaaaaaaaaagaaagaaaaagaaaagaaaaaaagaaagcaaatatgcctcttcagcattttgatttccttatttaaaaaatgagcggttgaagattcactataatatggtcacaatagcacataatttggtatctaataggtttagacacaaaccaaacaaatatttaataccgcgaaagttcagaaagcctagtggtaacaatgtttaactacaccatagatcgtgttatatcctgagtcaagctgcatataattcaattagctatcacacccagctaataagacataattgaatagtaattttcaaggccctgagatatcagttactgtagtgaactgtttagttgagagtaaaactaggaatggcaggtgtccccacagtaccccttccagctgagcttgggttcagtctttaggatcaacacagggtactaggcaggccagatcagcctatcagttggttcttgagatgaaacttacttgcgactattagctcttacatagtgtcccaaaagaattaatgtgacattacagaatattccatttagtcatcatcttctgtttcccattattgtattggacttgtggtatcatttctgtttacatcaacagtagaattcaaataatgaggaaagcactaaccgttttcagaatttttaaaacttcaattcagagtcacttggcacctaaaagttttcaaatgtgctggtgaaatgaagaaaacaaaatttgtaatagaatcaatctttcttgcttgcttgctttcttatttatttatttatttttattttttgcagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggttagtaaaatatatctgctctcttttgggtgtttattttcacatgtacttattcagcctctgaagtttcttcacttccaagaaaggcaaaagcacatctatactctgcagagaagtgcagactaatgagctttgggcagtactggtgattctctccctcaattctaccattaacaatggatgcccagagcccaggtgtcatatagcccaccctggaggccacttggggagagcaacggtagtgggaaggcacctcttgctgctgagacatcccattgccacatgccgttatttgaggggtgttctatagcttgagatggggaagggatcatgcatgtctcctagtggtagcataaggcagatacttgtcactgttgtctcagatcattttttcaaccaaatgagcaagccttcctcattgtgctgagatatccttcccctaattggttgcatttttttcacttcttcatgtatttgaatatgttcatttttattcatgttttcctgttgtcttgacagagattaacgtttcttcataggcagggtcttgttttttattattttctttgtacacacaggacaccttgaatagagggtaaaggaaatcaatcacttggacatgtatatttaattatttgtctctcacaggaaacatcttgggcagatactgtggaaacaccattcctgacagcatagacacttctagcaatactgctgtggtcaggtttgtcacagacggctctgtgactgcctcaggattcagactgcgatttgaatccagtatggaaggtgagttcattgattcattcaacacaacattgagcacctgcattggacagacactatgctaggcaccagtgttaaaatatttgaaaaacaaaacaaaacatgacccctattttcttggaccttaatcagaaattcacagtgataaatgaaaaattacagctgtgatcaatgctataagggaaaataactagtatcacgagagagataataagaggatgagagttatactgtaatgcccaccttaagagagtcctgtagttactcagaatttgtcttactgcaaacccaacaaactcaaatgaaataaagatcttgttcagaaaaactgggtacttaacattaactttctgattttcctcttttttttttttttgtgaacatggggtcttgccttgacctcccaaagtgttggggttacaggtgtgagccaccactgctggccaattttcttgattcttttttttttcttttctgagacagtgtctcgctctgttgtccaggctggagggcagtggcatgatatcagctcactgcaacctctgcctcccgggttcaagcaattcttctgcctcaggctcctgagtagctgagattacaggcgcacgccacgacgcccggctaatttttgtatttttattagagacgggatttcaccatgttggtcaggctggtcttgaactcctggccttgtgatctgcctgcctcagcctcccaaagtgctgcaagtgtgaaccaccatgcctggcccgattttcctgattcttaagttcattacattcattggtctctcatttcttgggccatgatgataactaaattgctgcctgtggactatcacccatggaaggcagggttaaatattaatagagataaaaaatgaatgtatatgttcactaaaatcctcatgcacataaataaatatggagactaattttatctagaaggataatttttaaatacctgaattttgagagctttcttgatggaaggaaacattttgatttgattgaaagttttcttggctttttccccacgtcagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtaagtgttccctgccgcctgagatgttatattccatcatttaaagagtttaccgacccataaatcatagtcagaaaactaggtcaggaaaattgccatctatgcaactataactcagacaaattctaagtattgttgaaagaacaaaatcacagtaacctgtcaaaataattgtaaaagttgtttgaagagactatcagctatcactctgtgcatcagggtcatagaataaattttaagagtgaatgatcacgacaaatggcaaaaccggagaggctgtgggaagctaagcctacagcagcacacagctgaatgggaccagagtcacagcacaagccaccacgaaagttctgagcaggtgggtggtcctgcataagcactgctctctccaggggtacagagggactcttggtgggagagcactgctacgtgacctccatgtcaccaacctccagtggtttcacatgtgtcttcagcactctcagcttcctgcagtgaaagaaagcaaatgagatccctgagtgtgaataacaaatagattgttaactgtgaagtgctgtgcacacatatgtgtgtgtagataggaagattggattaatattagtaaatttatccacccaacttgccccttctgcagtgtttgttatctcagtaaataattccaaacttctggttgcttgggtcaaaaatcttgatgtctattttggaatccttcctctcacaccctatatggcatctataagcaagtcccattgggtgtatctttaaaaatatccacaattgaactatttctcatcatatctgctactaatacccccaccgttcacttggattattttagaaagttccacctcgtccccctggttccgttctcctctccctacgttctcaacacagcagcatgtgatggttttaaacctcaatcggatcatgttgctgcctttgaaaatcctctaatggcttctcatctaactcagaggaaaatcccaaattgcacctgtggcccacctggctgacattatctgctgcccctccctcttctacctgtttgtcttatctcaaactcctctcttctttgctctctgggatccagccacctggcctccattccgttccctgaatgtgctgagatgctccccatctggctgttgccttcatctggaatgcccctccccagatggcggcctgctccacaccctcacttcactggggtctctgctcgaatgccttttaatccataaggtctaagtaccttatattacagaccccaccctggcctgacccttctctgccatgttgttttgcagcacttcacacctgctgccatacatcattttgatttgttcatcagtttattgtctgcttcccccactagaatgtgagctccttgaggtcaagccacagtttcattcactgctggggattcactgaatccccagtgcctgtacataatagagataaataattgttgaatgaatggatagtagaggtactatcattatcccttttataacaagccacttttgttttcagtttaatcgtctcctgttgggtagtgaatttcaaaaatatgaaatatctttgtatcttatgaccactttgtattgccgtaaaatgatctcattcaaccttcagattttatttccaagttctaatatctgaaggactgaactgttgtctttcagatcttgaaaataagaaaccaagtgtgttttcttttatttgagagccaggaaattttggactaaggttgtttattataaagaaacttttttcctattattgattgaattatataaacaaagatgaagtagaaaaaatactaaccactcccactataccacattttgattcattttctcatctcttcttggcaaagcatactttatgtacttgtaatcatgtgatataaatccacttgaattctgattttaatctatttttctggttataaatataatggatgcttattgagcaatatttggagagttcagaaaataaaaaatataaagatatttttaattctactcatgtattactaaaattttgatgtatgtgctaacagttgttttttacctttgaaattattttcatagtttaaatcatactgaatataatgattatcaggaattttacaagcagagtattcacatgtcctttaggaaagagaatatgaacagtcatagttttagatctcaaataaaagttacagtcacaaccacaaattccaaagcagatcttacttgtcatctccctatcccttaattatcaacttataactcttgcagctactgctggtgggttttatgtcattatttctaaataatattcctattctactactccttgctttttttggacattatctatccacatcctactctagaagatgagacttacccctttgccaccacaaacacacatggggtatgcaatgtttatatactttcccaatcgtctcccaaaatacgtatgtcacgcttttgcttaaattgctgttcagttgacattaccatgattatgtaaacaccattcacaactgagccaagtagtgtagtatggcaacatttgcttttgttttcctaaggaataataataattgggtcctctttacattttcttgggttttatgcattgatcaccaattcgtccacaccctctccaccccagatgtgcatctctaccttctgtagtaaaacatatcagttccatttcttttcctcagtaatatccttccttgagcctttgtacgtcagctgcaagcctgatgctagctgtcatttcagaatttccctttgccatcaaatgtgcaagttccttcattcttctcctgggctagagagctgactttgtgatgctatgcacgtccctttcttggttaatttcctcttttggtgaggcataccctcttgcggctccccaaggaaatgggcaagggcaataaatcttttgaaaaatggtatacctgaaattatctttattttaccataaatctttgaaaagtatatatttaaatattttatatgtttgatatattaatatatatgaatatattaataataattttgaagttttgtgttgctcatttggggtcagttttcttcatgttcctatctcctgtttactaatattggtctctgccttttacattagtcacttccctaaatgtctgctgatccttggctattcattcgtatttaagaatgaattactgaaaggatgactggtatctctgtatgcatgagggggccctgactctttagcaaaacctgcaaacctacaaatgtcatatccacaggtcttttctcttggggaggttaaaactccagcgacgaatcactttcagaattaatttttcttctgagtctttagttctaatgtccacattcctttttttgaaatgtatttttatatgttcaatgtttattttggttcctctttaccctgctccaaacaagggcatgtgggttggcctttgcccctactctatttgattgagaacttgccgaaaagaggaagaagaaagatgaaagaggaagaagaagaaagagaaggagaaggaggaggagaagagggagaagaagaagagggagaagagagggagaaggagaagagggagaaggggaaggagaaaaaaagaagaacaataagaaggagaaggagagaagaagaaaagaagtagaagaaggagaaagagaaggaggaggagaatgagaaggagagggagaaagagaaaagaagaagtaaaagatgaaagaaaaaaaagaaaagagtgaagaagaaagaagatctgctggtgcagaggaggcagctttaactttcattgcactgcttcctagctaataccttatccagctggaatgagcctaaaatttctctaaacccacctgcctatctgactctctgtacagacagagaaaataaaaagctatgccacccagtgtgtcctacaataagacctgtgtctgatgttgtccctgctcatagcagatcctaaatctcacgtgcctgcttcctatccatttgtactctgagagttgtagtttctaagtacaaaagggattagaggacaatgatgggaattgcattctggttgcttctaacagcagaagtccatgtgataaatggatgactataacatgttcagtcattgtgattctatgccaaaggcagactcagaggcaggataacagccattgatcacagtttccgacatgtcccattaaccttatggttggttctaatcccttttgattccatcaatgtggtgcccattcctgttttcagcattatagaaatatttttcctcatctgtttctttatgcattacttaatggtttggaatcagagggatggtttgaatcccagttctattattacatcatctttctggattctggtatcttaatctggaaaacagggatactgttatctgcctgggagggtgttttgttgattagataagacaggctgagtggatgataagcaaagactggcatttttgtctgctcagtaaatgatagcaaactcttcttctggtccagtgagccagaagacactttacaccagaagcccccagagagctaaatttgattaattatagtaaatttaaagagatgacatcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaatcagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaagagatgacatcttttgttgtggagtgcattctccttctgcataactgttagtgccatagtctgagtcattatttctaatcttgagtcattcaaatccttttaaaaatgggaatatcaaccattcaatcaatgaattattgttcagttatttcatctagattttttttgaactgtgaaaaccagtcatgcaaattcatttgattttataaagcattggaagaatagtttgcgaattattgtaactatgtgaatgactacagctattatttaatattttagagtcaataataatccattattggaaattcaaataagtaagaaaattgaagctttgaatccataactaatgaggaaagaactattatgtttaattgcagatggagattgatttttcaaattacttttcaaagtatttaaaaatatctgcttgctgggtgctgtggctcacaccagtaatcccagcactttgggaggccaaagcaggtggatcacctgaagtcaggagttcaagaccagcctgaccaacatggtgaaaccccatctctactaaaaatacaaaattagctgggcgtggtggtgcatgcctataatctcagctgcttgggaggctgaggcaggagaactgcttgaacctgggaagtgaaggatacggtgagccaagatcacaccgctgcactccagcctgggcaacaagagcaaaactctgtctcaaaaaataaataaataaaaattaaagtaaataaagaaaaatatctgctttattatgtacatgaaatcatcagaaactgatatttaagcttcccttccaagtaacaaatgtcctgatgcattgttaagaaaaactgcccatcagtgagctctgcagaccacattgtaagcacaatggctcatctcctttacattgagagcacagtttccagttgcaaagtgtatagcagcttttaatctatcaccacatggcaggaaggcattactgcaatactttcattctagtgaaatcaccctgaagtcacaaaatgtgctcggggtaacagtggcttgtggcactgcgatagaaacctgcattgttaggtcattcattttggggcagggttcccataaaaggaagtgggtctgggctggaaatatcacctcctaggaaatatgcagtaagatggattgtgtgcctgaaggttaaactctttttccaacaggtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcaggtaatgtaggatgttgtaaatgccccccattttaatcaggggcactgcagatgcccccagctactgccaatggcagcagagccatccattttccctttagtgatacttgaaatctttgacataagacaaacacacataagcagatgaaaaacgcactgcagacagaaaaaaagctttctgatttcagaaagaaactgccatagtgaatttaaaacttttaatgctattagattagcttctagcacagtttcaggtcatgttaccatgagggttggtgacctgttccgtagtccctggtcaattcttttgtgctgaaagaaaccatctacctcctagagggtaacttagtctcagagagtaattaattttgctggggacagaacaggctttattgtttctagtcatctatccacacacatatttccagtgaaaataaatgggaggtttgatttgatatagaatattccaaaattaagcaagatatggcctctaattataaatatcctcctatttcctgaattgggttcaaaattttaaagggttttaaattttagaagtgggagtgttttaaaatttagaagttttaaaatttagaagtgggagtgaatattaaaagaaaaacgctaagttatttcattggtacaagaagcatctgttcctttattaaaagggggcaaattaatggcaaattaatgtcctattatcggtttgatttaaaataatttattagatcaagtggagaattgctaatcaagccattaggacctgccaccattatatttatgtattcctctaaagtaaatattaatgaacagtaggcctcaatatttggacctattgatacagagccaaacgcccaccacttaatctacagcaacaggaaaatagagaagttgttgatttttgcacatctttcctttataaacttgcagaaacttccataatttgcatgccttttacccataagcttgactgcatctagaaaaacaaatcaaagcagtaatgttgatgttttagttactgttcctgtattgtttatctcttccgttgtggcctgaatcttactactactttctctgttgccttctgttttcttagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgagttctatctaagaatgcgttctcccatttatctacaatattctttttatcttttttgttgttgtcgctgctgttgttgttgttttgagacaggagcttgctctcttgcccggactggagtgcagtggtgtgatcataactcactgcagcctcaacctcccaggctcaggtgatcctcttgcctcagtcccccaagtggcttggactacaggtgtacatcaccacatacaactaattattaaaattttttgtagagatggggtctccctatgttgtccaggctggtctcaaactcctggcctcaagtgatcctccctctttggcctcccaaagtgctggggttacaggcatgagccaccacggctggcctacaatattcttcatatgcttggagactactaacaatgaagggagtcaaatggctctaacataggtacacacgatccaaaagaactctgttcgaagccataattctgtgtgtgcccagctgaggaaaacgaaccccaggaacagtgagtgaggcggatcactgtacaactagactctgtgttacagtcacttcgtttcccggcatgtgacttttgccgaagcgagagtccactactatcaagactcctttccaaggagactgggacttagcatgctcagcatgtgttggcagtttcctgaacttccaggatttatgaaggggctgtgaaattctcctgaggccttaggagttaaaagaagttttgcaatataccagatggagaaacacatggaagctatttggggaaataaccccaaagcagtcatttgtcttggttttcgtgatggaaaaggattgcggtgtactcaataaaccataattctcttaagaatttttaaaactctgtattcaaagaggatgaatcaattttctttctttcccatagtcaaggtgtaggttattcattaggttgcttccatgattatgctgacacgtttttctcagtaaataaacaagtagatagaggaagacaataatattgtaaatagtacgtaatcatccatactgtaaaagttttgctgagttctgtgtaatcccaaaatttaaagaaaaggaggctgaaagcagcagaagctcatcagttagttggtggagaagtccttgggaaactgagaggtcaatgttaattacctttgagaacgtgagcgacagaattttcaggaaggagaatttgatagagcctgtacccacgggccaagggcctcagccagagagtcctccaacctctctgaggctgaagagtctaaaaaggcttataagggaaagggaagttgtggtttgagaatgttctccatggaattctgataaaccctcaccccctctgcctgtttcaaaaccaccggcttgtggtattaagcagaacagctgtatctcaaatttcagtcagctaaatgctgtcttctctttatttgctcaggtttagaggcagttaaaatactatatatcattgatttagaagaccagtgatgtttatctgacagaataaaaagaaagcagataaatgagagctctgttggtgctctgtacatgttcatcaaacccacgaaatgtaatcttcatgaaaaatattaggctcagatctgacagctcttggcctgaatgccgaatatggagtccatttcagttgattgaatatagtgaagaaatctttcaaattttaggcaatgatcactttatcttgaggatatattttatcactgttggtattatatttcttacaccctacaaaaggtgtgtccaaaagtgctattttaattcattgtatctctgtttagatatgctgaaataactatgaaaacacaaattggaacaaaatggtgtccatcatagaggttcatttcaaaattgctttgatttttttgtgtttgttttacccccttggagggactttctgttgcagttaacagagacacacaaatattgtgcaatgtctgctactaaatcagaatttaagtgtgtgtcaatgaatatcttgaaatttgtttttatcaaattcattgaatgtatttctcaaaagctgtatcaatgatggcacttggtatattattttgttcaggtgatgctgatgggcccctgatgtggagactttgtggtccttcaaagcctacattgccattggttataccttattctcaggtatggattcactttgtcaccaacgaacgtgtagaacacattggattccatgcaaagtattcctttacaggtaagaattataattaagatcttgataaaattacttataaagattaatgatttttttccataaagatttcatatatattttgttagatttatttctacatagctattagttttgttaatattatcaatgagattttctaaattacattttttaattggttgtggctgatatctagaaattttataatttgcataatttaaaattattatttaattttaaaattattcaataataaactgcataattttaaaattattaaattttaaaattatccaataattatttaataattaataataataaataattattaataataattattatttaataattttaaaattattttataatttgcataattattataaattttataattttgcatacatgtaactttagtccaaagatctagctatcctcttattagttttaatatgttgtctatagattctctttgatctttctgtgtaaacttctgcaaatgttagttctttatgctttcagtcataatacagaatttcattttcttgcatccttttgctagctagggccaccatcgaatattgaacagaaggaatgatagcatcttgtttctgacctggatgtgactatgacattttattattaaatatattggttgctcttaagtttccaataaatatcttttgttaaagaaagtcccttccatccttagtgtgaaaaagctttttttaaatgtaaatgggcataggattttatcagatgattttctgcatccattgagatgattcaactttttctcctttcataagttaatgtgatgaattatatgaaagatttatttctcttggtaaaccatccttgcatttctgggataaatcctattttgtcatgatgtgtgttttatacatataatgggtattatttgctagtgttttgtgttggatttgcatatgcaacattcagagtttgtgctggaaaacccagccctactcttgactgcttcccttggcaatgggaggttttctagtcccttttcacgagcatgccagtttgtttagattcccaacttcttgtaaaagtctcaattccagtcctgccttctgtggagacccagagccctatcttctcctcctacccagtcatcaaaacctcagagcccaaccctgggacccaaacctgcattctttaccctctcagacttcactctttcactttcactcctctcactttgagtacacttactgcttctagattttggggagctgcttttctttccattgagtttgctatgaatcaaaatatgttttagttatggttttatctaacattcctttgtgttataaccaaatggctggttgaagaaggagtgaaattgattatctactcactcaaccatcttgccagttgattttccttcatcagattcaaagaagagtcaggtttcagtaaacagtattatttgtattgaacatcagaccatattattcttcagaaatgtatttgtttttcaattttcaattttctatgctaataccgtatggaattttgttattcctaaacttttacccaattttacttttcttctatttaatttcatttattttatacatatatatacataaaatatacatacacaaaaaaatacaaaatatatatatacaaatatatatactatatatacacaaatatatatgtactatatatatacaaatatatatatactatatatacaaatatatatagtatatatatacatatatatactatatatataaatatatatactatatatacaaatatatatactatatatagtatatacaaatatatatatactatatatagtgtgtatatatatactatatatggtgtgtgtgtgtatatatatatactatatatggtgtgtgtgtatatatataccctatatatggtgtgtgtatatatatatatatacacactatatatggtgtgtgtgtatatatatactatatatggtgtatatatatacacactatatatggtgtatatatatatatactatatatggtgtgtgtgtgtgtgtgtatatatatatatatatatatatatatatactatatatggtgtatatatataatatggtttttttttgagatagagtcttgttctgtcaccctgactggagtgcaatggcatgacctcggttcactacagcctccaccttctgattcaagcgattctcctgcctcagcctcctgaatacctgggattacaggcagacgccaccaagcccagctaatttttgtatttttagttgagatggggtttcaccatgttggccaggctggtcttgagctcctgacctcgggtgatttgcccacttcggcctcccaaagtgctggtattactggcgtgagccaccatgcctggccttactatgtttttaatcacaaaatctgatggttatgattactacttactttggcattatcggttcttttttttacttctgttttattgagagggttaccaatctcatttcagattgtggcggaatacagataggtgacagtggagtgatcacaagccccaactatccaaatgcttatgacagcctgacccactgctcttggctgttggaggccccacaagggcacaccatcactgtgagtgctaatgactgggtgaaatgcttctgagacaatagaaccacaatagcctgtcctgcatgaaaatggagctcttttattaagcaagtgattagagaaggctttgattctacaatgagatcactgtttttccctaacattttctcactagagcacatacattggcatttattattcatgaagagtgaaatctcttttttaagcatagggaaagatatacacagaagataattctgcgtcttagagagaagtgtattcagtttcttaatatgtgttgccatcccaaaccagggaaatgtcttttctcaaaatttccaagagaaccttcaataaggaaaaaaaagtagaggggaagggagaattaaataagagacaaaaatacaaattataaaaataaaaacaaaattaaacgatttgtaagggccttatcttcgtaacagttgataaaagctcactgacaaccattttcttttttctcctgcagctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggtaaaagaaatgtttgctccatttgattttctttttagtgatgtatagtatgaactcataatatgtacattttgtacctactttacatcaggcttagttctaaatatttgcacatgtcatctcatgcagcaaccctggtgggataacacaatatcaatacctggcatctctattttgcatgggcagagactgaggaagcatgggttgatcatttgcctagatacatagccgataattggtagagtcgggatttgaataaaggcaattcagtccagaaactttgatctcaacacttcatgatgctgccttcatcggcaaaagggtatggcacaacctgggaatctcaagtaatagaaacatgagttggaatcccaagtgcttgaaaatatctggagcctaaaagcagaatgctgagtggtgagctgagggcaggaaaataagtccacaacataaagagccttggtttatatgttatcccttgaacaatgggaaactgttgaagagttttgaaaacgaaggtgacaagatgagatttgtaatttagaacaaatgctgtagtgaatgggtcctgagtcaaaatatgacagatttcattttaaaagaatagtttttgtgcatagaaagtataaacattgtgaaaattctcagaaaatacaaggacttgtatcacatactttattagggatttctgtaaatcttgtatatcacacaagacaattatttctggtagagtcacagttattatgaagctctttgttgactgagtcagacttcccctggttaacaaccactggctgttattgaagtgagaagggagttttaggtgaatccctgatttccaggggtttcacagcaaaagattcggagaatgcctctttaacttcattttgttttgtatgaaaattctagatttttcttcctttgaatctacataattaattttgatccatcagtcagtttcaatatgaatcaatcagattgcttaataaaagaattttccccaactcaaaatcactttctctagtccagttagagtaacgttgcaaatggagtgtagagtaatattctcatgtgtgaatggtaataaaatacagaacttagcattgccaggttacatatactacataggctcaaagagaataaaaatacagctcttgtttggagacaggatggaaatctatcctctctatggcacggattagtgttcttggttgaattcaatatcattgtaacacaactgtaacagctgaaattttctctcaatttaactcacctttccatttatggagagagcttgctgtgcacctgactggaagatgatcacttgtaaaaaatgatgaattgaaatctcacatttggaaatgttccttctgtagcagtcttgagtttccaaaattactttccttgctgattgatggctttttacatggcaatatttcaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggttagtacacttgttcatttaattggagccaagttggttttgtgaacattagtgtttaagctagaaatgattcattgtcgctcaaagtaagaaaattttgctgcctggattccttggatgaaaagtgagaaagtgagaaacctcaactgttaggagctagaatttcttttctttcttacttttctaatagatcctaaagggaaaaatgccctttataatatagggcactaccacaggcaaaatttaaagcatgccacaaaaattacggaacgttgaaggagcagctaatgccagccttcaccttgggcattaagaccccacagtctgaaaaaaccgtgagaaagccatgtaaaaatgatgggaatggggcatcaggagagcaaagctctttcaaaatctaaagttataaatgctgctcgtgtggcagtggcttgtcactttccactgacttgtgactatgatgactgtcttagaaattcatttcatctgtactgttttgcatcttccaagttatatctctaaaagtctgtgacttttagagaaagagtgccttatttccactgtgcctttccagtggaaataacactggtcacgttagcccctccattcatgtctgtcatacctaccacctgcatgttcttctctgagctacttaaacaattggcctttaagttattcaactgtagaatgaagagcatgattccttcttcagtggggctgttttaagcattggagataatacgatgtaataacataggtagtgctaagtacttggaatttaaagtcacttgatgagtcaaagtggcttttattgtcagtgttattacttcctatcaactctcaaatgatgttttatatctcattgacccatgcttactgtttaaatgaaaatctcatatgtgtataacatatatatatatatatatacatataataaaatacatttaatatacacttttcttaatggctttttccatgaactaaatgaactctcttctcatgaaatgaatcaatatcaagtattcagacttaagtaaaactttcaagtgctccagttgtaaaactggaatgtggaaaatggcctaggctcattccttctctggattgaatgggggtccctctgataacatcgggcaagcccaacgctgctgccgagtgggatgtattaggaaccctgccaaaaataagtggccgtgggaagcactcgtcttctcctaatgggcccgagatgcttgtttctgccaagaaatgctgtgtgggtggacggaaccagtaaagggacccagcttcggcaagcagcccccgcaggaagccacttaacacctgtaaagctgagattctctttacccacccagagacaccagggtaggtgggactggaaaaatgggtcccagtcacagaaaggggccagtctgggaagcctctttgtccccacaggccagacctgctcctcttccacccagagacattgaggtacccgggggtattggtaggggaaaattactataccctttgccttcaactgagaaacacacagagtccctcaggtagcaccagcaagaaccagtgagagccccggtagcaccaatgtaaaccaagcagaccagaattccaccacacagattctgaatattgaagagcaactggaactgtaacccacaaaatgtgcaaggcacgtggtaaacataaacagggtgacagcctgctaaaataaaagatttgaataggacccaaagttccctaacataataaatgacatgtcctgggtacaatcagaaagaacacgttgtatcaggaatcaagaacatcacaacttgaaagagaaaagaatcaagtgatgtcaacagtgagataaatcagatgttgaaatatatgacaaggatgttgaagtagtttccattaacatgcttcaacaatcactgacgagctctcttgaaacaaatagaaaatatcagcaaaaaaacaatggttacaataaagaactaaatagaaattatagaactgaaaaatacactaacataaataaagaacatgctgaataggctcaatggtagcatggagatgacagagaatagaatcagtgaacttgaagatagaacaatagaattcacccagtctgcacaataaagagaaaatagactgaaaaaacaaacaaactagatcaacacagacttagggactcatggacagtaacaaaagattcaacattctctcaaagggagaggagagagtgcagctgaaagaacaatcaaagaactagtggctgtaaactttcccaaatttggcaaaagagacacacctataggttcaagaagctgagtgaacctaaaccaagataaacacaaagaaatgtaagttcagacatatcttaattaaacttctgaacactgaaggcaaacaaaaagtcttgaaagcagtcagagagaattgggacattacctagagaggaagaccagttagaataaaagcagatttctcatctgaaaccatggaggccctaatgaattgacaatatattcttcaagtgctgaaacaaaggaattgtcaaccatacattttatatctggaaaactatctttcaggagtaaagaggaaataaaaacttctcatatgaaggaaaactaaacaaaattatcactaggaaacctaccattaaagatggtcaaacagaagttcttcaaacaaaaatgaaattattaaagaaccgtggagcatgagaaaagaaaaaggaaagtggaaaaagcaaaaatatgtatacatacaatagaatatccttttccccataaagcttgtgaatcatatttaataaaacaagaaattataatgccctctgttattcagtataatgatatggaaaagttgaaaggggacctaaatggaaatcacatttccacaagtggtcagatgtggatggtggtagactactataatcacataggcacattgtcacacacagaacaaccactaccaaaactgtgtgaagaaatgtacagaaaaacgctaatatcaatcaaaatggaatccccaagatatcaagaaaagagaaatagaggaccaaaaagcagataaagtaaacagaaattatataataaaatgtagacacagaactgatatatatcagtataattgtaaatagtttagttagaccaatcacaatacaggttatcaagccaaaacatgatctaagtgataataaactgatttccaattcaaccacgtaggtacatgaaaagtaaaaggatggaaaaggatgtcatgcaaaggttaaccaaaaaagcaggagtggatatatttatatctgatgaagtagactttagagtacagaaaattacaacagaaaaagaggaatcttacataatgataaaaggatcaatccaccaggaagacataatgatcctcctaaatgtgtatgcaccaaacaacagaggcacaaaatacataaagcaataactgatagagctaagaagagaagtagacaaatcttcggttatagctgaggacttcaacactctcctctcagtaattgatagaacaactagacagataattgacaaggatatagaagaactctacaaaaccatcagttaataggatctgattgacatatatatgtgtgtgtgtgtgtgtatatatatgtgtgtgtgtgtgtgtgtgtataaatatatatatgtaaaatacaccacacagcaacatcagaatacacaattttttaggaactcttgtaacattccaaggtagatcatatcctgagacatggaaaaacctcaaccaagtcaaggaattgaaatacagagtgtgttctttgagtatattaaaactgaactaaaaaacagtaacagaatatcttattaagcactgagctgagctggagagaactgagctgccaattgttggagcagctaattaaaacaacaggccaaaatgtaagtaacagtcctgtctttcatcattttctgctgtggtgtaagaggccaaacaggagaaagctctgtctccctcaatcgtccattctttcccatgggaagtgcctggtaaggatcagatggatcagtgtagatatagaaatggtctcattgccaagtaagccccaaacaaatatgtgcaggatctgagtgctaaaaataatgaaatgctggcataaacctaaatgaaagagacaattatatttatgaattggaagactcaacatagtaaagatgtcccttctccccaaaatgatggataggtttaatgcaattcctatcaaattttctccaaagtcttttgtaggcatagacaactttttccacaacttatatgaaggcagagacccttcaatggctaaaagaatcttggaaaagaagaataaaatgggaggaagaattctaccttactatttacctaggcttacttatctaagttacagtaatcaagacaatgtggtattggttgaaaacccagatgaaaacagagaacctagaaatacactcacacaaacatcctcaattgatttttgacaaaggtgcaaaaactttccaatgtaggaagaatggttttttcaacaaatggtactagagcaattgaacatccacaggcaaaaaatatgaatctcaacctaaacctcattattttgtagaaaacctcactcaaaatagatgatagactgaaaagtaaaatataaaacttctagagaaaaaaaaatagcagatgtcttcaggacctggagataggcaaagaggtcttagattaaacaacaaaagaatgattcataagagaaaaaataaaatgataaattttaccccatttaaattaaaaatcttatgccatgtgaaatattttcatccagtctgtagccagtctgttcattttcttcacataggcaatgtactactatgtaaaatatataaagaagtctcaaactcaggagtaaaatacaaacagttctattagaatatggacaaaagacatgggcagatagtccaccaaagagactctacagatgataaataccagaaaagatgttcaacgtcattaacttctggagaagtatgaattaaaaccacagtgagctatcactacacacctattcgaagacaaatatttaccaattgcataatatttaccaattgcactctgggcatttatccgagagaaatgaaaactatgtttacacaaaaacttgtttacgaatctatataaatagcacctttatttgtaatagctgaaaccagcactaaggcctttcaacaggtgaatggttaaacaaattgtggtacttgcttaccgtggaatgtaactcctgaataaaaacaaactatttatagattaacaatctggacaaatcactgagggattatgccaagtgaaaaaaggcagcctccaaagattacatactctgctgttccatttatataatattttgaaatgatagtgttttagaaatggaaagcagagagccagaggttagagagaaggcaatgtaggagtaaattgtgtgtggttataaacaacaaaagcaacttagggattcctgtggtattggaatttcagtatcttgaatgcaattgtgtacaacttgtatataacttaatacacacacacacacacacacgagttcaagtaaaactaggaaactgagtaaaattggtgttatgtcaatgccagtaacctggttgtgatagtatactacagttttgcaagatgtcagtattggaggaactcagaaatgtgtacaaggaatttctccatattatatcttacaaatgtatgtgaatctgcaattatgtctgtaaacatttgtttaaaaaatagttgaatgataaaatataacctacaacctgactgaattatatagaacactaagaaaaatcagaaagtttttgacctgatgacagttaagtaacattttgtaggttcaatatagttttgatgagtcctctgtcatatagccaatgaaatgagttcttgataggcaaggcagaaatgaatattgaataactctttaccattgtcatcaccattatcatcattattattaaacttatgttcccaggccaaaaggtagagatgtcgaatctataattaatgacttcagaaaagtataagcacttaagcattcttggattccttcattaaagaacttgaggctctttattaagttttagcccttcttactttgcctgtttagtaatgtttgtaaaaatatagtatatggcccaggcatggtggcttatgcctgtaatcccagcacttttggaggccaagacaggcagatcagttgagtccaggagtttgagaccaggctgggcaacacgggaaaaccccatctctgcaaaaaaatacaaaaaactagccaggcatggttgcacgcacctgtagtcccagctacttgggaggctgaggtgggaagatcacctgagtccagaaggtcgaggctgcggtgagctgtgattgtgccactgcgctccagcctgagtgagagtgagactgtctcaaaaaaatacatatatatataaaatatatatacagattatctattgataaattgtgtttataattttatgaaatgtggataaaaaactgccatatactgtttccttggatatattattagggggaaatctaattagagatcattaagtaaaattgagtaggtgcattttttttcctgacatttttattgatcttaggcatttggcagaatatctgcacttttgttctcagtaggtccagcgccaggcacctcccttatctaataaatggctaatataatttgtcttcagtaggatgactaacagctggatacccagtgcttaaaaatcaattgaaacaatacggctttaaagagctgagaattattaaaccaatgctatgaatcagtgctatttcacatctcttgctatggactgatttcccaatagaaatgtttttaatgacttgatgttttattgctgtgggtgaggaatatccttgagaagagatgtgtttggaatgagtaatttggtatcattccatgtgaagaaaatgttgaatagtcaagtaagattaatacacatccaactacatccttgtttgagatagttgtctgttgagagaaagggcatattgggtattgcagattgcgtagcaatagtcctggcccctacccactagatactacccatcacaccgagtgtgacaatagaaaaatgactacaaaccttgccagaggtcccaaaattgctcctagttgagacctctgaactaggacgagcttctctggttaatatgtttaatgtttttggggtttttttcccccaagttttgtatattcattacctaatatgcatactttccttgagtgactcagcattgtagataaccatgatctctcacctgaactagggcaaaacctacctgactgttttccggcatcctttctgactcctattttccgaattgtaatgttttccaaaaaccaatcttcttggtggctccttgctgtattcaggacagtggcccgagtctctaacgtgtcctgcagccccctctgcaggcttcctcaccccttcctccttggttttctctctcttctctgaactagccacggcctttcctgccatcggggttcgctcggggcaggctcacttcccccagttaggtaaagccaccaattatatattctcaacagccccatcataatgccttgtttatagctggaattttgcatgtaaatttatgattctgtgattcatgtctctgtttttccctggactgataagaattggtttgatttggaattttggtgctcaccgtttatttcctagcaactgttttttgcatgagtatataaattcagtcattcgaggtggccagaccaattaagtgacagcccaggtctacttgggagttgccaaccaaatttttggtgaatagcacacactgactggatgtcagcttttcatcaaaatggaccctacaattccacacagccaagaagtgttctgatttattccatttcatgctgattatacgtatacttggaattcatgcccactttcttcatgcaccacgatgtgcctcttgcttgctggtgttgtccagctgtgaccacaatctgctatcttcccaggagcagggctgagttccacctggctgctccgtctccctcagcacccgggaagctcggctaggtcagggcaactagaagttatgaggaaaccgaacagtgatccaggaaggtggatttttaaaaaatcaccacccagctatgcaaaaaggaacaccatctccttagagaagtcaagaatgggacatgctattttaaaaacagctttaaaaaaattattctcaaaagaaaatactacagatttgtccatgttttgtttactcttatgcttagttctgtatacgtgtgagtgccattattttgaaacctaagtgcattaaaatattgatgggaaacccttgagcattaaagttctgtgtatgtccgtgctaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgtaagtagccctaagaaccaaacccagaggtctttgcgggagtgtggttgtcacaggcaggcagggttggctaaacctgggggtctaggggaggagtatgggggtctacggggaggatgagtcacctaatcccaagaagacacctttcttccaaatagcagtgagaacagaactgaattgagaagtgatataaaagccatgaggggcactaaccaacgtctagaaataagcctggcatccagagtgggctgatattgggcagaagcgcagatggctagttcgttagcaacaaccagtgtggctggcctgtggcaccttgaccacaaaatcccgtggggggcttgaaacacatgcagattcctgagcctcactccaggcccaactgaattcagaatttccatgacgaagtctttcatgcttttttttttttttttttttgacacggcgtctcactctgtcgccaggctggagtgcagtggtgcaatctcggctcactgcaccctccacgtcctgggttcacgccattctcctgcaacctccacctcctgggttcaagctattctcctgccttagcctgccgagtagctgggactacaggtgtgtgccaccatgcccagctaatttttttttttttgtatttttagtagagacggggtttcaccatgttggccaggatgatcttgatctcttgacctcgtgaaccgcccgcctcggcctcccaaagtgctggcataagccaccgtgcccggccggtcttgcatgttttaactgtcatccagagggttctcatgctaagtcaactttgggagccagtttctttgggaatgttctttcctaattttgattaggaaggatggatctccttttctagctattgtacactattagattcgtgggaaatgtagcagttttcaagtcagagaagcaatggtgtgtgcctgttggctgagttaaatcaagtgtagccactcatggcaaaccactgtttagggaaaagtttgaggaaaggaattagaggaagtaatacagtagacaggtttttcagactgaatcagagagtgctggaaaggaagtactgaaagacaaccctagaccaaatcttaggtctgcaggtggtccactgtgtaagtgtgcacgtgtgtacttgtgtgtgttttaatgtcaatttaaaaggatagagatattttcgtgcttgatagatcagagagtgaagtggattaactagtcaatggttatatgaaaacaaatcattttagtggtgaaaagatatttctttctgtttcgaaaaccagggatgcatgtaagaatttgataagagttgggattaataaatccagctagttttaaaaagcaaccattgttgtggctagattacaatggtaatgaaaatagcagttttctaataataagacattttaaaaacattaattgtgtaaagtactaatcagatacaaatcattttttatctgttttatttctttatctgcatgaaccatattctatcattgctcgtttatcctttcttaatatcttaatattaagggatttgcagtagatttgtggtaatattacgaggactcagtccataaaactctgcagcattttctaaaaatgtataatattcttattaagcacatatgtatgtttttaaatcagagctttattctcttcattcttgcttcttccatttggaatatctcagggaactatgtctatagataatttaggaaaatgcctctttccttcatggacaaaatagatacacgagaaataaatgatctgatgatgactttttgttcccacataggatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaaggtaagtttattcttttaaaaaaattacgtttaattgacaaacaaaaattgtatatttatggtgtacaacatgttttgacatatgtacatgttgtagagtggctaaatccagttaattaacatgtctgctcactcacttacttagcactttttgtggggagagcatttaaaacctctcttagcaatttttaagtattcggcaagtaatcaagtatttcaggtattcaaccttgttattcgctattggcaccatgttgtacagtagatctcctgaacttattcctcctagctgaaattttgtatcctgtgaccaatatatcctaaatctccactcccacataccctaccagcctctggtaaccaccattctactctctgcttctatgagttcgacatttttagattccacatccaagtgagatcatgcaatgtttgcctttctgtgtgtagcttatttcacttagcataatgtcctccaggttcatccatgttgtcacaaatgacaagattttattcttttttaaggccaaagagtattccattgtgtatatctaccacattttctttatccattcattcactggtggacactcaggtccattccatgtcttggccattatgaatcatgctgcaatgaacacgacagtatagataatctcttggacacgctgatttgatttcctttggatctatgcccagaaatgaacttggtggatcatatggtagttctatttttaatgttttgggaaactgccatgcatttttccataatggctgcactaatttacattcccatcaaaagtgtacgaggaagagttcccttttctccacatccttgccaaaacttatctcttgtcttttgataatagccttggaagataagttcattcttaagtaaactctaattggttcttcagaaatgaatgaggagtaagtagaggcagaagtctaaaactcaccatttaaagaaaatattgaaaatatgttacagagtagatttaatgtaaacgtgattaaaatttcatccaatttttaaagaatacaagtattattctatgtattccatctagaagtaaaaaaatagtgacagaactttaacaacacaagtattgcataaattgcttaaagaaaataagtctgaaatgtttcatgttaacatagcttttaatttattcacttgcatttaaagtttatagacatacgtgtgcacacacacacccacattcatgcacacactattaaccaaaccagtgagagaaactgtcttattgagtcaacataggtgttcgacaaatattgaataagtaagtaaattaataaaattaatataggctgggcacggtggctcacgcctataatcccagcactttgggaggccaaggtgggcagatcacctgaggtcgggagttcgagaccagcctgaccaacatggagaaaccctgtccctgttaaaaatacaaaattagccaggtgtggtggcacatgcctgtaatcccagctactcgggaggctgaggcaggagaatcgcttgaacccaggaggcggaagttgcggtgagcctagatcatgccattgcactccagcctggccgacaagagcgaaactctgtctcaaaaagaaaaaattaatatatgtgccctgcttttagtaaatactaccattgggcgttctttcttctgctccatctcggtcatcttcatcttctcagtcctgactcttcagtgcctgagttcctggccacaagtgccctctgtgttcattctcccactctagggaatgggccgttggcagagggaacagtagagatgccgatttgggctgggctttgactgacaatagacaccacttggtgtttaatggaggctttcacacagtggaaaggaaattccttcaaatagatgggtattttcaaccactcataaccatattaattttcttgttacatatcagctttctatttctaaaccacaatttatctgcagatttgtcaagctacctcggtatattcgaaatttcttactcttgggttagtctctcatggcagtgaaaagttacactttgcaaaatgttctatagcattcaacatctgggaaatgtatggtttataaaaatgacatgtcagaactcataaatggataaatttaacaaagcttgtctcacttaatcctttttcctatgacctcactgccttttcatacatctctgcagttgtaattttcagcacatgtgtttgcttaaaaaaatgccaagtgtaaatcaatgtatgtcactgtaaaaatggaatataaagtaaagtgtcatcttttcagcatttgctagcccaaaatcccagtaccataaaaagatgcccatgatatatgaaggcttgagggagggtaaaatagtttgtataagatgatccaattttctttctaaaataatgtgtgtgaataaaatctataaggctattaaccagtacattaagagttgtcaccactgtgtgatagatttattcgagatgcttattttcttctttatagcttttatgttatttttataattaggacaattattttaatagcaggggaacaacatgtggcttggattttgtgtttgtggtcattaagttaaataaacagtgcatctcacaagaccgtatcactcagactaagaaaggagactctagtaattgtactataaagccacagaaagcaatgctgataccagtggtatatgtattattataagagactctatcatgacctgagacagctccctgagctcagttgatcaggtgagaaaaaggggagcagccctggaatatctcagtatagtacagggaaagtgagcacagcatttaggatggatcttaatgccaggtcagccacttactgctattcaagtgactttgtgcaaattacttcacctttatttctgatacttatatatatatagcactttgctatatatgtgtgtatgtgtgtgtctaatatatatttattatatatgtataatagtagttctgaaagtcagataatgttagattgatttctgcttccgctaatggatttgccaatcctcactcagttgaagactgattcttttctaagatggtatccttacaacaatgccttgtgacatttccagtgtttaagtgttcagcattttcaaactgctgcctgagtaatttctggctatagattcatctaattatgatgattccccaaaagggtgactttaatcaaatttattttataattagcttcttatccttaaccatatcaatgctgacatttattgaataccatcaccgagctacagattcgctagctacagtaaaagtaacctttccccagcccttctaaagtgagcctgagggattcatgtgcaatatattgggatgaaaccgagaattgctctgaaggaaggtcatagctttattgagggagccttggcctttctagctgctataggcacttggaactgtttctgagagactctgttcaaatggctaagtatttctgagcccaggatcccagcagagccagtgttgacttaggtggtgatgaaggttctagatctgtcatcttggtggaccattagcacaaaaggtgggattggcaaggaaaagatgtggtatcccaggctacaaaatactgtgaggaaacacacttgtccctatatggcgtctactaaacattgacacctgcttagggagggttttaccatgaagggaaaaatacagattgttgaaccacactcaactcttaggttacaaaggctcagtgacctactttccgcttaccacaaagtaagttgctccaagtttaatgttggtctaaatttctctaactttctcattacttttacatttccagtactagacattccatgaactacagaccattgatgtttgtcctcattttggaatctggtattattaaataactgcttattttattttcccaaatattaaacagtccaaaattttgtgttctcattattcatgtggccaactagaagccctcaatctgctaaaaaaaaaaaaaattatagatccagttttcttatttcatagataaagcacttcttgaggcaaaatgaagcaagccagtgccttctaaaccttgattattctttcattaaaattagatagtaggccgggcatggtggctcacgcctgtaattcccccactttgggaggccgaggtgggcggatcatgaggtcagggggtcgagaacatcctggctaacacggtgaatccttgtctctactaaacaaaatgcaaaaaattagccgggcgtggtggcgggcgcctgtagtcccagctactcgggaagctgaagcaggagaatggcgtgaacccgggaggcggagcttgcagtgagccaagattgcgctactgccctccagcctggacaacagagcaagactctgtctcaaaataaataaatacataaataaaatttaaaaaatgaaaaaaattgggtagtaacattaattcaccttggtgataatgaggaatttagaaattctcaatttaaaaattctacacgcagtaaactgtaaactcagtgtttctcagatccagtaattcttgacaagcattggagggtgcagcagcgcttagctcgtgaggtggaaacaccaaagggacaaatgcctttgcttgttgtcctctagagatggcttcaaagccccaacaggagtgggcccagattcacacctaatatttgcctaaattctcttggattaactgaagtcccagtttatgggttatatctaatagaaagcttaaagaaaaaaagtaaaaaaaaattagttttagatttttctttttgacatttttttccccatcaagaagcacaataaatgagctttgtcagttttctttatttcctcctatttaaattttttaaaaactggtattgctcaactgctgtttcttctctttgctttctcagttgtttctaaagaactcagaatgtggtcgcattccacattactttagaaaaaagtgggcagtggtccttttgaaatgtttcctattgatattttattcaactggcagagcactggagcagatggtgtagtttctgtgaaatccctcgtttgcctgtgttacactccaatttgctttaatttgtttggccttcgtgcgcaatggaacttagctgtatactagtacatgcttccccctcctctgaatcatgcctccgtagaggagaccagtctcccagctactcagggtaaagttaacaagacagatgataggtctcagtcactgctgcctggtaattcatgtgcctctgcctagaacccatttctttcttccttccttcctttctttttctttctttcttcctttcctttcctttccttccttccttctttttccttccttcctttcttttcttttcttttcttcacagagtcttgctctgttgcccaggctggactacagtggtgggatctcagctcactgcaacctccgcttcccaggttcaagcaattctcgtggctcagcctcccgagtagctgggattacaggcaccagacaccatgcccagctaattattgtatttttagtagagatggggtttcaccttgttggccgggctggtctcaaactcctgacctcaagtgatctgcctgcctcggcctcccaaagtgttgggattacaggtgtgagccactgtgcctggcccctagaacccatttctatttcctgaaaatacttgatcttatctacaacatggaaatatcccaaacaaagggttttccctcatctctagtcctctttggtgtctcggcccacgccctccccccactttggagaaaaactgtggtccaactctaaatcccacaagtttattctatttgtggaattactcatccttagttttccttcagttctctcatagttcttagaactatgatgaagtttggaattagacattgcccagtaataaatcccggaaaaatagaacaaaaaattaaattttactgcatggtatagagccttgcccattgcaaacgatgaatatgttttaaagtttttaggaaggatggaaaatagtcataaaaacaaatgatagggaatcgttttgcagctcagagatttcagtagtaaatgtctatcaaatcacttgttgaagacagagttaagaattactgagttcccggtcccatgacgtggactctagtccacggagaaagtattgttcaatttcagggtgcttctcttcctcacaagttcgcatatgtctgatcgaatgctgcctcttggtcataaactcaactgtgatatccatcttgcttcttgaagaagtttttccaaacctcaactaagtttccttctctccctagaagacagtcaccccaattatgagagtgttgtgtatattttgattatacatacaattggctcttccaataatgatgagaaagtgtttaatataattattttctgatgcctttagtctgtcaccaacaccttctcactgaagaatcaggctgatatttttgatctaatgcagtgatgggatatatagaactttagaatatgatatatgtgtgtaaagtacttaatgtctagtgacacacatatccattttcttgcatattactttgttgatgttaattttttatattttcttagactttagctaattttaccagcttctaatattatgtacatgtttgatttcttttggagagaatttgaaagggcataacatcctaccttaaacaaacgactactagaaaggatacaagaatgttttaatccatgaaataagttgccagatattataatttctacattttactgaattaggctttgagaagcagactgtcttacataatttgtttagttagttgatattctattgccatctacaaaaaatctaaaatcccttgtcaacttcctctgcatttccccaacaaacttccttattgttcaatacagacatttaataaattgttgatgagttttgattatgtctcgtaccactgccatttcatgaatgaactttctgtatttcagctagttcctttaatcaactatttgtcaacataatcaagtataagtgacactataccttatgtttcacagccttttcactgttttctaagacaactgccactgtgatcatttatatcattagcccacaacttaacaactaactctttaatacctaacacatgcatagcagcctatttgatcaaatgtgggaccaagatttcaatccagcatcagcaatttttccctacattctgtgattttggttttataacttgatatattgttgctaaataatttctataactaatgcacaatttttttattctcaaactcatctactttgaattttttaaaattccagtggagcttttgatgtcttaaagacaaatactgaggttataactaaggtacataatttggcaatattcaaaccatgaatctgagtttaacttatttcttttttgtcctctttttccacatcatattgcttctaattacatgaaaaggccattgaagttcagtctttcactctttcaacttatagatttatgcccaattagaaatatttctattccagcattttcaaaataagggaattctttgaggttaatttaaaaatgtatatcttgaattgatacctcaagatttctgcaggctgaatagaaacttagcgaaggagctgaatgtattcttaaaatgatttaagaatgtgtggtaactctttaatgcacagagatgctttttaaaagtatttgtcaagattctttgaatggcaagttatcttcaaaagttagcttagatacaaagtagggtttataagaaggatactgggtgatttcatctcatcaaaggaagggcttctagaacaaaggaaaccagggacaagaatctgtcagcatgctctctcttccccgctctttttgctgattgctgcacaacttctttttcccttacggcagcctggcttccttaatgtgtcaggaaacatggctgcagacattttttaagtttagtatctttggctcctaccattgactcttactcagttgcagtttggacacatctgattggcctggattgggtctgatgccatgccttgccattgattgactggaattatcaatcagtcaatcaatcaaccatggtcaggatggtggggttgtataaacaatagcaacagtgactctaatcatgaaaatatctaccatatccattaggaggttttatggcacaattaacaggaaacttgattcaacctggtttaaacacaaaggagcaattcattggtttttaattctggaaggtttcaaagttgggtgtgcctcaaatctctcaattcagcattttaattatgtcatcaaatattcaactgtttctgtttttactttgtgctactccagtgtgagcctcatcctaaggctggctcctctcattgctgtaggggtgctgctctcacagtgggtactcctcacccacatcagaaagagagatggcttctatcctgtggtaagctagagttgggttgcaccatcttgcaagagtcaattttgctcatctattcctattctgcatttaatgacttgttgttaatagcttgaaattggctatcgtgggagtatttatacgatggaaattggcaaatgccacaaatctctcggagagttggttgttatatttaccagcatactactacctctattccaacttccaaatatcaaacaagggtgttgaaattcacctttattggactggattgggtcacacacccacctttgaaccaaggtctatggccaggggacttggaattataaagtaagtgtgcataacgattttgtcagcgtgctcttgtaggaagagtattctaacagcaaacagcaaacaggatgtctgatttcagagtccaccgtgccatagcatgtgcttatataaaataatgtagtttgggtcattcccaatggggcatttgtaagtaagtaaattttgtgtgttggggtgatgtggatcattagatatatgttcaagttagcatcgccatgaaatgaaagcattttgttcttgtggcttgtaaatgaaaatgggaaaatatttcacattgttaatcatcagagcaattaaaattaaatatcacaatgaagtttcgtttcgcatgcaccagaatggctaaaattaaaaagactgacaatgtcaaatgttggcgtccctgcagagcactggaagtcccacacatccctggtgagaatgtatactgatgtaactactatgagatatagtttggcagtttcttgtaaaattaaatacatacctaatttgggggctaataatttcactcccatttatatacccaaaggaactgaaagcatgtgcccacacaaaatctcatgcatgaatgttcatagcagcattatccataatagccaaaaggtggaaacaaaccaaatgtctgtcaactgatgaatagataaacaacatgtgctatcactataaaaaggaaaatattcagccataaagaggaatgacatactgacacatgctactacatggatggactcaaaaacattatattaagtgaaagaagccagccacaaaaggtcacatattgcatgattttattcatgtgaaatgtccggagtagacaaatccatagaggcggaaagtagtttagtaattatgtagggcaggagaccatatacaggaaggatgagactggagtgattgttaatgggcataacattttcctatgggcaatgaaaatgtagaattgggaagaatgtcagatgccaaaaatgttgtgggagagtaagtcggcaacaccaatctagggatcatttggtaacctgaaaaatagtcttaccttagtgccagtatctaacttctgaaaacttattctgatgaaatgatgaaaaacttcctcaaatatttatgtacaggaatgtttgtttcaacaatatttttatttacagaaatgtggagaatatagaatttcaagcaataggggattgatggaatgtggatggcacatctatatgttggaatttgatataggcattaatatattatgttggtgcaaaagttaggctggtttttttcctttcctttcataataatataatgttttattttatttgagatggagtcttgtgctatcacccaggctggagtgaagtggcgcgatctcagctcactgtaacttctgccttccaggttcaagcgattctcttgcctcagcctcctgagtagctgggactacaggcgcgcaccaccacacctgactaatttttgtatttttagtagagacagggttttgccgtgttgcccaggctggcctcgaattcctgaactcaggtgatccgcccgcctaggcctcccaaagtgctgggattataggcgtgagccaccatgtctggccctaatataatgttttagaagaatatttaatcacatacaaatgcatgatggatgtaatttcatattgatacaaattaggttaccatatgggtgtcatttcctattaatacaaattaggtatgatccaagttaatattttaacagtatgtgttcacctacaaaaatcactggatatgttgtagtggacacacatctttttaatttcttgtttattttgttttatatttttctttgggggatggtaggctggagcatatattcacattataattggcaaacaaaacaataatatatattttatagtccttaaacactaatagtgtttgtgtgaacatctaaaatggttgttcaataaacattaaggagtttctaatgatatctccatgataggagtcccttatctggacataagcttggagcaagttttctcagtagcagcgctattgacatgttgggctaggtagttttttgtgggtcccagagggtccggggtgtaggtgctgccctgtgtatagcagcatcttcaggagcatccctggtctctactccactctacagtgtgacagcaaaaatgccttcagatagtgctaggtgttcttggggaggcaacacggtccccagtttacagtcactgagttaaaggaaccgttatctaaagaaaggaaattctgaattgtttcaaggtggaaagtgtctactgtgaagtcctacctgttttatcatacctgtgcttgttttgtagttagagtaaacattgtttcaacaggaaactaagttaaatatctcgtttctcattttaatttttatagcaattgcatgagtcatcatcacatttttgtttttatttttatggccttaattgtttgtgtaggttctgatcataatgcggttgttccatgccttttccagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctgtgagtagccataatgacagagtttggaattttcttcttttctgagtaatgtatacaaagagttttcactgcgattcatacagcactaacttgaagattcagagaatttaagggaaaaagattgtcagtgaggttcatggttaaaaaatacatatacacattttttcttaaaaagaagaggacctttttcaggaactttggctagaactactctgaaaatcaaatgaagaattgacatttgttttgtaatttaatttaaataaatactactgctatttttttgtttttcttaccttacacaaagttgcctgttggtccaaattatccagatgcctgttttgtttccccaagtcattttgctaatacaaaaattaatattttatatatttagaagaaatataagagaatgtctttacagtctgataggaaagacttttttaaaacactatgcccaaaacaaaagccctaatggaaaagattgatatattcaactatgctataatttacaacttctctgcatcaaaggcaaagagaaaagaggagcaatagactggacagaggcatttgttgctacccagaaaattctaagattgcatttcctgatcttgaatagtcttttcccctcctgcctggttagtttgctgacaatatttatgcactatctaatagacatctcagctgcagtcaaactggcacacaaatcttgtaacatctttcttgagtctatttcatctttgctccaccaaacccattgctaaaggtagaaagttaaatagtttcccttggaataaattattgttcccatctccagagaagactaaaaacatgtatttacttctgaaaaggccctccataatttgttcacattagctgctatcggcatcctgactcccacagtttgtaaagtatgactacatatggctgtgtagctctgttggctctagcagaatagaaccacgcaattaacgtttcctctcccgtcgtcttgttgaataaagagaaggatggatttgttttattcttttggcacaactgctgctttggagaggtaaactcctgctttatattcttcttctctttaatctctcattttcctacaaggaagtagtcaagattcaatatattctagtataagagtcccacttaaagagtgtcgttgatgtgaagacttcaaatgctgatattgtgcaaagatgggagttatttaggccttgataaacttccagagaccacataattgtgtataaagtgaaaaggagtgattgctacccttatctgacatgtaattcacttttacagatggacctgggggtctgaacacacaagtacttacaggcacatagagaagagtgctccctgcaaggtgggctcagttgaggcaaaaacagtaaagaaataaagagcctgacatggcagcctcaatttgttcctcatttctgaggatgtaaagtggaacgtgtccactgatagtgtataaaccatggaaatacttcaaaatgcgttaaccccattataattttagaatcataaatatacatagataggtctttccactgcagggagagtgatcatcaggaggtacaatctgatcctcatatgtaaacccaagcaaaaataatcactttatattgtggataagaaggctttattacatttttatgtctgtcgttttattgactaatggatctagctcaaggctctgagctgttaattgctggaatcctggagaggaacgggcctggcctcctcctgcttgttgaggattgaggatcagtgatattaatacaaactggggcaagtttagtccttaccagtctcacaactgactgcaaatccaccagactggagagctatacatttgagcccacagaaggaactaaactggaaagctccaaaaatgatttccagtagtttaccatataatattctatccctgacaggagagacagggatctctattatttcagatttccagatcacaaccttcctagatctgtacgcccagaacatcattctggccgccttttccgtacttcgttactgttgtcatccctctctcaacctgtcaatgaaatacagctaagtgatggtgaaatgttcctgctcgtcattttcactctggccattaatttgactcagactgattcctttccaagatgagcctttaaatattcttccctgtttctaccctcttgctgtctttcatcttccttcctagtggaaaaatcagaattatgtgtaaacacaatgaagggagatataagtcactttaagaaaaataattattacctcttttagggaaaaatgtacaatagtatagaatctcttaaaatcatttttccatgctgggactaatcgttgttctcttcatattcccttgtcttctgttgcagcctgtggtggtgtgttcaatttctcttctggaatcatcacaagtcctgcctattcatacgcagactacccaaatgatatgcactgtctgtataccatcaccgttagtgacgacaaggtgatcgagctcaagtacgtaagacaaattggctttcttaagaaaatcctttcagcattatttatagaagagccattcgtttattgatggagggcactgattctcatcggcagtctggagggaaatctacacagaggagtgatgttcctagatgacagttcaacctgggaaatgacgctccccctctccacacaagccggtagtaactaagggcaaaaaacaagcactcaccagttaaaacagtcgttatagtttcccaacaattgtgaaggagcatcataacatggattgtcaaggtataataagcccatcttgaaatcaaaggagagaggaagggcaagagaaagcagttgccatgtgttgggtatttattatacacaaagaactttgattcacacgtgccgtaattgtctcattgtattcttaaaacagtcatatgaggtatatatagattctagattgggaattgtatagattattcccatttcactgatgaggaaactgaggctcagaaggatcaaattgctttccaaaagtaacacacacataaagagtcaaaatgtgtattcatgccaggcttcctccaaacaccacatcctcaatgtttcccaatactgtctctcaaagtatacattttcttttttcttttcttttttttttttttttgagagaaggtctcactttgtcacccaggctggagtgtagtggcacaatctcggctcactgcaacctctgcctcccaggttcaagagattctcctacctcagcctcctgagtagctgggattacaggcaggcgccaccatgccctgctcagttttgtatttctggtagcgacggggtttcaccatgttggtcatgctggtctcgaactcctgacctcaagtgatcctcccgcctcggcctcccatggtgctgggattacaggcatgagccaccgcacccagcctcaaaggatacattttctaactacttaagaaatctatttttatacctgtgtcagaacacctctaaactgatgctatgagagatagcttgagtcactggtcaattttcttcccagtcttacctattcccaacaagactgatgagggcaatgcaacctcccactctccagaatgataaagttcaagactgttttcacctgacagcctatttcagtgatatacgtatggcatgtggtgggaaactctgacagtaatattgttcatggtcatgtaggactttccatacagaagcctgatgggctaagaccacacctacctacctacctacctacctacctcccctctatttgtctgtgatcattttctaccctaaagattctgtactccctgcagtttacttccagaggcctcatgtatcagttggctctccaagtgaacaagagatgtcttgatgaaagacatctctcatcaagcctgatttggttcctgtatcaggcgttctataggctggacctcgaagaaaactgcagctcttacctggactatttgtaggaaaacagagtgtcttttaggtcttggggacaaaagaacagaaactgtcagatggccaggagcaggagttctgtgaagtatgcctgcacaggcgtgaaagtgtaagggggagccatttgctactgtgactcactatttgtttctcatatgtgtaggattgattattgccttgttctgttcaggttgctttaacaaaatatcataaactgggtggcttataaacaacaaaaggctgcaaaagtccaaggtcgaggcagattcgttgtctggtgagctcctgttttctggcttatagaaggtaccttcttgctgtgtcttcatgagctggaagggcctcttataaaacactaatcccatttgtgaggggtcctcccccatgacctaatcacctcccataggccccacttcctataccattagcttagggaacatatgaatttaggggaacacaaacattccaaccatggtatacataccaactcatagaggtatgttatatattctctctctctttatctgtctatctatctatatatatatgtatgtatacaatctaaatgtattttttcagttttcagcctggatcctggagctcaccataatgaaatttacatctgcatgtttattttattttacttatttatttatttgagactagctctcactctgtcgcccaggctggagtgcagtggcgtgatctcagctcactgcaacctccacctgctgggttcaagcgattctcccaccttagcctcctgagtagctgggactacaggtgtgtgccaccagcctgggtaattttttcttttgtatatatatatatatttagtagagatggagttttgccatgttggccaggctggtcttgaatccctgacctcaagtggtccacctgcctcggcctcccaaagtgctgggattgcaggtgtgagccaccacacccagcctacatctgcaggtttagaaaattatttattgcgcactaagagcctacattctaggaaacagataagattctaggtgtggtagaagatgcagacattaataaaaggctctcaaaagattgtggttacacaagcttttctgtcaatgggcttttcagatctcttctgtgctctcctgggaaaatgatgtaaaataaaaagccaaagcagatttaagtcctcttagaaactcagattttatctctctttgtggattctttttgtgaaaaataaatgtgttgtctgtagagaattaaaatgaatacagtgttgttggaaattatctagctattgttcttccctgatcttttacaataacattaaatgttaaatgtggtaaaagaaaatcaatacggttttcatcttgttcctcatcagtctgaaaaccttcaaccaaccaaaaccttttagaaaaaaaaccaacaattttttttctcaaggctgttgaaaggaagcatttattatatattttatatataaatatatattatttagtctatattttcaaaattattccatattatgaattgtttattagagctactgccaaaataaattgaaaatgcaggctgggcatggtgtcccatgcctgtaatcccagcacagggaggctgaggcaggcaggtcacctgaggtcagaagttcaagaccagcctggccaacatggcagaaacctcatctctactaaaaaatatacatgtaattaaaaaaaatagccaggcatggtggtggacacctgtaatcccagctactcgggagggtgaggcaagagaatcacttgaaccagggaggcagaggttgcagtgagctgagattgtgccactgcactccagcctgtgcaacagagtgagactctgtctcaaaaaaaaaaagaaaaagcagaagaacctataaaaatgaggacaggatatcaaatattatttttttaaacaagttttaaaaataagctataataaacccaccacaaaactctaaagtaaatccatgtaagaagccttgcttgttcaggaactctagaaatcgttatttgaaatgacaaagaataagacctgaattaaacactgtataagacagagaaaagttagggatgcatctgtcaggataggttatgcacatagtaacaaacaactccacctcacagcagcttaactcaacaagttgatttctcattgtaatgagcatgttcagtgtggcctggcatggaagctctgctcatcgtggtcatccaacaacccaggctgatggaagcttcgtttttacatttgcttccatgatcatcactgcagtgggaaggcagtgtggcaaagcaagtagtcatttgtaaagcttcttccgtaaagtaatatgtatcccttctgcttacatttctgtggtcaaagcaactcctagcagccatgtcaagcctcaaagtgtgcccctagggcaatcctaccagtgctggggaggcagagagctgggaccatgtgcagaagtgtcagtgaccaccacagaggtcttaaatgtaaatttcctgttcttcacctgaccttaacataaacttcattttaaaagaggaaaatgagactgtgaggagaatggagctgtgattctaaaagcagcatttcttctattatattaacatgcttcccataagttctacttcatctcataaaataacaagggaagagtaaatatggtatttttaatgagacctaaaaaactaaagtattgctgggatagtaaatatcagttcaacttgtcaaaagttgttctcagatggactttaatatgccctagactgtgaattccttgaaaagtaagactgtatcttactcactttgacatccccagctgctgtcacagtttttgttgtattgtaattactaaaaacaaatttggctaaacttttgaactgatcagtaaagtactgtttgatttctaatatttcatatcaagtgagttttgaatgctctactggtagttttttccttgtcattttttttgcaagagctaaagctacaatttaatagaagtccaaatggaaacatcagtattaacaaggtacatttcacaggttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattgggtaagaattctggacttgtaaatctatttttcaggactgttacctttctgctttatttaatttccccaccccccccccacccccacctgattatgattgcttttccttgaagcttagaagaatatgccatgtaagggcttggttttaaaacttacgtatgacatattttaatgttgtaaaaaaatcactcaacaaatgtacccagcactttgggaggttgaggcgggtggatcacctgaggtcaggagttcaagaccagcctggccaacatggtgaaaccccatctctacaaaaatacaaaaattagctgggcatggtggtgtgtgcctgtaatcccagctacgcaggaggctgaggtgggagaattgcttgaacccaggagatggaggttgcagtgggccaaaatcataccattgcactctagcctgggtgacagaatgagactctgtctcaaaaaaaaaaaaaaaaaaaatcactttggtagcacagtggaggaaggctagaagaacctacaacatgggaaggaagaagcttatgatagaaatctagatgggaagtgtcaaagccttgaacggacccagaggggaaagagataaagggaagggcagaaatctgagagacggaaggcagaatacattggaagcacagtgtttggactctgatgatattttaatgaggacatgaattgaggatgactttctataggtaatttgttggatgatggtggcttaggagactaagatttaagggagaaatgttttatttaatttggagtattttaagttggaagacctgtttaaatggagctgtctagttggaagctgatgcttgagaaggaatttggactggagagggtgatgtagcgggggtaggtaaagttaggtgagaggataaactgaaaatatgccccagattactcccactgcatgtgagaaataaattatccacatcaaacaccactggtgagaaatacccatatcaaattaactcagaattttgaataatttaaaataaaaggtagttaatcaattacctgtttggctattctaacagcatcagtgacacagtctaagatcattaatattcgactctggaaagtgttttgatccttttccttttgaatatagatgtgattaatgttctaaaaatgcacaactctccaaacaaatctcatactctgtgaagactcagaaaaatccaggcagttttctgtaataataaccctgattcacttttcaaactttctgtttcttccatagtgtggataaacttcgtttctctgatgcaaaacggagtttaccttcaacttcttgatattgggcatgtgaatttttccatgcagtacttgaggaaagcaattagacattgtgttttgaaggcttcccggtaaaccacacacctcaagacaaattgtatcagaaaatccctttgccacctcccctacttagctgtctcaacagtaacttgaaagcaagtctcacgggcagtgagagagtgttgccttaacagaattgtgtaggtgaagtagcatacaaaagccagaaggctattttgaaagaaaaattaattttcctttggagatttttttttgcacaaaaaagggatatattcttgcctttagcacagactttagaccaaatgtcctatgtctgcatttgctttgctacctttcaagttgtttttctttttcctaatatagtctcacaagaaaatggtaattgttgtgttaacaatctcctcactgctatcatctgcatgaagcttctcaagtgagccagggttccctagcctcattaaattaccatgtctttccaagccacaaagaagacatttttagacctattgtgatttaacagaaggaaaagtcttacactgtcagaagcattctctatgcacgagtcattgaacaattacagtcacttactgttttcctctggccacagttagggaaaaggtttaagtggagaatgtagaaacggaactccttgccagcattgtgttacccctgtatttcatgaagatgatttttacctctttttcatctgcataaatgccatcagccacttggaaatacttcaagtcattgtaactactctttgatggtaatgtttaagtgaaaacctaagtattatgattttgcattgcagtggtcttacaaagctttcaagaccacacactgacaagtttattgatcattctgcataactttcaaattttgtttcattttggtttttattgtttgtagtgaggagagggggaaggaacaataagaatagctttgactgtaaggtttatagggtcgtttagttatagctttggatgaagacaaacttggctaataggatgccccttttgcctccaactcatttatgtaaaacaactctgtctttcccctgaagagagggaaatcaactttgtggaccagatagtggattttcatttacaaagctgtttgctcagcctggaaaacaatatcttcacttagtaaataattgatgtgaagaggagaccattttagtctatgacatttccgtttcgatcttaactaaaacactaagtagggttttgcagatttgctatttagattatacacttggcaatgttttatgtacatctgcttcaatttttcaggatgaagagattggcttatataattatgtgactattaggttcaattcgccttgtgcatttgttatatttgtattgctagcgagtcacagcaaatttgggggaactatccctagttgctaattactaaatatgtagtgaaattgggtctcctttttcctcggaacttctgctgctggaggcccatatgcatggatgcaaggtaaggagaaagcacatttggcaagcatgagctgatctctaactgcaatggaaatgtgcctgcttgtctcccccctgtgctccaatgctatatgaataattgatcctgaatggctgacaaccagcaaaatgatcacactgggctgcagcaatctgtgaaactctgaaataatctgcaaatcggagcatttttcctaaccgagttcatagtttgcatcagattgtcaatggcttctatgctcctataaagtttaaaaagctgttggttctgtggatttggctaagtgggcatggcctataggcagaacggatgcttttaagtaccttctgtcctgttaacttctgctagtttagttgctgccccttcctttaccagcagggtcgtctcctgccttgactctgtttatgtgtgtcctgtacaaatcacttcacacttgcaaacgtatttttaaccatcagagcctccagttcttcctgagggggtctcataccagagagttgcttggcctattcacaatatgcatgtcacactacacatcaaacttctacacatagggttagatcaggggctttcagtaaacttatttatttactgtgcagtagcatcattgtttcattttttttttctaaaatgatgtattctataacacttcagcaaaacttcagtgtagaaaatggaacttggctctattagatgggaggtctgcaggcatttcaattagtgagttgccaaggagagactgaggggtgtcccctgcaagacagcagggggacagacagcacaggaagacagatggggaagacgcaccctcagggacaagtggtggcagtgcctgtgtttctggagttggttccttctggtgggtttgtggtctcactgacttcaagaatgaagccatggaccttcgtggtgagtgttacagctcttaaaattggcatggacccaaagagtgagcggtagcagggtttattgtaaagagcaaaaaaacaaaacttccgcagcgtggaagggtacccgagcaggttgcggctgctggctggggtggccagcttttattcccttattgccccctcccatgttccatttttgtcctatcagagtgcccttttttcaatcctccctgtgattgggtacttttaggatcctgctgattggtgcattttacagagcgttgattggtgcattttacaatcctcttgctagctacagagcgctgattggtgcattttacaatcctcttgtaagacagaaaagttctccaagtccccacttgacccaggaagtccaactggcttcacctctcacctggactcaaagctcccagccagcccctgttgcccagagcacacatgctgatgacgagggccactgtctgccttcctccacctggggtatttgtcacatggagactgagtcaggttgcattaaggtcagttcagagacctttgctaagagaccaaggcaaaaatacccaagcacatatataacaaggacagaatgaattacagtccaacaaatgtataaatatgttcaggtaggctgggcacggtggctcacgcctgtaatactggcactttaggaggctgaggcaggcagatcacttgaggtcaggagtccaagaccagcctggcctacatggtgaaaccccgtctctactaaaaatacaaaaaattagccaggcatggtggtgcatgcttacaaacccagctacttgggaggctgaggcaggagaatcacttgaacccaggaggcagaggttgcagtgacccagtgacccaagatagcaccattgcactccagcctgggcaacaagagcaaaactccgtcccaaaaaaaaaaaaaaaaaaaaaaaaaaaaagctgggcatggtggctcacgcctgtaatctcagcactttgggaggccgaggtgtgtgaatcacctgaggtcgggagttcgaggccagcttgaccaacatggagaaaccctgtctctactaaaaatacaaaattagtcaggcatggtggcacatgcctgtaatcccagctactcgggaggctgaggcaggagaatcgcttgaacctgggaggtgaaggttgtggtgagccaagattgtgcccagcctgaggaacaagagcaaaaaaatccatctaaaaaaaaaaaaaaaaaagaaagaaaaaaagacatatggccagatggaaagagctgattgatgcatgatatcattgcttggtgatacggctttagaaaagccctataacgttttgaatctcaatttttatctactaaaaaactgatcaatttgaaatattacaactatttaagaatgtgatggggataaagcagataatttctggaaagcaccttagctgtcagagtgaaagactctatgtattagaaagtaatattgaagtcccaaattttcaagccccccgcccaaccctatttccaaggttgga

SEQ ID NO: 521 - DNA, 9279 bp, Homo sapiens
ctcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgtcttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataacggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggcacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagatacattctccaaattaccccagtccttataggagcaacacagactgttcttgggtcattcgggttgacagaaatcatcgtgttctcttgaacttcactgactttgatcttgaatcacaagactcttgtattatggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaaggcaagtaccctcctgcggaggccacatcctcaccagctcatttgatactgtttcctctccacggttccctgccaattatccaaacaatcagaactgcagctggatcattcaagcgcaacctccattaaatcatatcaccctctcttttacccactttgaacttgaaagaagcacaacgtgtgcacgtgactttgtagaaattttggatggcggccacgaagacgcgcccctccgaggccgttactgtggcaccgacatgccccatcctatcacatccttcagcagcgccctgacgctgagattcgtctctgattctagcatcagtgctgggggtttccacaccacggtcaccgcatcagtgtcggcttgtggtggaacgttctacatggctgaaggcatcttcaacagccctggctacccagacatttatccccctaatgtggaatgtgtctggaacatcgtcagttcccctggcaaccggctccagctgtcttttatatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcggcacgggcttccaggccacatttatgaagatatttggcaatgataatattgtgggaactcatgggaaagtcgcctctcctttctggcctgaaaactacccacataactccaattaccaatggacagtaaatgtgaatgcatctcacgttgtccatggtagaatcttggagatggacatagaagaaatacaaaactgctattatgacaaattaaggatctatgatgggcctagcattcacgcccgcctaattggagcttactgtggtacccagactgaatctttcagctccactggaaattctttgacatttcatttttactccgactcttcaatctcagggaagggattccttctggagtggtttgcagtggatgcacctgatggtgttttacctaccattgctccaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggagataataacttggcccagcagctagcagttctctgtggcagagagatccctgggcccatccggtctactggagagtacatgttcatccgcttcacctcggactccagtgtaaccagggcaggcttcaatgcatcctttcacaagagctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtgctaagaaatggtcctgatatctattctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttagcctgtgggggcaacgtctacatccatgatgctgattctgctgggtatgtgacctcccccaaccaccctcataattatcccccgcacgctgattgcatttggatcttagcggctccaccggaaacacgcatacagctgcaatttgaagatcgattcgatattgaagtaacacccaactgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctatagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggaaacatcttgggcagatactgtggaaacaccattcctgacagcatagacacttctagcaatactgctgtggtcaggtttgtcacagacggctctgtgactgcctcaggattcagactgcgatttgaatccagtatggaagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttggctgttggaggccccacaagggcacaccatcactctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctcctgtggtggtgtgttcaatttctcttctggaatcatcacaagtcctgcctattcatacgcagactacccaaatgatatgcactgtctgtataccatcaccgttagtgacgacaaggtgatcgagctcaagtacgt

SEQ ID NO: 522 - protein, 1668 aa, Homo sapiens
LTCQPGRLMMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMSSPNSPACTLDRDECSFQPGPCSTLVQCFNTQGSFYCGACPTGWQGNGYICEDINECEINNGGCSVAPPVECVNTPGSSHCQACPPGYQGDGRVCTLTDICSVSNGGCHPDASCSSTLGSLPLCTCLPGYTGNGYGPNGCVQLSNICLSHPCLNGQCIDTVSGYFCKCDSGWTGVNCTENINECLSNPCLNGGTCVDGVDSFSCECTRLWTGALCQVPQQVCGESLSGINGSFSYRSPDVGYVHDVNCFWVIKTEMGKVLRITFTFFRLESMDNCPHEFLQVYDGDSSSAFQLGRFCGSSLPHELLSSDNALYFHLYSEHLRNGRGFTVRWETQQPECGGILTGPYGSIKSPGYPGNYPPGRDCVWIVVTSPDLLVTFTFGTLSLEHHDDCNKDYLEIRDGPLYQDPLLGKFCTTFSVPPLQTTGPFARIHFHSDSQISDQGFHITYLTSPSDLRCGGNYTDPEGELFLPELSGPFTHTRQCVYMMKQPQGEQIQINFTHVELQCQSDSSQNYIEVRDGETLLGKVCGNGTISHIKSITNSVWIRFKIDASVEKASFRAVYQVACGDELTGEGVIRSPFFPNVYPGERTCRWTIHQPQSQVILLNFTVFEIGSSAHCETDYVEIGSSSILGSPENKKYCGTDIPSFITSVYNFLYVTFVKSSSTENHGFMAKFSAEDLACGEILTESTGTIQSPGHPNVYPHGINCTWHILVQPNHLIHLMFETFHLEFHYNCTNDYLEVYDTDSETSLGRYCGKSIPPSLTSSGNSLMLVFVTDSDLAYEGFLINYEAISAATACLQDYTDDLGTFTSPNFPNNYPNNWECIYRITVRTGQLIAVHFTNFSLEEAIGNYYTDFLEIRDGGYEKSPLLGIFYGSNLPPTIISHSNKLWLKFKSDQIDTRSGFSAYWDGSSTGCGGNLTTSSGTFISPNYPMPYYHSSECYWWLKSSHGSAFELEFKDFHLEHHPNCTLDYLAVYDGPSSNSHLLTQLCGDEKPPLIRSSGDSMFIKLRTDEGQQGRGFKAEYRQTCENVVIVNQTYGILESIGYPNPYSENQHCNWTIRATTGNTVNYTFLAFDLEHHINCSTDYLELYDGPRQMGRYCGVDLPPPGSTTSSKLQVLLLTDGVGRREKGFQMQWFVYGCGGELSGATGSFSSPGFPNRYPPNKECIWYIRTDPGSSIQLTIHDFDVEYHSRCNFDVLEIYGGPDFHSPRIAQLCTQRSPENPMQVSSTGNELAIRFKTDLSINGRGFNASWQAVTGGCGGIFQAPSGEIHSPNYPSPYRSNTDCSWVIRVDRNHRVLLNFTDFDLESQDSCIMAYDGLSSTMSRLARTCGREQLANPIVSSGNSLFLRFQSGPSRQNRGFRAQFRQGKYPPAEATSSPAHLILFPLHGSLPIIQTIRTAAGSFKRNLH

SEQ ID NO: 523 - DNA, 30306 bp, Mus musculus
  misc_feature (1)...(30306): n = A,T,C or G
cagcaaagcctatttacagaggacgattctgagcccagagacagacaccagcctctttggaaggaaggaatggattttcatggtgctctgttgcaggaaggaactgtccaggcagcattcagatggcttcatcagtgtcctgggtagacagcttattcattcatgttcacacacatccaacaagacagccatcaaccaccatactacatacacatgtgaatgcacacacagagatacacacacatacagacacacacacacacacacacacatacacacacacggctgggtggggagagaaaaaaacagccattccacagccaataaaataaacacacacacacacaaacaccccaacacaactagccccctccctgcccacagctgcagccagggacaccccatttcagatccttccatcaacactgactaggagctggattaaagatgggcctgggaaggggaaagatgactggcagagggccagatcagcgggtgtccctcctgcttcagtcaccatggcaactccaaagaggaggaaaagggctctgggcagtgcctagcttgtgtcagcagcttgaggcggggtggggggatgcggggtggggctgtgttccctcctctcatccccagctagtcaatactgaagcatgtctgccaagcacggatggtcatattacagagcacaccttccagcatgggtgagttagataggagcgccccaccccatgcaagataagcatcaggtttatcattaaacctgaacagataagcctgcctggctcatgaagcccagatctataactcttccatcatctgaagaaaaaaaaacaaaaacaaaaacggtagagaccagtgactgtcttttccctcctcattccacccaccccatggctctatgacagcttcctcttcagagaaggagcccagacctgattaagagacaagaagtatgtgcaggctgtgaactcagcccactttgccctctactctacagccttggaggccactcagagcacagtctgtgggtagaagcagagggggctgtgggggctgcatgccctagcatgttgactgggaaggtcaaagacattgcctttcgcctggtcacaactttctggtggagtttgtcgcttggtgacatgcaaaacactcagcagaggaacacagacttccttgtattcgggtgagtctctgtccactgaccaggcctgccctggctcagctgtacaggcctgggcagctagacagtgttggagtgtgcaagccagactcgctgaagatgacagtcattcctcttacctgccttactaaggaggatcctgaggaggcttgacccctggtgtggccagttcttcattccggaatcttctctaaatgactaagtcacaccagccgatggaaagttttctacatgggtgggactcagaaaggaagtagccagccatgtccagatagcatgttctagaaaacagtgcggcagccccaggaatgtgatgggaggctgtggtgggctgtaatgaaggcagcctaagccttaggctggtcactcagtccccaactcactttgcccaaccaggcagtctagaagacctgaccctggccttactcgttgcatgtatgtggcatgtaatcacagtcaaggtggcccttgaggtggggacagtaccactagacttcaggagctgggccgtctatctccgggacagctgtctaccagaggacagatgagccccgtcctgttgagatatataagaagagagagcttagcccccagctcaaccctgctggcatcattctattcacacccacccagttccaacactcgtcctccaagttctttctcatctctgtgcctcagtttccacatataatgagtatgcaatcgcaggtcctcaagctcatgaagtgcttttttttttttttcagagtgtctggcttgataggtagttgaagcttggtagtgttattaataatacctagaagcacaattgctcgggtgggatccaagatgtacgatagaagataaatgatcgatactagtggagccccagagaaacatccaagggcacaaagggaggggccacttagaaggagacagcatacctggtatactgtagcatgaccaggcgttcttggacctaaggtgaggatgggggaggggtaggcatcagtgggtgagaagtagggggatggtgggcatcagtgggaagttggcagaagatagagaactctcagctctccccagcagaaccctgttcccaagacccatgctctgcatccttacagggaccttgtagagtcagaacaattgaggctcaactgtgttaaggccctctggaaattattatcattggtgccctgcctgtgctgagcctagggcacccatctctacctatgttctaaataatgtgcctcctttcctggatgaagatcgcagacccttgccagtgttcctgggctggggttttgtggcatgggtcttctgtttccaacttgaaaagtcaaccccaaatgctagggttcctgtacctctctcaggcagcatggaaagtctccaggtgacatcaggagtcaattctgagaatatcctactagtgcagggctacaagaggctcagatccatggagcacagctataggaggtgagctgtagcagcaggaccactcctgagcaactctcgctgtgggaagtgtcatcctgctgaggtagacaaagaggggcacatctccaaacagccatccagcctggccagacatacaaacgtttgccccagtttgggagtcctgcagcagcctgtcagggaagacccagagcaggtcttcttcctcaatgacccctgggtggcattttctgctagaaggagcagaggaggtataaagagccacagatggtaaactgtcaccctgtcctcaccaggtgccacttgctgtcgactgtgaagtaggaaacaaccacgaatgcagacagactcagcaaaaaaaaaaaaatcactaagaagaaggtgacttcttatcctgttagttctcagcatacagggagatatgggagaagagggccattggggtgtcatgacattccatggcattgcttgcttatgtaaatgagctgtgcagccctgactctagccagggctcttgagtataggcaacagaaagcaggaaggtggtagcaatactggacagccataggaagtgagagggggcaagggccaaggtagaaagctggtggatgcagggcagaaccagaagtcagagccaggccctggttatttagtagagaccattgtctcagagacctctgcatttcacaactgtcttgggactggcacctaagtggccacatgtgaattctcactggctcctcatctggatctcacacactccaaattcagagcccaggcttgagcttctgattggtcaagctcaagtcacatgcttaaatatagtaggcagggccttggcaggagaaggggactgggggtggtcctgtggtcccagaggacaaacacaatgggtagcaggcctgcctctggttccacacaacatggagttccctacagacagcaaaggaggaggttagttgttgcctagaaacaaacaaaagccaaatctcagtgagcattcaccacgttcttttccttcctctccttatgagtttctgctagccagttctgtcgggcatccagctggaagtagcttaggtttcagaggataacccgaagggctatgtcatcaaagcctaggtggtgggctgtggggagctgaataactgcctgttcaccaagatagcttagtgagccgatggagtttggggaacatttggagttccctgtgggaacgtgggccaccactgaagaaaaggctccctctagcaattattaattgtgcatttgcttgaggagaggtagggcttcacaagctccttcctcccgtgatggaggatgagcccagtcttgtatgggtcttccgtgggtaatatcagctgctgagagttcagatggcaacagtcttgtcatgccccagaacacagtgttccacagcagtcaggcttctaacaaggtctaattgggggactcaaactgtcttgtgaacttggtgttagacaccagtaaatggtctccctgtgatagcaagtggctagcaaccccagtgacttctaagagtaaggccagcttgggggaaggagtgctcttatcagctcagttaagtcacttgaggtgagaggtgtcagcggcttaagagctgaggagtagggttccttaaagcaagctggaaggtctttctggaggacagaggacaggagaaggtgccaagtagaaatgacctcatacagtcagtgttgggcaccaagggagtcctctctgcttccgttcaaagtcccagaacatggcccaagctgaggctgttgcctgttttgcgtggaggaggggaggggaggttttacacctgcatccagtcacatgggttacacacatattcttgttcagacacttcccaggcagggcagggaaggggtaggcgtggtggcttctgaggacagatagaggggatgtccacaggaagccctggagccacacctctgcttctccaagcccattcaactggcacacacctgagcaagtgcaggccacagagacaggggtctgctctatgtgcccactcattctggcttggttacagaggggcagcaccatgctaagttctggatctcagatcaaaatcctggttcacattgtgaacatcacagtgtggcagagggaaactatcatgaaggccttgttaggggctggagagatggctcagttgttaggagcactggctgctcttccagaggactcaagttgacctcccagcacctgcatggtgactcacaactatctgtaactctactttttggagatatgacaatttctcttggcctcctcaggcactacacacatggggtgctcagacatgcatgcagacaaaatacccatatacataaaatacaatcaaccttataaaaaagaagactctggtacaagtgttgtgttataagaggggcaagaaacccacccattaagagatagcctaaacgcagacaccaagggctcaagtcccaacttcaccactgactaactctgtgaccgtaggcaagagactacacctacctgggcctcggtctccccataagtatgacgggaacaataacttgtgcatcttagacttctatgtgcatctctgcgttaggatcggcttagtttttaggatgactcccagtgtggttgctctgagtaagtattagctaatcctgtggtgacatcattgctttcctgtgtgctgtcatcaccagagcacaccacccagccagtggagattaaagagatctcccggaaggaaaagggcctcaaatccctaagaactgaggtagagaaaggagggggaggaaacagccatacaaagtcatgggatctaagggggcaggagtagcagtgtgtgtgtgtgtgtgtgtgtgtgtgtgtgtgtgtgtagaggaaatgatgggtcccagtggaaagagtctagaggaacattagtcaacagaccccatagacttcctctgaccaggaaccaaattggggaagtgggcctgaagccttaccagatgaacacattagctcataacgagacaaggtgttggctgacggatggagctctacccacccacctcctccagcagcccaggaattagctcacagctggcaaagcctcccctactatcctggaagcctggagcatgtttgaacagcaaccatgtgtgcagagtgggtcctcaggcccacacatcatttcttcggagacactggcacacctgcaaggcttgtccctgctaccaatgggacatctgccgtgtggggcatacctgatcccggtgggattatgagatcgtctgctttcttctggtgccctgggccccaggtctgggagtggtctttggcttcctgctttcctcttcagtttactggctccaggagactctaggagaggtgagtccttggtacagttgctcaacctgtcagggggctcttcctgaacccaggcttcagagcattctagtatttaaaaaaaacaagaaacaaaaacaaacaaacaaacaaacaaaaacagaagggccctgctgccattctgcccgcccatggatggcacctatcccaaacacccatccaggacctcaccacccgctcaggacgaatctagctaagtgcccactcactgggcagttgaacctttctcctggcgcctctccaggcctgtgtgggtaacattccaggccaactcctacacccacttatagattcctccttcagataccagggccatttggtttccaaggaaagatgccaaagaacagaggcaactcaagtcacccaaaaggtcaaggacccaaaaatgacagctcagggcagcagtgaggtgacaggactggaatgtggcatcatccatgggtttcatccactttacaaccttttaaaatgcaattttatctagacctcctgtatgtggggtgcagagctaacagctctgttaccttggttaagcctcaaatgctctcagtcatcgacaccctgaacagaggcagacatcatgctgaaatcctttggaactttttttgttttttgttcctgttttaacccaaggaccacctagtgtttgcatttggagaggccagtctgcaaagtgtacgagttctggttgtatccaacatctctgaggacgatggagagggacagagtggtcctgaagccacaggcccgacaaagctgccttttggctttgagctggacagaaagaaactgtctgaaaccagatgacgctgtgtgcccaggtcccagctacctatagcctgctcatggaagcacctcacttttctgatctctgtgctccctacttggtagtacccattctctccattgcctcttggatgagggcaaagctggagagagtcagggtacgccctgtacttcacagagcccatgaaaatagtaaatcaatggccccctaggctaactcatctcactgagctcttgttcaagccttctctgggtctagtcagaagcagtcattaaaacaaagccacacagcgagactggagtgaagacccttacctcaccctgcaggttgccaccccctacacaggagcatgcaggagtaggaaggccttcctgcctgtgcggactctcccaggatttggtactgctcatcagcctgtctaaattggactttctccaaaaagctcggctggctgtaatgagagctcccttgtctgaggaaggaagctttctggggttcagctgccccaggtgtacttagaatgaaggctggcatctcagtacaaaagcagacagcaggcgcctgggaagggccccagaaagccactcccaagttttcacacttggagagatctgaggaaggcaaccatgggaaactacaggggcagagtgttaagagttgctgtgccttcctggcatagtaagagagagcatatgtgaagaggtgggtagtctcaaccccttatgcagagagccagccggaggctcggctagcctggggtcagatccccagctcagcatctcaaaagaaggttttctagctatgtgcttggagcttctggaaactgaggctgctgctggggtagccttggggccagcataatgggctcagaatccctcaggacaatcaaggattctcagggtaccattaccttgcccagagaaggcaagaaatgaaactgggtttctctgctatctgtgggctggaatgttgttctcacttcctaatgatgccctggtgcgggtagcctcagaccctagggaggacagcacccagggctctggtctgctctcctcacagtccgggcttgtaggagcggtcctgagcagaaagctctgctctcaccttcctgaggatctgtgtacctggcaagaagaaccccacatcctccctcaatggcccccagttgctcccacatcgcccccatcttggtctactgaatcttcacctccatctatccctagttcctgccactgtgataaggtattaccctgaatgaattctttggattagggaatttttcttttaactttttaataccgatttgattggcaaccactaaaatgcagaaacaatttcatgcatttcaacaggtagaaagacaagttgttttcccacccattccctaagaaacgcagccatagctcaagtgtgctacactaatggaaagaaggctggcttgggccatgtaacgatgtaacagtctcagaaggaaagaagatcctcctggggtggagatagtgcctgtgtagaggcagcatgacctttttgtgtcaccaagaagtcaggagctaaaacacacacaagtccataagcagctccatctcttctcttttccacatgaggacagcatatgctccaagaggctgagcctatagctcttcttctgggccttatcttggatgcgtttccacatccattcattcctgttttagacctcaacagagatctgtttcaaacccaagttcaagtcatgtgccttctactgtaatctgtccttgcccagatctccccagatgtgagatgctaaagccgcgagacttggatctgcttctaactcagctatgccttgatatgatgggctaagggtcttggcttatacccttcactagagccaagctgatcggctcagagcacagcctggatcccttgcaaggtgctgctgccccgtgggcagtctaggtgaatgggagaaacatctttccacaagagtgagtcaccagtctgttcagtttcccagtctagctcctgccggcagctcctgcttgccgcggctgcgggtttatttgcttcctctgatgagatgaggtgaggtgttgttgttggagccggaagctgagtgtgaatgaagggtggggctgtaatgggtctgagggtggctagaggcagtagacacctgtcctgagtctgtgtaggatcccacttggctggtcagctggctgtgaggacctgcccagaggagaaacttgtgtccagctggcctttccccctgtttcttgctgagggatctattgtggtgagtcacttggcttcttggagacgcaggttcttgctttgtaaattgggcgttaaaacaaacctgcactcgctgcaaggtcttctatgggctcagagaggtagaatggttttactgacagtaaagctctgtccagttttatcagttgctctgcctgaaggctgtgaaatcgccttacttcttgccaagaactggctcatagaagtccctttgctgagcctcagtttcccatcttggggaatgagacctgggctgatatgattattttcttccttgcaggcctactttctgcatttcctttggctttgacctgtacacctccagcaagcatagagagatcttggaggaggaggctgtcccaaagatttcctgctgatgcttgtctgatcctgccttctgtgaagcatggccgccacaggattacgacaggacaaatcatagaccctgagtctcacagctgctctgagaggcacacgctacagccttgcttggcgccaggtgctgccacgccgtgagactcactcccatcccaacaatgccttcaggcgccatggctgcagccgtatgagaccattaaggagcaggacttgaccttgctacccagtaaacctcccgagcggccccctaccacctcccatgtctggctaccagggcggactagagaatgtctgtgccccagatccaagtggaagaagtgagtgagaaagacaggccagccggggcagccgtacctcctgatgaccacctcctcagtctgaaggccctcactgagaagctgaggctggagacccgaagaccttcctacctggaatggcaggccaggctggaagagcagacatggcctttcccaaggccagctgcccagcaagaggcgagtctggagcagggagcatgtgggggtggagagcctttgatgcctctaaaggagccccgagaccttctcccaccttccgcgagtgccggcaggggtgacaggccactgaccacgggcaagctggaaggcttccagagtatcgatgaagctatagcctggctcagaaaggaactggtgagtggctgcccaccaagaggcccatgtatgtgccatgcatgtctcctccctcatctttctgtctgactctgctgtgttcccacatcatgtttgtcctcccatctctgcttgtttcccattgcacatccgacttcctgttaggtgaaggggagatgtcatttttcagtggatacacggggctcagttagcctctaatcaaagatctagaggaagcaagcattagcccaaggatctgagcccacatgtgttcttaccctctcctcaccagcattggggtctcctactcttattcctggacacctaagggagccccagagtttacctgaacttctccccatccatcccagttacctacaggattggggaccaccactcactgagcaagcgaatggcctctttccctgagctggaagttgacaatagctgggatggtgggtctccctgggtggccaactttgagaagggcgctgagcttggggttcatagctgtaagtactggggctcagcatgggaagtgctgtttaataattcaaggtgtagagaacttccagaagagggcgcatgactgatcatgcttggggtgaaggctttggggtgaaaggatgtcgagtaagaatctgcccagaagtcagggtgggtcgggcattccagtcgggaggagtgaacaaggacagaagatgctgagggagcagcagctggatccttttactgcccacaggcaaaaacagactctcattaggagcctctccccaccacagaaatcctaggaaaggagatggaatgttgtcccatcctgccccaggaaaagcactaggtcccctacccacagtggcttctcagcagacccagacctgaaacaaaaccttccccccaagtttcagctgcttccctgagtcacctccagggccatctgactccaaggagccagcagtcaagggccagctgccctccagagctgctggtaactctccagccaacaggaaagcagaggcctgcttggtttgttttggtgagtcctgcaagacatctctccactggggcctgaaatttcttgtgggctgaaagaaagcattggagttgggggtggtggcagctcattaggctggacatctgattaattcagaaccgctttagttgatattgaggctgctcagaacacactgttcccctgtgtatgctgctagggtcgagcatggtatacttgctattggctttctcagaagacagggctcctgtggattcttgctgcgtgactacagggtgctccacaggagcatgagaggtggagaggtgggcaggacacagaccctaaaagctgtatcctgaattcctgaagctaaactgcttagatctgtctttacagaggaacaacaaaaaaaatattctcattagccaaggatgcaatttgttggtttggggttcatttgagtatttattgtttctaggagctgagttgtttactgtttaaataaatccacattccttgtgggctctcctttggagtggggagtagagaaaattttcctctgagtgaacggaaaacagtaggggcttccttcttggacagcttctggcatcctttagatagaaaggcaccagggggagccttggaaagatcccaatgcctcaggatatgatgaacatctaggatgtgatgcctgaaatctatggggcatactcatacccattgccaggacacatcaaaccaagcatggcaaggtaccccacccagagtgtgctggctaagaggaggaggccagccatattcaggtaactcagcctgtcggagcccagggcaagacagtcatagtcaggattaatttggttgccaaaggctgtctgatgtgggcacaagaaatatgtgcgttagtaacatgccttcacctatgacattttctattctcctgggtgaccataggtgagtaacgatgagtagtagaatgacagatgtgtcatggtgctcactgtgtgcatgtctcattgccgtggtgtgacttggccttcacaaactctcatttttaagaggacaaaagactcaagagaggaacacagcagggaatgaggaagctggtattcaaaccctgggccatagaatcactttgccaatgctagtcttaaactgttgctacagaatacagcatcctccattagtagccagtttccctaaaactgagctcggttgaatgagaatccctaagttccactcagtcttacaaaggtcctggcacttgtgtcattgctcccatcacacagatgagctcgatgaagctcctgggagtcagtgaacctgaccaagagtgaccaagcagaggctcagatcacccgactggggaaggcccaactgatcatgctggaaatgccattgggccttggaactccagtgtgcatccagagccccctgagtctattttaagggtggacactgtgttctgtgggtctgggatggggtctgggatttggaatttccaatatgtcccaagggacactaaatgtcatatgccaagctacatctagagtaccaaggagtggaaagagacccaagggactgtgaagagtcttcagaagacagatcgtggacttcccaagcttgagtccacaccctgtccatgacttaacagccccacaaagccaagctcagacagcaaagggtcttagtaaagaggctcttcctaagcatccccagcccaagggtgcagaaaccccacctgcttagcagtgccctcccggaggctagcagcagctccagtgctgggttcaggactcccatgcccaattctgccctgtccaagatcagacaccagcagaggcagctcttaaaatacctggtttgaagcagcacagttagaaggcttgcctcggtctgtttcagttaaaacgaagcttcgtgatattttgctaatatatccattgctcaacatcaaggtgcctctgaaatccacctatttttgaggccccagtggaagtagtttgcataacctttattatgccatatttatttaaatttggaatcaagctttctctgtccctgggcactcctaccctctttctcatttgtcagactcctgtgcaaatttatactttctcaactacacgtccagggaagcagactggatgagattctataatcctgaagtcagtatgtgggctttcccacctccacaatgctaaacacccaactcaacacgaagttgtctgtagtcctggggattggatttagagacctttcttcttctgttatgcaagtgcccttccatggaactatatccccttctatttattatgctttttgagacaatgtcttgctaagttgcagactgaccttgcattccttctatagtccaggcaggtcttgaacttgaaatactcctgcctctgcttcagaagtagattgattttaggtctctgtcactaggatcttatcctagcagaaaggctatggctctggacagcaggcatctgtcagttccttgtccctaaatatggaatttcagttgccctggtagcttcctttggtcagggaaccaacttaggtgtgggcttggagctgagctactgacagactgaccagactgaccgtcagtgtctcacaatcaccttccatcttggctctgtggtcttgctcagaagtgtgcccttgacagacaaggagataagaaacaggggccagagcacattcagctctgtgagaggcagacaaaagcaaaagccttaatctcccaggttgtgtggtgagaacctgagaatccatagcacctacactgttagtttcctgcaggtgttggatccctgcaggcagaaggtgtttatagttgttagaaaacagaaaaaggaagctgacaggtactaaccaggcagggcattgtgtgtcagagctggagacctgggttctggtgatgccctgtggcctcagcttgatcactagcaggggttcttagtggtaaatcttggcaagcacatggttttggcacatataacaccagctcccattatcttatctgctggacacccaactagatggcagatcatgctctctgtgtggagtggaggtgagtgatgatgcagggggtggggggggggagaactctggtgttccccgagcactttcatatggtgctcccagagcgctttcatggggtgctcccagagcgctttcatagggtgctcccagagcgctttcatagggtgctcccagatcgctttcatagggtgctcccagaagcttgagactgtttgctcttcccactttccaaaggagaagacagaggctcagaaagaccagaagtcttaggtcagagggtttaagtgacagccaagcgggtggctcagcctgatagaatggcacccacttgactcaggggccaggattctttcttgtttcagagccctatcacatgttcacatcttgggccacatgctgtaaaaggcatactgtaaaatggggtgacagatacccaccggtcaggctgttgagaaaggaagataaagaggaggaggcaaaggccaggatcagtgctgtgtgtgtttccttctgtcaggacacctgatgctcacagtgtccttctgaggcgggtgctactgataggattagcacccccattttacagatgagagaactgagtatcaacatatggggatttgaactcacatctgcccagcctcagagcccacactccaaatggctgctgtatccactgctcctccggtcaataagcttgaagataccttctgcttgctcagcatatccttctagctcctggcatttgccatgttattctccaaaagtcaactccatttttgccttctttccaagtaattctttcactccatatgaggaggtatcttatgctaacacagagcccagccatggtagtctcaagtatcaaaagggctagttcagtttgagcatatctgtaggatagacaatccctttctgaaatatttgtgtgtatacatatattacatatacatatatgtatacatataattatacttaatatatatatattaatatatatatatatatataattaaatcaacatatgttgacctgcttgtgggttagtacagttagatagagtatgtggtagttgaaccaaaattagcatttccactttttcatgtattacctgttctgtggtagaaacactcaacttctccatgagttattctgaaacatatattaaattgttgtaaactagcattactatttcctatctttttgacagtagtcatttgacctggggtgaggtggtttcttgctgtgggcttgtgtttgtttgtttttgttgtttaaaacagagtctaattatacatctcaaactagcttagaactagcctagaactggtgtctcagcctcccatgggctagaatcacaggtgtgtggcctcaagcccagctttgttgtactggggctacagatcacagctcccccccccccccatttctccctgttcttccacattgtcaggagaggctattcccaactctgtgacccagtacctccctcctagcagaaacaatctctccatgaagcaaatgcccacctccacctgagtccacaactccgctggaaaccaattcacaatgtggaactgcttctgggaacctttgagcttttccttctacaggttcccagaaactcaagtttccagtgagcaagacaccttacccataccacctgcctccttctacccttggcaatccaggattcacaggggtcaaactaaggttaaagtgtgctgcattgtcctggttctacacagactccaacacaatactgatgataacaatgtctgacattatacgtgtcttattgtaacaatggctgacctttaggtgaagctagacaaacaccccggcagaatacaaagactgcttgcaatcctcaagaattagggctctgttgcccaaccatgtggaaatggaacgggctctgccccttcacacatgctgagttcctggccctcgcaccaattcttcccagcatctatcagagacaaatggagtctctcagcctgagatagcacctgaaagcgctccagcattagggactagacacatgtctttcatcttggtattctctttctatctgtgctgacctgaccgttaaacactgattccctgtctccacaccctgcaaaacctttctgttgtctgtctcagaatgtgactgttccggctgctccactcacacgggtcacatatttgtccttttgtatctggctaatgtcactcagcataatggccccaaggttcatttatgttgtgacaagtctccgatctcctcctccctaagcttgggtagcatttggatcgtggatagactgtgttcatctatgttgcagttggagtgtgccactgtgaacatgggtcacaggtctctctctcttggagtccttgcctgtagttgatgtgagtgaaacccctggtcatatggtaaccattgcgttcattcaggacatgcaaaggatttctacagcctccatcgtcattgccctcagctcggagtagttatgagctcgacttttgtccccaggagagcacatagtgtgatctttctccagtaagcagggcacgttcacctgagagctttctgttccggattctcccctcctctctagctttcttccttgtcttccctcagcatctctatcacctctcctcactccacagtgagctctgaagtcaggaaacctctcccttctctttcagagccctataattactgtttaattagataatcctacccttgggggtttgccatctacctgaagaaacgagctgattctcctaagaatcttctcatttgtcgcaaaatcaccagtgtccacaggcaacagaagtctgaacaacagcactggctctctcggaaagcctcaggtccctggagaccctctccctaccattctcctaaaccctaatcctggccccgatctgtggcatcgccaccctttgagcccgcactgtggcccgattatgggattactggatgaacagaccacacctctgaatccagcctgtgcctgtctccgcagaagcaggacaagccaccctgggggagggatggaaaataagtgcattctaccctgtgctttagaggacaggagtcaacccatgctgagctgagttccttaggctggagtctaggaccggtgatccaacctaggtgttcctgtgggtcttggcctggcttagagggaagcacttggccacaggtagctactgccctgcagtcagccagtacagcttcccggtacatacagcttcttgtctgatctggaaacgtcatcagccccttcttggagaagtggaggcagaagctcagggagcataagtgactggtttagatagcaggagaggagccccgctcacaacaggatctccccaagaagtctgctgcctccaggccctaggagaaccagtacaggactcgggtggtgtcagaatatcaccattcccaggagggctgggcctgagtcaggtttctcatctgtaagacaataaatgtgatgcctctggcccggggttgaggaactgatgaggaaacagtacaggtcaagtacctcaagtgcccggagccaggggttgggggacatcttgccatcctaactatctacggtgacctgtgtcctttaggcatggttaaggaaatttagtataaaatgactctcagccatgtggaccgggagagcatgatggaaaatgaagtaagagcacaaacacaaaatagatcctgcgggggtgggggtgggggtgtagaggaagagacaggcaactgagatgggcttgtcaggggccggaggaagcggatggggaattgtccttatttcttttttctttttcttttttttaaatgagtacatattttagttgagaaagatggaaaatttctggagttgggtggtggctacggttgcaccaagatgataagtgtagatttgtcattttggttttaaatttgggagtcttagcccttcacattttagaaaaaaaaatatttgtgtgtgtgtgtgtgtgtgtgtgtgtgtgtgtgtgtgacagagagagagagagagagagagagagagagagagagagagacagagaaccacagagagaacactgaatgctcactaattttctccaaggcaattgctctgtattccagacccaacagtgaatgagaacatttgcattcatttgcataaccactgggagtccatcctggatcttagggctcttttggctccaggcacctggtaggccacagagccaagtctgaggacacaaaagtactgaaacaacagcagcttgccagcgtgggcagaggaaatgtcaggatgggactgggtttcaggtcaagtggaaacagctggtggcctgtcttagtgacaaagctttgtaaatgggaacctggctgcccacgaagcctagggagaccatagttacattccttctctgctgagtcacagtcctgtgacaggctgagggacaccttgaagccttctgagctgcagtatcctgacttgcaaaatacagaccttcacggcaggtaccttggggaggctgaggtaccacagggtttggtatatagatgggttttgaaaagtactgctgagagctgttctcagtgcatcccgttcttaatgggaaatagaggtgctgaaaatatcagaaaccctctacagggtccttgagcattgaccagctcgatctcccagactccctctacctaagaggcagaactgagttgtcagtctcctggcaacccacagtctgtgctcccatctcagctttaccaccaagggccttttgacagttgacgttaacttccccatctgtgacttgtgacatagtaagaattttactccataggctatcatgaggattagctctagtgtgttagctctgcctggttcatagtaaaacagcttataaatatcagctcatttttatgattggctcttaggaacctttatttaaaataaaaaatgtatcagtgagtaattgtaagacatctgatgaaagaaaaaaaaatagcaggctgcagaaggagggatagccacacctctttaagaatgtgcccactggtccgatcccacaccccagtagatggcccaaaactcatgtgtagatagatgggcagcattaactggagtcagggtttctggttttgttttttgttttttaaggacatggatttataagagtgggcatatactctggcaagctggaggaaggtaaatggatatgaccaaaatataatgtaaaacgtatgaccgttcaaattatagagcatgttatggcagcccacatacatgatctaattgggactgtcacagtggaaaatacctttgtccaccccatcacatgccccttcccacccagaagctatgttaccaaatctggtgtctccctccttctgaaccccttgagccccttgaacaccaaaggatgggaatggatggaaaggaactttaagccaggactggcacagagaaagacttagacatagtcgctagcctggcacaaaacttcatcaggcaacaacactatcccgttccatcgcagtcttttcacctctctggccaggaagtgtgccgtcactagatggacctgtcgatgatccatgacatcagttaggatccctattaatgagtgtcctcagcagagtttacagagctgcactcgaccgccatgcaccttgctgactcaagtctggcctctccccttccaggcagagatgcggctccaggaccagcagctggccaggcagctcatgcgcctccgaggagacatcaacaagttgaagatcgagcagacctgccgcctgcaccggaggatgctcaacgatgccgcctttgagctggaggagcgggatgagctgtccgacctcttttgtgactccccgctggcatcctctttcagcctttccatgccactcaagctcattggcgtcaccaaaatgaacatcaactccagaaggttctctctctgctgagaagccttaggatggaagggaaaccacagccaagggtgagagagagaaggctcagaccaagtggtactttgggtaccagttactccccctgaggtcttgggagtaaaaggcaccaggacctggtggtagtatgccaggggcttcagctttgtatacctgggtcttcatgttcaagacccaaagagtctgcagacattatgtaaggcagggctctcagcaggatccctgtggccttcccctctatggcccactttcctgtgacctagaatcactggtgctatgatgttgaatcccaaaggggacacccctcccatacccctgccaaagcttgttcttatagaaagctctactctagggaagctgagaagattagattgtgccaagtatacccatctctcacgtattgttaccaccctcttagtgctagctctaattgcccctatgtaggaggctcagcaacctgtgcagggatgtggtaggacaggaaaacttaaaggaataacaagatgacaagtgggaatgcaggctcctcttcaatggctaccagcatcccagagaaggagctctgcccaggtactttgaacttcagccttgatgccacaaggccatgctgtttctagcttgatccatgacatatgatatatgacatatgtaccttgtatagctttggtagagcaacccaggtatcctgctgtctcccattacaaccacttcagttacctctctgccacccgcaaccccaggagaacacctagcaggctactggtcactgatggctaaactaggcaagataggagatagatttcccacaagtgaattctataatagggagcatgacagaggtcccctggtggaacctgatattgtcaccttatcctccgtaccaaagaccccagggatcccaaaattccatcctgagcctctcccaagactgtgcctgatctaagcaatggatttcaattgaccatgactgttaactaatgcgttgctaacttgttaatacctgtctgaatcctgtccaaatggaaaaccagttgagtaggccacacagagtttgggctttagttttgagagtttttccctagcagcaagcttgagctcagtaaaatgttaagctcttcagttcagggaagacctggtacggcacacctggccacaatcctcttaacacaagttcctcatactctgggtgtgtctagtgaggtctgctcgactctgggtgtgtctagtgaggtctgctcatgagcacagaagggcagagtgaagcctggaaagacaatgacttccctccagttacctggctgctccacagctatagaatattaaggtgtgaaattactgtgaatccagcctagatcttctgccaatgaacttgaactccaaaagatggtactgatgctctgccaaacccacaagttgccagcttctccctccctccctccctctcggtccctattcattcttctctggcaatgactagtactggggttggggagaggggagcataactcccagatggcggacccttagcacttaccacttgtcagggctctgcggtctatactgactgttctctgtatataacatttcttcctaccgataatccccatgagctgtgtccacacacgacacaacacacgcagactggaatggaaagataatactgaatggcctcttccttgtgatttcaaagagccaaactgtttttgtttctttttttaaagatagaacaaggtagccaagatttttttaagagccctgaagtccagaggccttgaccccagtcccttccttcaagactacacaaaacactgccaagtcccaagaggcctttatttcccatcacctcctgcctctggtcacccccgacccttgggtgacactcgccacatcacagagagcacatgaaagaaggaccatcccgtattctaaaaacaatgccaaactgagcgtaagaaattaaatcattatccaggcatggtagtgcacgtctttaatcccagcactcaggaggtggagggaggaagatcaggagttcaagactagcctatgatacctagtaagttctccaagtcagcctgggctttatgagaccacacctcataaacataacagtcaccagttattacagtaactgacgctcttagcttaaagcaaagcagagtgatcgacttggatatggtcagcaactaactatgtgactgagcagtctgtgctcagataggaaagcacccagcatcttcctcctgcttttgttctctgggaaaactttgtcctaggcagggtttgaatagattagatgtttcaacttaagttgttcatcccaagagaattgtattctgggataaggatggggggctggggagtagactgaaaaggtggaagggaaagtcattctgtcatcttacctgtagtctagtgtctgttagctctctgccttccgtggtgagctcaaaccattaactgttcactctggtggtagaatccccgcagagatgtctgtaggtctgtggcaacattagctgccttcctcagccagcttcctgccttactgtatgttcactgtcctgtttggtgttccctccttaaccatctctatcccccccccccccaggtgagacatgaactatccactgtgctgccacaaggtcatgtccaatgcctccatggcctcagtagcaatcacagaggcttagagggcctggacaggcctggccataacctggcctcatctaagacctacccctgtagcaataccaagtgctattacataatcaattgacaatttacagttttatttttatgattatttgtttctatattactgttagaaaaagtgaaataaaaatatttcaaaaggagatatccaaatagagacatttactgccttgttacctatggttacagcatacacaagatcaggaccataattagatggatggatacatggatggatgcatggatgcatggatgcatagatggatatatgtatgtatagatgtatggatggatgcatggatagatatatgaatggatgcgtgcatgggtggatgaatatatgaatggatgtatgcatgggtggacagatgtatgaatggatggatgtatacatgggtgcatggattggtggatggatgatttgaacaattagatgaagatacagaagaaaggaaaatattctccagcacttttttccaagaagggtcacttggaggtggttacaatggagtcccattccataggccatgtgagcacacctcatatacccatcatgcctgcatttgactaaatccaaagcagaggtgacccgttccaacatataatggcctttccatggtgactctaataagtggtactatctctgtgtcttggagagacatatgcttcagaatgtttcagccactcactcttagatgtgaaatcagtacaggagagctgtggagatgtcctggagacatggattctggctgtgcacttccagagcagctcttgggatcttctcttctacagaggaccaagggtaccataagaggcagggtcttgaaagagttgtgtcttcataaccctaggaaggccatgtgagagttcaaggtgggtcacaaattccattgtgtggaacacctgtcagcagctccactgagattaagcaggtgtgacgaggctttctcaaaaagcacatagcatgcaacctgtggccacaaggtgagggagcacaggcatcacttagacgtccaccacctaggttgggcacgttgtcccacactttaatcccagaacccaggaggcagaggcagagaggcagagagagaggcagagaggcagagaggcagagaggcagagaggcagaggcaggtggatcttagtgagtttgagacagtcaggtctatttagtgagtttcagagaagccagtgcactagtgctatatagatcctccctttaaaaaaaaagggagaagaaggaggagagggaagaggagggaagagggaagaggaagagaaagaagaagaagaggaggaggtggaagaaaagaaggaggaaggggaggaggaggaaaaagaagaggaagaggaaggaggaggaggaagaggaggaagaggaggaagaagagagagagagaggattaaagaaaaattactaccacattagaggtcacagacttttttataccaaagccaagacgcatgtccacttcttcaagccagctgaacatgnnnnnnnnnnnnnnnnnnnnccacttcttcaagccagctggaacatggtaaccatttggctgttatactagagttctctagaaagcaccaataggaatgcatatctattgtacaagggcactcgttacaccagcttacacgatagacccaggtagtccagggatagtaatctgcatgtttaactccagtagctgctcagtctgagaagctggaagcctcagcagtcccagcagatgctgaaggcctggaaactccatggagaccttctggtattgaatctgcattccgaggccaaaggagtccatgccagtggaggatgactacaggccggtcaggacaaaagggagcacaggtaggcagtgtttcctctgcccgtttattggaaagtgttgctcacttttagggtggggtttaacacctcccccaggccccctctctagaattgtccacacagggaagtagaggaacagagatgctccaaggtgctgaccaaactgaggaatgtggatgtgacctctcagaagtgacacagccctttgttcagagggccagctgtggcttcattaggttgggccaactgccccagtgtgctctgggagctttgtcaccagcccaacctacagcttccacattccagaccctgaatgtcacagcccatctggatgccgggagaatgggaattgattcccctgcctttcctgcttcttagtgaatacagaggattcccctcctgttcactgtccacatcagaaccctgctgcctgtgattggactggcttgggggaaggctgagctgctgctactctgagggaaatgatatgcagctgagccacttgggcagtacaggcaggccccaggccccaggccccaggccctatctggtgtgagctgatccaatagaaggctacattattaaataccctgttcctaggcacaaagcaaatgactacatagcccagcctacagggagatcctggaggaagggaaacctcagaagagcataaaagccctggaagtggccacctcacttgccacaaggaagtgagtcctgccacgagtggtttctaccagccatggatggcgcaagactctagaggcttggcttctcgaaatgttcctaagccatctgttagacagaagggtcccacgatgcctgcttctcactcccttcagggatgaagaggcactcaggtaggaagacttgccaaggaaggtgataagtctccagagaaaatgatcacaacgccaagccagaccttgagagtgtcttacaaagtcacgcctggccaagcctcgtttggaaggattgcaagagactagtattgggacacatgcttctccacttgcccacctagatggatcaagaacttggttgggaaaggagaagctactctgagccttccaggaaggggaagggagaggggtgaggactgagagcttctggaaccgtaggaagatctgagccggggagtcagggaagaccaggccgccagtggaagtgattcctagaactcttctccctggggtgtcacctcacagggacaacagtgatgagcaagcttctctggccaatgtatctggaaatgaggtctttgtgggttaagatgaagtcataagcacatagctggtatctttatttctcaaaggtgactaggacacagacacacagagggaggtcatgtgaagacacaggctaagatggccattgcaaacccaggaagagaagccttgggaggggccagtcctgctgctcacaatcagacttctggttttcagaatcatgacaacaggggttactgtttgagccacccactctgcagtacttgtgataacacctgtggtgattagttttaacgatcaatctgactcacctgatagcctcatagagtaactgatttttttttccaggttggtctattggcacatctctaggaggatggtcttgcttgttaatgtaggaagacccagctcgttgtgagaggtgaggggtcctgagctattggacagtagaaagttagcaaagcaagcagacagcaccgatgcgctcacttctctccgctcatgactgtgatatgttgtggtcagttgctcgggatcctgccttgacttccacaaaatgacagactgtgacctggagctgtaagacagatgggccattactcctctgggttccttgtgctcatcagagcaacagaaatgacactagacaccagatcaaccaaaaaaaaaaaaaatagtacatctgcttctcctctctggcctctcttcttccctcccactccccacccttcagctgtccacctgggggtaagctgggtcacttctcacgagtatttgggctggaacaagtccgtaccagctagttctgtgtcaacttgacacaggctggagttatcacagaaaaaggagcttcagttgaggaaatgcctccaggagatccagctgtaaggcattttctcaattagtgatcaagggggaaaggccccttgtgggtaggaccatctcggggctggcagtcttggttctataagagagcaggctgagcaagccaggggaggcaagccagtaaagaacatccctccatggcctctgcatcagctcctgcttcctgacctgcttgagttccagccctgacttccttggtgatgaacagcagcatggaagtgtaagctgaataaaccctttcctccccaacttgtttcttggtcatgatgtttgtacaggaatagaaaccctgactaagacaaagtcctaagtaaggaccagcatgacctctgagggaagtacataggtaaccaagcccatgaccattagcaaccaagttgttaaggagggaccctcagcccgggagcagacccagagtcttccatcacccacagggactctttttttgccatgaggactctttagtcaaaggacgtgtgccaaacggcaggcagcaggacaatgtggttggtgtgagaagaaaagatcacaacttctgccggtgtcattaacttcttccatgaaatttaaatgtgcgtgacattgggtacagcaattcattatatgatacatacttcgggaggaccacaaaccttttggctgaaacccacaaaatcaagcaagtaggcggccagcttttgtctgtagccctggtagtggattgtgcctgctgtgctccttggtggtgctagatgggacaggagccaaggcggcctttcttctgggagatggcccaaccacattctatttgaccacagcaggaggcgtctgcatgtcagtcaccctcccagtaaaagctgagtccctgctcttctgctcagagctaagctcaacagagcggcccctgcaagaaaccccagaaaacacaagataggaaaaaaagagagagagagaaaggaaaagattggaagggacagagaatatggaagagtgaggtggtggaagagtaggaacaagaaaatccaagggatcgagggagcttccctgcccctcccccatgacaggatttctctgtgtaatcctggaactctctcattccttctgaaagcttcgatttaaggtgtgcaccttcttacagtgttggctctgaatctcagaccatggactaggctttcctgcctgctctcccatctcccctccctcctgtaaataattgttttggccaattctaagaacagggcctaagatagtagcttctgagctggaggctcaaacagtagtgcatcgtagagccagctgcctagcagaacacccccaggtctatgggctccaccagttagagaggcttgtccatcacctgttgtccctgtgaagccacacctcagcttctgccagagacaccctcggcccctgctcatccttctaacctagcccccagaaggtcatctccccagccctaatcttcagggggcccaatgggactcacagtatcacctttaatactcctcccctgatcacaaccaccctgacctccacagctgcccatctcaggaacaagaagctaaagctatcaccatagcagtgtgccagggcatccaggaggcacacgttgatttatttttttaagcaaaagaagcttctgtttaaaagatgacagtcactggtatttctagaaggcagtgaatttccctggggcttggaggtacagcatgtaaagccatggctctatactgattccgcggaattgctgggacgtagctattgtagcaatgtgtgctgtcagcaccagtgggctataaagcggtggctggagcgtaactctctcctctgaattgaaacccaacactattggctcattaacagtcagccagtggcagagctagtgatgagctggagtctcctggcttctttcctaagctctaccctctggcttcccacctccatatgttccttactcaaaccacagcagagaaggtctaagaaaacaagtctgccaacaaatggctttcagactgctggcctgccacccaccgcagttagtagagcctaaggtgccctctgctggaaaactatagaatacatttgtgtgtgcacttaactgagtttccttggcatctttgattgtcagaatttgctatttgttagaataatgcacattttgatgttcttctccatggaccaagcatgaaatctctaatctgtcagaattaaaactctataaattcatattctctctctccttcctctctctctctctctgaaaccttttggtctagccgaaaggttcttactctacaagtctctttgaggtcctgagccaggtacctaacaccaaacagatacacagtgtccatcctttttatttctgcttttccataagcagtgtggaatttctgagaaagattcatatggaaacagagcattaattaaaggacactgtgacagaagttacacacgcttggagttccatctgcccagttcccacacttccctaggtaaactgtagccttagtcttttatgcacctttccaaaacttcaaaaacacctatctgggctggacagatggctcagagggtaaatgcaccgttggcagagcctaatgacctaagtccaatccccaggacccacatgtcgggaggagagaaccccgcccccataagttatcctctaacctccatacatgtgccatggtatgctcccagtaagacatgaaatacttttaaaagtaaagtaaaaatgcatgcatgcacacatacacatatatattgtactggctagttttgtgtcaacttgacaccgctggagttatcacagagaaaggagcttcagttgaggaaatgcctccatgagatccaactgtaaggcattttctcaattagtgatcaagggggaaaggccccttgtgggtgggaccatctctgggctggtagtcttgggttttataagagagcaggctgagcaagccaggtgaagcaagccagtaaagaacatccctccatggcctctgcatcagctcctgctttctgacctgcttgagttccagtcctgcatactttggtgatcaacagcagtatggaaatgtaagccgaataaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggcttttagtttattcaaggtcacttagtgcatatttgattagaactacttattgggcttagcgaggtcaccagtaagtacacaaccgaaggcaattattctgtccttgaatctatccatacagtggcagtatcgttcaattacatcatgagttttgaccactcttatttcccatttctctctcttgctctcctcctctgcttccttctccttccattcctattctcaaatagcctcccttctcttttcatgtctttctgtgcacattcgtgtagatagataaatgatagatgataaatagatgatagttgaagtatagatagatgatagagagataatagt

SEQ ID NO: 524 - DNA, 587 bp, Mus musculus
atgcctctaaaggagccccgagaccttctcccaccttccgcgagtgccggcaggggtgacaggccactgaccacgggcaagctggaaggcttccagagtatcgatgaagctatagcctggctcagaaaggaactggcagagatgcggctccaggaccagcagctggccaggcagctcatgcgcctccgaggagacatcaacaagttgaagatcgagcagacctgccgcctgcaccggaggatgctcaacgatgccgcctttgagctggaggagcgggatgagctgtccgacctcttttgtgactccccgctggcatcctctttcagcctttccatgccactcaagctcattggcgtcaccaaaatgaacatcaactccagaaggttctctctctgctgagaagccttaggatggaagggaaaccacagccaagggtgagagagagaaggctcagaccaagtggtactttgggtaccagttactccccctgaggtcttgggagtaaaaggcaccaggacctggtggtagtatgccaggggcttcagctttgtatacctgggtcttcatgttcaagacccaaagagtct

SEQ ID NO: 525 - protein, 132 aa, Mus musculus
MPLKEPRDLLPPSASAGRGDRPLTTGKLEGFQSIDEAIAWLRKELAEMRLQDQQLARQLMRLRGDINKLKIEQTCRLHRRMLNDAAFELEERDELSDLFCDSPLASSFSLSMPLKLIGVTKMNINSRRFSLC

SEQ ID NO: 526 - DNA, 63313 bp, Homo sapiens
caggtgcaaacacctgggctcccagaggctttggagggaggtggggcaagtcatagaattttcccaagttgtcctatgtctgagcagaaaacacttgcacaggcctggctcctggctcagggcggaaggctgtgggaggataaacgccgccatcaagcctgggcagggactcatatttgctaccagcactgggtgctagggaggttggtgagtccacgcccagcttcccctgtggcctgggggcacctcgtgaagggatctgagcctctctgtctatagaaaggatgcgtcaaagtttgtcaaagtttgccttttgccgatttcccgagaaagaagatggaatcttctacaactccattttagctccttagaaaagaggcaagatcacacaatcccattaaaaacagtggggagatccatgcctgtccttctgtcattgactggggatgggggaaagccggggggcgggggtgggcactggtggccacatcacatcagcagtgaactaagggtgctgcttcctctggcctctccttcctctcctcctgcttcattcctaaggttggagaggacaaacggcttggctcacacaccacccagcccggcaccaactacccatctggaacattcctggcttccctgggttggctcatctcccacccattccttcttcaacagaggaaactaagcagaagggttattgagaatgcacgctcattcattcatccatttgttcacttgtagaaacatcattgattacgtacccactgcattccagccctgcactaggcactgggaacattccttactcaaagatgaataagaaaccacccctgagctcataggactcgtagtctactgggaggataaccaagaggtctgcgtccacaggggtgagtgtgggagtggcaggtgtcccaggtgatagggaaacacaggtgaagggcagcaatttgagttgggggaggggacatagagcaggggaaaggagctagaatcaatacatttagggaaagattagagaatctgtgtgttctaggacctgcaaataggcacatctgacctgattgagtcagatcatataattggtactggatatgtttgtatgggtgtgcttgtgtggggtgggtttttaaaacgtaatggctcttctgatggcaagaagacttttgcaggaggttcagaaggagtatgatgtgtaaaaggttggatctcaactgtattttaatcttggcttctgcttgatttcttttgggcctcatctgatttcttttagactctgagatcctagaagcctgagtgacttgcgcagctgaacatcagggtgagaaggcccagctgggggtggggtgaggttgagaggcttttatgcagacactctaaagtatttgcaattgccaacagatcgtttttcctcttggaaaacttctaagaaaatccaagtccttcaactctgtgagcatgcacaagggtgcagagaggcccatagggaaaccgagtaggaaaactgaggccaggctggaggggcacagggagggggtcccagaggaaaagccgaggaacctgtcctaaggtgggggcaccacggtgggccttggctgcagaactgttagccccaggctggtctggcccttcctgcaaccactggactgcccagtctgctggatcaaggcctttatgagacagtaagaggggaagagtcctgctcatttgtttattctgacagtgtccaggggactcccatgggctcctcactccaggacacttggctgctgggcagagtgcaacccactctgaacctttctctcttcccttccttttgcctcccttctccctctcccctcccctctccttcatgtcgccttcgctgttgatgttattgtgattcttcttcttcctccccctccccctctgcctcctcatcttcctccttaccccctccttttcctctccctttctccttcctactccctgtctcctccccgtaagcctatggcgtcatcccacagagccatttgtccaggagggctgattgtgaaacattttgatcagaccatgaaacatcagtgggttcttgcagaagtgatttctctgtgtgttcatcagtctgtcctctgcactgtggcttctcgcatcttccaggaccctaggtaagcccatctctgggtgcctgtattgatttttctcttcttttctgcctctagttctgtctgtgaagcagaaaccaagtctcaatcctaagatgtgaaccatagcctggcagctgaccaggttggagtggcttgctgctttcctgggccaggaagtgctctggagtctgtgcccaaaaactgtggctgaaccacggggcatgtttgtctgttccatgcgccgtcctgttttgctggtgtcaggttccaaacagggctacctcatgctctgggaagacaaacaaggcagctaagatatccaggaatgctgccagtttgcttgttgaatatttgttcatgctgtgcctggtaccagaatgagtgaaagccacacccctttccaggtggtgcgcaaaccaagagcagttggcgcgcagacgtgataaaacagtgttggccgggcacggtggctcgtgcctgtaatcccagcactttgggaggccaaggcaggcggatcacctgaggtcaggggttcaagatcagcctggccaacatggtgaaaccccatctctactaaaaatacaaaaaattagccgggcatggtggcgcatgcctgtaatcccagctactcaggatgctgaggcaggaaaatcgcttgaacccaggaggcaaagattggcagtgagctggtattgcgccactgcactccagcctgggtgacagagtgagactctgtctcaaaaaaaaagaagaaagaaagaaaagaaaaagaaaaagaaacaaacaaaaaaaccaccattccctgtgtgctactccctgtctaagactgtcaggcattttctaggcgttaattctaatcctcacagtgaacttcatggtagctcttggtactgccaatgtgtagaggaggaaactgaagctcaagagactaagggatttgcccaaagcagcctgacagcaaggggcagacccagagatagaaccgcaccctgcactgcgtacacttcctccccacctccctggccaggatggggatgggaaagaaggtgtgcgttctttttgtttgaacatctacgtggcagtgggttagagctgattttaggagagaagttacgtataagggaggctttgtcctcagtatctcttcggggtacagttgttgaaaagaggttgaatattaagagcccaagtcccgtttccccaaaaatcccccccagcactggtgaatgacaggcagtccttctcttttagcaccttgtttcactcctgcctccaaagcctgcctcatgtctcggccttcctgatgacagaatgatcatccctgtatgcaacaagcttccccccacaccagtgttcatcagtctgtcctctgcaccttggtttctcaaggtatcatcagggattggccgatggagatgaaatgagcccctgtgtcctcgctcctgcatcactgacgttgccgtgggctattgagttggagaagacattgggcttccctgtcctggcttccataaggggcagagctctactgcaggtcctggtcttgcctgcaggtcaagggccacctcaccctgagttcaagcaggctcttccccaggatgggggtgccgccttgttcctgaacatcctgggctggctctcatcccagcctcaaaaccagcctgtttcttttatcttgctggccttgatttatagtaactgccagacaccactaattgacagttcctggtccggcctcctgcctctgcccagcaggatagagtctattcagcaattgcagagtgtcatggaatcaggggtcagaggatggcagagctggaaccactcgttctagtgaaaagaaagccatccaaccaaaggaagtgatttgacaaagttccagttagtaaaagagcccaccctggaacctggatctcctggctcctactcagggctctttccattactcaaagtagccaggctcactgggtgagaggactgcttagaatcacgtctagaaggctctcccctgcccatcagggtttccggtcttctgttgttagtggtgacatttctggtgcccttcaaatgctgtgcatgcaagaatcgctagaacccaggagacggaggttgcagtgagccgagatcacgccactgcactccagcctgggcaacagagagagaccttgtctcaaaaaaaaaaaaaaaaaaaaaacccaaaaaacaaaaaacaaaacaaaacaaaaacaaatgctgtgcatgttcaggaggcctccttccagctgtcaccaaggatgtgctggtgctgggcattccacagcatattctagaagatgttcttacaagtgttcacaagataaaacagcaaactccacaaactcaaagacatcacaatggagaggggcaggatacgggaggtgatcgctcatgtctgtgtgcggtgtgctgcgtaatctgctccttaaacaaaccagcaagaaaggctcaaatcagtcccagcctgacatttgagaggcccaaagtgaatgcacaaagggaggcccacatgccgtgtctctaaatatttgaaagttataaatcaagttaataaactggaaaataggtttcgttctttcctcctgccttgacaaatatgcctttataacaacttcaaaagcaaggctctgatttgcatccttggacccttgaacaaagaagggaggtgggagtgaggcctcaggccccacctgtggcccccctcttacttttcccacccagagcttggacaggggagcagctcagcctgagagcgcagccttcatccaaaccccatagaccaggaagaggccacacaggcctgaacgtggcccatctgagcaggagatccctgggccctaggtcccaggtggaaaggagggagtggattctgagagggcaccccctgacccccggccatcttgcctggagaaagcgcagggcagggttctctaaaacccagcccaggcagccctctcgctcacggatcaaggcagtactatgaacagtaaaatcatttccatcttattgatgatgtaactgtagctcagaaaacttaagtgaccgcccatggtacatactaatcaccagaggagctgggatgcaacccgggtctgcctgactcgtggtcccctgctgtcaccacctctattgccgtcccaatgtcatcatcacctgggacatgcggggggcctcatcaccttgagccagcagaaacacagaaacaacctctgtgtgggcctcctgtctcaacccctcacctgcccagctcttctgagctaggagagccgtgatgcgctccttcctcatcccctgcctttgcagttgcgccgagccctgcagctgtgcccttgtgcccgccactcctcacctcggccgctgagcaacctcctgctctgcacaaagcctccgcacatgcccttccagatgcagttccctctgctgcctcagagtgggcacctctcctagctgaagcccactcctccgcctcacctaggctcaggtggaatctgtcacctccctactccagcactaaggtggacgctctgtgtggtgactgctctgttaattatcttcctaccaaaaagccacgtgcgccacactcccatgtctagcccccgggtggcacagagccagccgcccctaaatggaactaacaggttccctagaagacagaaagctggccctcattgtccttctgaacttcagcctgaatcagcctcttctgagagatgagagcagggaggagccattgcagctgaacatgcctaagacagtcacttcccgcttcttcttgaaactctgggcccacggatggacaagtcccttcacaggaaaacagcagagaccggtggactctggccctgggctgagagtcttcattgctgcctggagcagggcagggatgtcgccacccttagtgtcctctgtcccacagagcccaacagaaatttcatccttccttgtcttgtatccctagaatccaggaatcgccttcaagtagcttatagactcaaaagggatcaggagagactgatttagagagggctttgtgccctgagagtgacaagagagcagagtctggttccagctgtgcatttggagctcccctcgggggaaggccagtcctcacgaggtctgccaggcccaagggctctgccgcagcacctgccctgccctgtctctgatgtcatctcccacccatgctctactccctgcctgctgcattctggcctcgaggcacccatgctggcccctgattgtggcaggcacgtttgttggcccagggcctctgcactgaccctttccctagaacacccttccccgagacaccacaagaccccctccatcgtctccctcaaatctttgctagaaaaccaccttattagcgaggccagccctgcctaccttgcctgaaaacgtgcacactcttcccctcctctgccattacttccaatccaagtctacaattctgtttttctatcactcacaatattgcttatttacttagcgtatttgtcggtcatcgtctgcctgctttcctctgctagattatcagttctcaagggcgaggtccttcatctaacttgttcactaacatttcccaagagcctagaacaatgtctggtatttagtggtactaatacgtatttattgaacagatgaataaacgaattgggagaaattctgaaagaatattttaagtttaaatcttttatttatttatttatttatttatttatttatttatttatttttgagacagggtcttgctctgttgcccaggctggagtgcggtggtgcaatcatggctgactgcaaccttcaactcctgggttccagcagtcccacctcagcctcccaagtagctgggacttcaggtgtgtaccaccatgcccagctgagttttctttcttcttcttcattttttttttgtagaagtggggtctcaccatgttgcccaggctggtctccaattcctgggctcaagcaatccccctgcctcggcctcccaaattgctgggattacaggtgtgagctaccatgcctggttgggcatttttcttgactcatctatttcacagcttcctgtaggattataagaggcaatgtctcatgcatcatgcaccaacggaaagaaaacttctcgtaaggaatcaaagggaagagagaacctctaggtggccttgccttctctggcccacccagatcctcccaccatcactgggtttcagtgtgcctgacacaaaaggaagtgccatcagaaacaccaacacagtgccatcttcccttttgagtagtgtttcttgatgtttctcattacaaaacgattcattgtagaaaacgaatgcaggcttacagaagacattttaaatcctccattatcctgcagcccagagataacgacagctaatatttgcatacactcttccaatcttttttccatgcatacatatgaattagatattggaatgagaagtttcataatgtacacaggatttggtgtcccagtcttatttacttagcgttaaatcgttagtatttttctatatgatcaaatagcttttgagaatattatttctatggctacataccattctgtgctaactcatttatttgagcactccatatgatttcactttggagttgaggctactccaaccaagactgctcttcctcctccccttcctctttcctctggcccactctcctcctggtccccatcactgattaccctcctgcccgcagacaaatgccaggcagaatgggagccacagggcaagacaccacccttgccttggacaggctgcctgtccatttgaggcatgccacaattcccccatgagaaagcatctgcactcccagaaatagaagccataggtcaaacagggagccaggaggtagaggtgggacaaagcatttccagatggggctgaatggcccatccaaaaagatcttggagcattcaccacgtgccagggccatgggcacaccagtgagcaatgcagccaactagggctcagcaccggggctgtggtcagaaacagccagcacccagaaggatgctttatccccaagtccagattgaggctcctgcttgcaaacatggttcatgcccttccggagcctactgcctcagagggagacacatactaatcaaataacctcacaggtaaacttggaattataactggtccatgaaggacataaggcagggggctgccagcacctgtaacctggggttcccttaggaggcagagctgcagcagcctgtcgggaggagcaggtgcacaatgggactggaagagggtctgttgtctggggagcagggtctgtgcaagacaaggccctagagacggacagaggccagccaggcccctgcagccaagctagctcttaatcctcagaggactgggggcgttgaaggcctttaagcagaagcagctgagactggatttccattcttaagagtttcccctgtttgtggaggagtaactggcttgggaggcgctgagagagggtaaagggagatcagtatggagactgcgtgcacgcttggacccgggtggcaggtcccagaactgggtagggcaagctgctggtggcttgggtagggacagtggcagcgggcaggaagaaggaaggagtgatgtttaggagctggaatcagaagatctggatcaaggctgtgactctccaaaagatgcttgttaatacacccgctagcttaggaccgttccctcattagcatgactaggtctgtactggcaagatgtctccttagacgacgtccctcagaggaccttccagtgaaggtcagaaaggaagggagtaggtcagggctggatgcggagttgcagtgaaggacgcgggcaccagagggcagcacgagtgtctcgggcccctgcaggggctaagaccccacagaaggcccgaccagccgcgcacctgcctggagcctgcgccagtcactttgcagccccaccactcagcttcgcgtctggccatgtaggcggcgcctgcgcgcacgcccagggctatcgtgagaatggcagactggagccctttgaaagacgcttccagccccgggcatctaggaaaggtgcttgatgaggtctggggtaagagacccccatccagtaaccagccttggggcctccagtgtctggcctgggcccctcgtcagaagctgggactggtcctgaagacctgcggtccgggcagctcgggctgctgtcctgcctgtgccttagggtttgcagctctgggctctgatgcagcagggactgggtcttagaatctaacgacagccagaggtggccgatgccgcgcccctggcgggacagacaccctgtggttagtggggcaaacgctcgcgtctttgcacctcagtttcctcatctggcagccagagatgcctacacttgccctgctgggtcgtcggggggcgtggcccacggtaggcgctcgcgggcagtcgtggccgcgggtcctatgaactcctgccgtttgggggtgggtgaggccctgggcgtggggtccccctgcgccctccatgcggacaaacttctgacagtggcgcagtcacgttgccacaattgggggaaactgccttggtttcgggtttaatgagaaaatggatgtttgggtttggtttcatctgaggtttggcgaaggcatgcagttcctctccactcgcgggggctgcccgggccggtgaaccgacagggcgctaggacccggggcgcgctcggacccggggcgagaacgcgaggccgggatcgcggtgaaaggctcgcggcggagagctcggccgtcgccaggcaaccgccctgacgcaacgcagggggaaaaaaaaaagtcctttccgaaaggagcagcgccgagaattcaccggagctcggggaggcgaggcgggagccctgagctgaggccgggcagcgcggacccgcgcaggaggaggcggcggggacaccggcgagtccccagcagggcccctgggctcccggaaggtgggttcgcgccggcggcggggactttcccagggactgggaggtgtggccgcggcgggcggcgcagtctgggcaggggctgaggcgtcgcaggtccccagcgcgagcagtggcccggagcagcccgatcccaaagcgccctggaggggacgcgctcctaccgcccccccgggagaggccgctcatgcgctcccgcgggttcgctgccctcccagaggagccgggcagccagggctggacttcatctcctagctccctgctggccgtgtccgggctcggattctgggtggaggttcggggtctgccgtctgagagggagggccgcactcagcctctccgggtccactcccaggcggctggtgacctccaagcccagcctggctcctgtgtataggttcagtgagatggaagtttctgtccccacggatgcggtccctaactaatgggaggtggcccagggcacctggacccaagggtgctctaaggacccaagccagtgtgacctgagggaacggcacagccgcaggggcccccgggaatgagcaggtcagccgtgaaggtgggcaccctgagtcaccgagacaccggagcacagacggcgggggggagggtgtcttcttcagccaagttaggttggatgtataggttttctgcacacccgttactgcctggtttttattcccggcggggcttggagggaattctgaggactgggacctcctgggaagatctggaaggagggttgactctaggttgggggctggccactgccgtatgcctgcaagcaggttctcccaagtcaagtttccacaaactccccgtgattgctggagaatcccagaagatgagatcaggtcctatccacagggttttcaccaaggggcacatgctccaaagcagcttcccactgacacagtagacacagtcctgcccctcactaagctcgggatggagcgtggagagcgtggacaaagtcttgggaaagcagaggtgctgtggcgcctgttgcctgagggcgttggcaggataggaacttctgcagcgtgtttttaaggagcttggaaagcagccatgggctgtgcttggaatggataaagatgacagctcttttttcttgagtgcatttatggaccatgcactacttagaaacccttcgcatcccttggtcactccatcctccccatcagtcttcaaggagactctattatccgttttgccaatgggactctaagaaattgagtgacctggtgtggctcccacacctggtgagagagcagagagtcagcctcacgtgcctgactcccgggacagtgctctcagacgaaggctgctttgggaaatctgaggcatctaaggcccagagaggggcagaaaccactcacgcccagatgaaatgagaactgtgtcgtggggctcatcttatgacctgagaaggtcccctgcctgcttgaggaaccctgtggagccaggaaagccatttcttctattaggagcttgcaaggctgtgttgttgggcctggccggcctcaattcttcccacctgaagcagaagaaagggttgctcccccacaccctgttctcctccttgcctgcccagagcccccagactccctgcgcacttgctcctgttcttctggtcctcgcaattacatgcatggatttctactaaattgccagtccccgccttcctgtctactagcttggcccccctccaggaggaactctggcagggaaataaattaaggccatgcctaactatttgctgagagagagccacagagccccaggccaatgaggaagaaactacttgctaggcttctcacaccctggctgctgtgttctctaggcaaatcttgctcacagaaagccccgttggccctacaggagccccggtattcccagaaccctttgggagctgtgctttcccaagggacttgagctgcttgcaaaggcggaaaatgagtaactgagcactttgctcctggtttccagaccaggggtgggagagcacgcacgtgccactaactggaaatcccttaggattagcctggctggctgttactgtgcaaatgcaccccgagacttggattgccatgtggagacaggaaggaaaagcacagactgaaacagaccttgaggggctgaggatgggctacatggtgggcagggggaggtggggagcaggaaggatgggacagggtgggaaaagagtttaggaggggcggcaggtgagcctcactggctctgcaatcacctgtagagtctgagctgccaccgagggccgtgttgccaggatgagtcaggtaggccgcaggtctcagcttttccctggttaggaccgttgccctgtccattaaaggccaactcttccccaccctgacccctaccacttctctctggagaagtgttggagaggaaggacaagcatggagaaagaaggtgagcagagcagttcaaggggggctgctcccacctcaccccctttccttctgcacactgcctgcctgctcatctctgccaggcagcatcaaatctcatccatcagccactctcgagaggactttgctgagcagtagcccagtctccctgtgggcacagccgtcaagggggcctctcttctctagcagcagctgtctagcgtcaggctcctctccatgccagggccctgccacgtggccttagcaagcacatagtagctccccccaagttgtcatctatagtggggggtggctttgctcccccaccacaaagctctcttcactgaggaatttccagaaggtccctcgggtgcccataagtgtgatcctcctccccagcggcctttgcagaaacctgaagaggatgagggttcaccttctcccactgggggcatggaccaagcccccatttcttcagtgtggccggaagttccctccagggcatcctgatccaaaggtggaagctggcagtagatgcccaagggctccctcgcagggcttgtcccttgggcatccctagagggacaggcccaggtcagaccccattttccaggtccagtggcaggtatggaaagagcctaggcagtgacttgtgcactggctacagttccaggccttctcgaaggctgggcagtgtttcctcattccaggaagccagcggagcctctgcgagctggctgggcacagcagcccctaggtcagcaggctcatgcttagggtggtggccacccaggaaggttctggatgagggtctttgccttagggacctggcccccactgtccaccatcaagttgaaagtgacactacctccctagtcttgtgatcagctccacgcacttcgccctggaagtcccatgccaggcgtgaactgacctaagtccctccagtcacaaaggcacttcccaaatttggttgtgtggctgctgctattttgtttatttgtttgatagcagccactgaaaacttggaggaaggtgaagccagcctcattatcaagtttgaatgaaagcagcctcagagcaaattctgccagacgtacacatttttggacaaatatttacctgaaacaagtccagcggagtccatacagcctgtcctgtgggctcggtgaagcccagcaatctgctctctgctgccctgaccacacctccctggagctctcatggattcttttacctgctctttcctgagtcaagagtgtctctgaattcatttagccaacccacacatcttgaatacctctgtctttaccaatgagaacgcatttctaatatttactttgctaatcatcaaatgcccaatgctgaccagagataaagacgctgaagtgcctgtccctgctgcctctggagcagatgctttctgcttcgaggcagtggctgcgagtggggtaggggtgggcgttgctgatttgaatacatctaggttgtagctggcataatgaaaccacacagaacagcccaccatctctgcaaaggagtttaggatccaaatgcaccaccctaccaaggaagcagaaggtgaaggccgtgccctcagggagcgtgcagtctggcgaggttgctgatgcagtagagtcctgagctcacagtaaaatgctgttctgcacgcttcagttaactttcgcagtgcaggagccatttcccaattcgatggaccaaggagagtgacagccaagcacagtcaagagcaggaggtgacagtcgtattagaggtgtaactaaaaattcacgtaaacttgatctcatttggtccttccaagactgtgaggtacgatccattacaatcctgtttcatggatgtggaacctaggcctaggagggttgaatctgttgatcaaggtcatagaactagtaagtggcaggctggctgtcaaccaacccacgtcccccgacacccggctctgccctgttctaacttgctccatccctttctcctgctcctgattcctttcctctgcgaggtgtgaacccgggaggcttcagcagccaagtacctccagcgcaagctgacacggcagggaagcaaagtcacacatcccattttctgccctgcctgcgggcactcaggccatatgtccctgccaaaccccagtgcaggcacagcgctgcacctgcagccacttacaggctgcactgggcagtccaagccaggctgaggccacactgggaccccactgcgtccaaacaccaggaaaccctaaggacccttctagcccctgagaggtcaggacccccagcccgaacgtggaggtgcccagttggcataagcacagggaacaccgtgaaaggccttacgaagccttttagaaactctgggctttggaacttgtgctgcagagtaaaatagaaatcagatcatctggacaaatccccccttgagctggcgtttgttgattctgcctattttcaacttggagccaattatcctgtggattcaaatagtcctagatctgccttgtttggaggctgaggccaatgccagctggttaggagccactctggtgggctgaagccacaggggagggcacacatcccccgtgtccttagctgtgccctggtgtctgagtttcagccagctgggaagtgtttcctgtttgtatagccagggtaccggcctgcgctgcattctgctttcatctctgcagattgctttaaaggccactctgtgtctactttctgccctctaatccccactgccaccatggcctttggccagaaaagccctgggtctcatgtggcggttggcggggcggcagcaggctgccttagcccgtctgggcatccctgccttgtcgagcgtttcccgggaggaaaaccacatccttctctttttttcccatggctactttccccctccccatctcctccaaactgtcagattctcaggcacctcttcctgcctgccagggccgccctttcccagagccccgcagccttggaagggacacaccagcgactgggcgtcccaagagcccctctccctgcagtggccctgggctttctccccgccttgcagggagcccataaattagatctgtggctcccaggagccagggcctctttctgaccaacagggaagcagtatttcttggcaattttctcagcagcctctttcaccgggctaaatgaaaaggaaggtttccgcgctcccagccttcctgcaggaggactgtgcgtcagcttgaagcagcctgagcccatcaattattcagcatggacccagcactttgaatttgcaaaggtcttaagtatttttatagattcttttctcataatgtcccagcgagacaagcaaggtttccctgtttcctagacaatagatgcagggttcaactcggagtcagaagacttgggtgcaagcgcagccagcgccactcatggagctgtgggacctggggcagttctttcgatggctctggtgtgcagttctctgtggtataattcttaggaaggcctccctagcccaggtcattgtgtgtgtggggaaaaaaatttgcaaatgcagtgtgattaaaaaatgcatgtggttgctcttgttgcaccaggtgtggaaacggaagcttctatcctgagctgaagtgcaaccattagcataggacactgcaaaccgggctctgctgggagacagtccccagggaaacgtgggcgagtcggcgcctctactccctggccccgtgggggtggctccatgacatggtggtcccactacctgctgctgtgggctgactctgcatgtgtcagggtggaagagggcacggaggtcatcacacccaaaccaatggcttagggtgggatgggaccccagtagctgactcccaggtcgggaactcttttctcttccacaccaggctggctctgtccaaaatgtttctcccgctcccatcggcaatgctgggaccccaggcaggaggcaccgagggctgcctaaagccggagtgttagggcaatctacgggtgcagcccactagggcgcctgcccctcccagagccctgtagtgggtttcatgccatgtacccatcctctcacactggtggccccagcatcacagctgtccctgggactggcccaggagccacctccatcaaccaaaacaagcagacaaatgaaatgagtccctggcctggtgcggtggctcacgcctgtaatcgcagcactttgggaggccgaggcaggcagatcacctgatgtcaggagttcaagaccagcctggccaatatggtgaaaccccgtctctactaaaaatacaaaaattagccaggtgtggtggtgggtgtggtggtgggtgcctgtaatcccagctactcaggaggctgaggcaggagaatcacttgaaccttgggaagcagagtttgcagtaagccgaggtcgtgccgctgcattccagcctgggtgagaagagcaaaactctgtctcaaaaaaagaaaagaaatgaaatgaatccctgttccagttgaattccaaagagtcgtgtgacttgtccagcgtcacaggttgttaatggcagaacttcccttaggctgaggtcccctcactgcccagccctgcccaaggactaagaccccagccccggaaagaggccctcctgccacagcagctgtactcacagcacccacgtgcttggcactgcagaccgaggcgctcggtctcttcttcctcttctgcccagaacaattttacagaaaaacaaagcattgccttgggaatatttcagtgttatttgcccctgaggtttctaggaacactggacttgtaagtactataaagctcacatgcctgttacttctgtgcaaatggagccacctgaaagatggtcacaatggtggagttggggagacttgagctggaatggtggttccttccctgacctgcttgtgaactgtggtttccttgcctgcagtagagataatacgagacactagataataccagtcatgcctcagggtcatttcaagggctaaactagatattgcacagtgcctggcacaataaaaaaggtctcctcttttcctcctccttctaacaattttcatttatttctgtataaatgagaaatagagaaatgggtgatagagagaaaagtagtcattcatgcgtttattttattatcagaaagtatgtgttgaagttgtactggttatacccagcaggtggccatgagcagcagggggaagaactgggggcgaattcgccctcctgaagcccaggctagtgtgggcagtgccgttccagcctctcttgatggcaagagaatcttctggtgcatttcactgggaagttcagctctttaggttctgctgggcctaagggctcagaagatgtcaggatgctctctctttctctctctttctgttttttttttcccttagttcgccttacctcaggcttattccctttttactacagacgggctttctccagactctggaaactccaagcttatatcctcccagctgagctgctcctgatgaaaataccctatttctccaagtgtctgtgtttaaatcccatgaaaatattctgattggtcttttgtggcccattgcacatccccaggcccagtcactattgccagagtaagggctaaaatgaacgtctctttctaggtgtcgtgagtgttcctggggcaggggtgatgggcaggtgctgtgactcatggtcccttcagaaccacctgaaattagacaggagtgatgcccacagaagggatgctggaaaaagatagatctgttcacccgagaggcacatcagaaatgtgactcagtaaaaccatccagcaggtgcactgctgcactgagagtgggcaggaaagtgctcagatccaagtgtgaagggaggaagccatcagctccattcggaagagcacaaaagactgtcgagtgaggtgctgtttgatccaggcttgaagactgagtcaaattcaaacataaggctatcgcggaaggatgagacataaagttgagaccagcatcccaaaccaccccatctcaactcaagaaagatgactcagccaccagaagcattctgactttgaaagtcttacccatgaagctgtgggaggtcttctgctggggagatgtcatctggagctgtgaacgactctggctggactttgttcgctgacttcaccgcatcagcgtcatcagcacacactgaacatctgctgtttacagggccctgtgctcgggacacaaaaggtgcagcagtgtcctgcccctcaaggagctgatgtctggtcaggaagacaggaccacagactcccacagttcaaggtcatgcgggccagtgtgcagtcagcatgaggaaagcaagtgactggagaattcagagaaaggtggcctggaaggtggggagtgtgagagggcttcagggaggaggcgagccctcggatgagctttcaggcagtgcagggcctagctcgccagtgagggccaaagacaaggacaaagggccagatggactgcccagaaagtcctcttcattcattcatgtacccactctcttactcagcaagtttcctgagcacccgctgtgtgccgggcactgctctgagtgccggggtcacagtcaggaacagaattcggaagcccctgcctgctaggagctggcattctcaagggtgggacacacagacaccaacaaacatcacggagtaagtgatgagctccagaagcaccaggaaggcgagcgctgggctccatcctgtggcccaggctggggtttgcgtggagatgaggttcaagcagaaccaggcatgaagcagccagcatatgacattgtggcacagcatcaatgtccttcagaagagactgccgagttctcacaagggtgtgcagcagggaggggaaaccccggcagcaaacaggaggcttccaggaagggggaaggctagtgctgtcctggctggacatgtgccagagggaatgcttacccggcagggtagaccacaggggtgcttggagaaaaccccaggagcgctgtcctgtggagccctgatcccacccacacccctaacccagccccgcccacttccccaacccagccccgcccatttccccaacccagccccgcccacttccccaacccagccccacccacttccttaacccagccccgcccatacccctaacccagccccgcccacttccctaacccagccccacctacatccctaacccagccccgcccacttccctaacccagccccgctcatacccctaatccagccccacccacttcccgaacccaatccccccatttccctaacccagggcccaactcacttccctaactcagccctgcccacttccctaacccagccccacccacgtccctaacccagccccactcacttcccttagccagccgcactcccctaatccagcaccacccacgtccttcacccagccccgcccatgtctcttacccagccacacctacatccctaacagctctgcacatgtcactaactcagccctagccatacccagagcacacacccaatagagcaaccacctcacactcgtatattcacacacctagcagggcagctacccacactctcacactcatccacccagcaatgcaaccaccccccacactcacactcacacacccagcagggcagccagcccccacactcacactcacacacccatcagggcaaccaccccccaagcactcacacatacagcagggcaagtacccacactcacacactcatacacccagcaaggcaaccaccccccacactcacacacacaccaggcagggcaaccaccccacacacacacccagcagggcaaccaccccacactcacacccatacacacccagcagggcaaccacctcacactcacactgatacccacaaggcaaccaacccttacactcacacacacagcaaggcaaccaccccccacactcacagcaaggcaaccacccaacactcacatacccccagcagggcaaccacccctgacactcacactcacactcatgcacagcaaggcaaccacccctcattcacacacccagcaaggcaactaccccccacactcacactcacacacagcaaggcaactaccccccacactcacactcacacacagcaaggcaaccaccccccacattcacactcacacacagcaaggcaaccaccccccacactcacactcacacacagcaaggcaaccaccccccacactcacactcacactcacacaccaggcaaagcaaccaccccacacacgcacccagcagggcaaccaccccacactcacacccatacacacccagcagggcaaccacctcacactcacactgatacccacaaggcaaccaaccctcacactcacactcacagcaaggcaaacaccccccacactcacacccatacacacccagcagggcaaccaccttacactcacactgatacccacaaggcaaccaccccccacactcactcacactcacacagcaaggcaaccaccccccacattcacacacacacacagcaaggcaaccacctcccacattcacacacacacacagcaaggcaaccacctcccacactcacacacacacacagcaaggcaaccacctcccacactcacactcacacacagcaaggcaaccaccccacactcacactcatacccagcagggcaaccaccctacactcccactcatacccagaaggcaaccaccccccacactcactcacagcaaggcaaccaccccacattcacgcacacccagcagggcaaccacccctcacactcacactcacactcagcaaggcaaccaccccacactcacactcatacccataaggcaaccaaccctcacactcacactcatacacagcaaggcaaccacccaacactcacacaaccccagcagggcaaccacccccaatacactcacactcatgcacagcaaggcaaccacccccgacactcacacactcatacaccccgcagagcaaccatcccccacacccacactcacattcacacacagcaaggcaaccacccccaacactcacacccagcagagcaaccaccctgcacactcacactcaggtgaggcaaccatcccacactcaaactcaaagcaaggcaaccaccccccacactcagactcacacacccagcagggcaaccaccccacacactcacactcacacacccatcagggcaaccactccccacactcacacatacccagcagagcagccaccccccacactcacacacacccagcagagcagccaccccccacactcacaatcacactcacgcaaggcaaccatcccacactcacactcctcacactcatacacagcaaggcaaccaccccccacactcacacacacccaggagggtaaccaccccccccagacacacacagagcaaggcaaccaccacccacactcacacagcaaggcaacaaccccaccacagtcacacacacacacagagcaaggcaaccaccacccacactcacacagcaaggcaacaaccccaccacagtcacacacacacacacgcacacacacatatcccagcaacccatccctgccacgtgcagcactggggccggggtcaggtctcggcaggatgtcatctccatgtcagggctcctgacaccggctctgaccaaggcttggaatgcagatgaggctggaaaggcaagagatgagcgccagggctagacagcagggtccctcctgctcagttgccatggcaaccccggaggaggaggggaccactagggcagcctggctcccggcagcagctctgtggggcccagggctgtgtccctgtcctctcggctgccacctggtcagtgctgagcccagccagaggccagcccagtcctgtctggtcctctgggtgagataagtgttgggtttctgattaaacccgggcagaaaagcctgcacaccccaggctcgcctccctaggccgactgtggagccatgtcccagacctcctgacctcttactcacccagaacaaagggatttgccttttcagaaaacaaaaggaaaagatgcaggcatgagctttgccctgcaccaccctgaattttctgtgtatgaaaccccttagagcctctgcactcccttggctgtggggctggcctcactgttctctggcctctgaagccaccgcaggtcccagctcatggcccctgcctttgtctccggttgaaatcagggctgtgccctctactgatgggcctggcctggctgaaaccgcaacatcagggcaaggtagagtggagatgcctcttcctgccacccctgcaccagacaggtgttgacggaggaatcaggagatgctgtccttgagtgaagccacgagtctctctgatgtggagttttaggcttggtgacacacacagcaggctcagcagaggaaacagagcgctttgcacacacacgtgggcctccgctctccagccaagcccaccctggctttggcagcagagccatgggcaacccagacggtgtcggggtcaagaaggtgaggccggcactaaagacatcccatcccccaagacctgccctgctgaggatcctgcagggccctaagtcacagtgtagctaattcttccttccagaaatttctgggagaacccagttatacctgcagatggaaagctttccacacgcgtgatagctagtcctgccagatagtaggttctagaagatggcacagcaaccccaaggagtgtgggcagtaggctctgggctgtcactgaggagccccgggccttaggctggtcacataggctgccacctcggtttgctgcatgatggggtaagaagacccagccttccctgcagtgtttatgtgctgcggtgtagacgtgctccataaactcagtgaaggtggttctgctgtggagtggccagcgtcataggacagcacagaaccaagacagagctggctatctcggggggcaacttgattcccagaggacactcttgctttgttctgtttgagtagaccatggggagggtcacagagcctctgacccggtcctggtccccagctcagccttcctggctcctgctgcagccctcccctccacctccacagggagctgtgcatctgctggtttcagtccttgccctgccaggtacagtctgagtgccactgggcccgtgccttatcatctctgtgcctcggtctcttcatctgtgtaatgggacaatcatagtgcatacttcacaagattctcatgcaaataagtgaggtgctatctccttatagtgcctggcacatattgagtgcttcatacatattagcagcttgacagtgttactaaaatgttatttagagtcaggcatggtggcacatgcctgcagttccagctacttgggaggctgaggcaggagatcacttgaccccaggagtctgaggctgcagtgagctgtgattgtaccacttgcgctccagcctgggcaacagtgagacctcatctcaataacaaagttacttagtaggaaagttattaaggggcaggattcgagttgcattttagaaggataaccggcagcaggacagaggagaggaagcctggaggagggagctttgtggagaaggggacagcgtccaagtccccaggctcaggctgaggggtcaggagtgcaggggaatgggggcagccgtgatgaaggggacagagcggggagatcaccccagctttcctgcagcagatctgtgttctgggaaccagccagcctctgtggcctccactttctcctgcgtgaagtcagaaggacgtgaggcccgaatgtgtgtgctgatgctcggtgaactctgaggagacctaccattgctcagcccgtgctggcactggggaacgtgcctgcacattcccccagcattcataggtgctaaataaagcacccttttttctgggccaggatctcaggccgtcacgtctgtttatgggagcttgggcttcggtttcatgagaaaagttatctgtttcctcacctgtaaaatggggatttgaatagggttagtgcacctctttcaggctgcagaaacagacccgaggcaacctcgtggggtggaggctgatgatgagaagggagggagctgcaggtggaggaagcagcagcctgtgggagacagatgcagccacaggctcactccttcatgctctttctgcctctgctcaccccctctccctctggggactgtcacagtcctgaaacagcccagaggcaccactcccaaaagagcacagctcaccagacttctcggcccttcagttgtttgccctgatgtccggctgtagcccagctgggctggtctcatgacccagcgtgtatccattttgcacagggaaccatgggcggcgtttctgccagaggagcagagcaaggataaattcactcatatgcgaaattgtcattctgtcctcatcaagcatagcctgtcatggattgtgagttaggagacaagtcaactctgcatgtggacagactcagtaagatttcattaggaggacagtgaccatccaccctgtggttctcaatgggaggtcgcacagcaccccctccctgccccccaccaccaagggacacgtggaatggtggcagagggagccttttggattgtcatgacattttatgacactggtttgctctcagttgtatattttcctccccaaatgagttgtgcttcctgtctcatttcagttacagctcttggttgtgagcaagagaaaatgacattattgtaaggctgtcaggtgcccacagaattggcaggaggtaaagaccagaaaacaggcagaaccagggcagatccagaaggcagaggcaggagatcccgggccagtccttcagcagagacaatttggctaagaggatgccaccgcccctgcacttcacatctgcctccagggttggttcacagatgcgccctaaccatcccttcctctgagactcacacgcacccaattcagagtcggggcctgagcagctgactggccaagctcaggtcacatgctcacacctggtcaccagggcatgagctgggaagaggagcacgtggtcctctggttgcagagaaggctgcacggcctgcctgctgttctgcacaaaatggggagctccctccacacaggaaaggagagggtgttggatatggcaaacagacacacagtccaacgaaagacaaatagcagcaagcatccactgtgctctttaatattccttctccagtgcgtgctgtgtcagtcacttacgaatgtcagaaaccccactccaagtagctgaagcaaaaaaggcggaaggtatacgctgtgtaacctgggcagggcgggtggcttcccacggggcccagctgcgggcccccagctccttgccactgggctctgatggccaagctaccacactgtcggcttggctttgctctccagttagaccctttccccacatgtgctgagcatggtggccccagcggccccggccagctcagagcaaggctggcctctgagtggttctgacaccaaaacttcatcctgtgtctccccacgccccaggagaaaggaaaccccagggatgggctcctgtgggaaagggggatgcactttccagaagagggaggaagctgctggatggaaatgacctcatcctgcactggactccaaggaggccctcaagctaggtctgtcacatcagactgtcccctccaactccagcacatagtcctgggatttgggatgagctgcagctgttcctgtctttgtcccactgcaggcccagagcctgcacacctatgtctggacacttgtggtcagggcaggcagggtgggtggcatccgtggggacaggaggggaggcaccatcccaggaagcctgggtgtctttttctgcctctctgagcccatccaggctggctcagatttgagcaaggacaggtcgctgtgagtgggaggaaatctgttttattggctcattcattccacagcatttaaagagagcagcattgtgctaagtactggagggtccagcataaaaggcttggttctcgtcctgaagttgagagtctgctagaggcgaccattgacaaaggccctgggtgtaagtgctgtggcttaagaggggcagtaagcccagtggttaggggccagctcagagctagactgcagaggttcaaatcccagcttcaccacttataagctctgtggcttcaggcaaggtcccgaacctgtctatgcctcagtctcttcatctgtaaaatggggatgatgataccccagattcatagggctgttgtgaggattaaatgtgttaatacatgtaaagcttttagcaccacagctcgtgtggtgtgctgtaagcattagctaatgttgcgatgacataattgtttctctgatgtgctcgggttgtcctgggtacacacagcccagcctgggcaaatcaagcaaaacttcccccaggagaaaatccctgagaactgaactaaggcacagaagggagtgaagggctttccaggctggaggaaagcttgtgccgagtcaggggtgtgaaagagcatggtgtccggcgggacaggagtgctgggtcggggttggaaagattgtgtcttatggagaagaaacgaaagggttctagtggagaatgcgaggctggaaggaacagcaggagcgcgtggtgagaggaggtgtggaggggatgggtcagcagtgcctgcgtcttcccctgcccttgggagcccatcgaggaagtggatgtgaccgttttccaggtgaacagattaggtcataatgagacaaggtgttggctgagctgcccccacctggctcctccagcagccagaggagttagctcatggttggcgaaggctcctccaaggagccgctgtgggcctgggagccagggagcttgttggaacagcagtctctgtgtgtggcatgggtcctcggcactggcacacagagctgcagaaaggctgacgcgcccccccaagggcttgtccccactgctgctgggtggcctgcctggcggggcgtgcctgggcctggtgggattacagggtctgatgtcgtttttctagacaccctaggtcccaggtctggcagcgtcctttggcttccttctccggcccctccacccctaggaacgacccaggttacatgtaaagaaagcccgtttgtttagagtgttggggggctcttcctcccggggcctgggccccaggagtccctggtttgtcaagcgaggggaggcctccactgcttttccagcccaggaagctgcccagtgctggcatctgttccccggcacccggccagcacctctctgccggctcaggccgggtccagctcagtgcccagtgagcagtgacaagcttttctgctgtcacgtccctgcgcctgtgtgggtgacattccagctgagctcctgtgcctagtgggagggaagaaacccctttgggcttgttcaggcaccagggcacccagggggacagtgctccccaaacactgacgaccaggaaaacacatgctgcttgagcaactcctcgcggtctgactgtgctgggggcaatcccattcctgcagcagctcctcaccatctggctgtgctgggggcaatcccgttcctgccagctacgggtgaccacctgctctaaaatagtgactccccaactcaggcctctccacattgcacacacgcctattcaggtgggtacagctctttatagtttaaagagagctttcacataccaggttccatagatcctcagccattgcacagattagggaactgaggccacgaggaaaggactgagcctgggtgctcggcttgtcagcagtgctgggaccagaaaccaggcttctggggcctggccttggtctgccatgcagagagcacagggtggagtctctccaacaccccgagccgtgggcggggcattcacaatgtgagcagagagggaagggagcaggcatggaatggttttagtaagtggagctgttctctcccttctatggcagaacagactccactaagttttgagacctgaaaatctgggggaggtgggatcaactgacttcgtgtcgtttggtgtccagggaaggatgtgagggggcagggattgtcttgggccacccagcaggtcagagaccaacagagtgtctgctcagtgcagttggagggtcatgatctgtcatgtgacggtgatataactctgataggttatgtcatcttaataatgacattttaaaaaccatgactaaggctacatgactatgtctagggcttcctgtagaccaggcagtgtgctgagagctcacatttgtaaccttattgaatccctgattaggacttacgaggtagatgttattatccccagaactagcctcatggctgtgggcagtggcacagggcccctcgtgtgggttcatgctctgctgtccctgtcttgaaattcttagaactttttttttttttttttttaagacagagtctcgccctgtcgcccaggctggaatgcagtagtgcgatcttggctcactgcaacctctgcctcctggtttcaagcgattctcctgccccagtctcccaagtagctgggattacaggcgtgcgccactacgcccagctaatttttgtatttttagtagagacggggtttcactatgttggtcaggctggtcttgaactcttgacctcgtgatccacccgcctcggcctcccaaagtgctgggattacagatatgagccacggcgcccggccaattcttagaactttttaaacaaggagccccgcatcttcgtttcatactgagccttgtgaattatgtagtcgttccggttgttctcatttctcagaagaggacacagaggcccagagtggtcatgaagcaatgtgccagcgtcacaaagccaatggctgccctggagctctaacccagagcccacactctccagagtagaaagaggctgagacagagtcaaatgactgtgcccaggtccagctgctggcacctgcctgtgaccaggaggtgaggcacttcacctgccctagcctcgatttctccttggtgaaatggggtgatcccgcctgcctctgggggctactttggggctcacatgggcagatgtgcacactgtgttttctgcacttcaccaagctcagcagatctgaggaccatcactagctggtcacagttcacaggggctaatgcccgtgccaccagatggtcctgacatggtctatgcaggccttcacctgaggtcagcagttccagaccagcctggccaaggtggtgaaaccttgtctctactaaaaatacaaaaaattagctgggtatggtggcagctgcctgtaaccccagctactcgggaggctgaggcaggagaatcgcttgaacccaagaggtggaggtggcagtgagccaagatcacgccattgcactccagcctgggtgacaagagtgaaaactccgtctcaaaaaaaagaaaaagaaaagaaaccaataattgaaataaattgtctgcaatacagttacagacttgtagcagtttcctaccctgagaggagcccctcacccagcagtggtagcccagtgggatgccctcacctctgcagtgggagcctgctggtgggggagggggtgggccaccagggctcctcatccatgttatctcctcacagaactcagggcgggagggtgctgctcatccgcctgcagttgaatcctctccaggaagctttgatggatctaatcagagctcccctgccagggagaaggaagccctgtaggtgcagctgccccagacatgctcaaaacagatcctggcacctcagcaaagaggcagacggcgcctgggaggggccccagaaagcagctgataagtctttagatttggacagattctgaccgtgaaactgcacaggagactcccatgagtacatttcgcatttgcggacttagcgtgctaagtcttcagagagtgccggtgaattttagttctgccaatctgctagaacataggaggttggtatttatcacccccattttacagatgaagaaaatgaggcttagcaagcctgacaagacgtagagctaggccatctgatcccaactctagtgtctgcatctggagacagtggttctccaccccggctgcacactcggatcactgggggagctgaacactgctgtctgagtcccatctctcgaccaattgaatcagaatccagttcctcagggggattctcgcttgctccaagcagagctggaggtgacagcgggtttctctgcttaccagttggggtggactattccttctcattctccatggatgccccttgctagggcaggctcgtagcctagggcggcagaggtcgggcagcaggacgtcctccagtcacatccccaccacaggctggggctgaggaaaacgtctggactggaaagttctgctctcctttcttaagcgtctgcgtgccatgtcggagaggaatcccaggacaccgcgaggtggtcctgctgcctgttcagcttttgccaccctcatcttaattcttttccctcctatcctcacctcccttctgcccagttcccctcactccaaacaagtaatcatgactatggctattcccttcctttttttttttttttttttttggccgggatgtttttaggcatttacaagtcagtaacaatccctctttctttctcctttttcaccccaagggtggcctactctccaggctgctgagaatcttgcttttcttcatttaagctttatctcaaacatcattccatatcaattcattcttttttatagctgcatgtcccccagcacagattttttttttttaaaacacacccttaaaatccagggcttaccacctgggtccaaatcagatgtctcctactctgattcacccatgtccactgcccaccccatggacctcggaccacagagtctggaggctgcggtctcttcttactgggagttagatttctaccctgtgtctgatgttatggggtaggagctggggcttatgcctcctctctggagatggggaggccacatcagatcccatagctgaagtctttaccaaacaggtgctgccatgcgggcacttaggtgaacacgagaagcctcgttctagaacaatgagtcacagcctgcttgtttagccatccagcccaggtgccaccgccttcttccctccacagctgcaggtttatttgcttctgtctctgaagaggtgaggtaaggtgttgttcttggaggaagaagctaggagcgtagagtaagacctggatgtagaaacggctgctggaggacaggacctgtggtgggtggaggtggtgagggggcagtggcacctggacggagcagacccaccttagcctgtgtggggtgcggtttccctgctggctggctctggggaccccccggctgttgccacagagaggagagacctgtggcctcagattcagacagcctgagcttgtccccacaacttattgctgggagatctcggtgagtcatttaacttctaggatatgtgggttcctcgtgtgtgaaatgagaataaaaacaaatccctgcagacttgctgggggcattaaataagatagtagaggcggagtcgtttttatataaatggtaaaacactgcacaatttttcaattgctcattaacttctctgcattgcattaaggcattaaaatgatctcacttccgtcccgggctagccatgagaagcgcagccaccagtccactctgagcctcagtttcccctcctgtggagtggacgtgcccgcctctgagtggcagggcagggatcgggactgatgcggttctcatccctcccacagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcagacctggcccttcccgaggccggctgcggagccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactggtgagtggctgcccccaagaatccccagaaaagaggagatgccaccgtctctctgtgtctttttctgtctctctctgtctgtctccccacccccaccatgtatttcttcccctctctctaacccccaagtgcacatctgtaatcttcccgtgagttgaaggcaggcgtcatttgtatgtggctggggggacccaggtgtcatcagcccctaattgcagacactaatgaaggaagcaggtgttttctggcagaacctgaacccatgttaaggtgtacccccctccccccaacaccgctcccagtactggagtctggctcctggggtgtgactgcccctccctctgtgctggaacctccccaccctgctgtccaccccagctgcctgccactccggggaccactcttctgcacgtgagcggcctcttcttgtgctgggcgctggccgggtggctccatggggcacagtggctggggtgtggctgtgcagggcgctgctgtgaggagctggctcggtgtggaatgtgctcgagtggtgaggagttgtggagctgcccagagtcggcgggatgggtcctgcctggggagaagctcggtgaggaggctcagaggaggagttggctcagaagtcagggcggggccaggtgtgagctaaaggcacattgtgtttgagctgggaccgcagcgcggtcactttcctgctcataggcaaagcagattcccaataggagcatcttttgtgcatggtgactcagcctgagaacagggtgggggggcagagctgggtgccctgtccccttccacccccccaggggagaatcacccgtgtctggcacgacagcctctcagcagcaccaggcatgaagctaaccctaccccagctctcaacccctgccccaccccgtccctgaggcccaggtgacacctgcgagtcaggccactctggccacaggtgagccagccatcaagggcagctgccttccagagccggcagtggctcttgggtcagctgggtaggctgaggcctgcttggtttgttttgcagaatcccgaaaactaaatccccatgaggcctggaatgcctcaggggctgagagaatccactggggtttggagtggggcagggctcagggacgcagggatctgactgattaattggaagcctgtttgcgttttaacacttgataccgagagtgcttctcagaacacaccattctattatatccgtctttagtaacgagagggtgcatgtgctgtcggcttcggagaagatgaggcacctgcgggtttgagccatatctctggggtgctctatcacccctggtgctcttggtggggggtataagaggtgaggggagatgcacagtgccccaggacagaccgcgcacagcccccagctgctctttgaatggctgaggctaaactgctttgatttgctttcttaggaaggaacaaaaaacattcttgttcatcaaagatactatttgttggtttcgagttcgagattttattgcctgtgggagctgaggctttttctttttaaggaagttagcattccgcatagcgcccactaggatggagtttcctagaatttgtcctgcttatcgtcctttagtctcctcactctggcgtgtaccgtaaccacctggggagcttttaggattcccaaagcctacgccacaccgaagaccaatccaatgaatgtctgggggtgataaccacacgtgtggtttttaaagctcctgcgtgcttctcatgtgcagcctgggcctcgagtctacaagtcatgctcacatctcctgccaggcctgtgagccaagcagcatgaagtgccctgcccagtgtgctggccaagcgaggaaggtggcccagggtgaggcacaaccgtgggtgatgtgtagagccaggctccataggccaacagcagagcagaaattgtcaggactaatctgactaccaaaggctgtcgtacatagggtaaagggaatattagcattattaaaagtgctttatatttgcactgtttccgctcctctagccacttccctgtgccaccaggggtgtgtcctgtatgccaggcacttcgcaggcattactcacctcttctaattgtcggatgaccttcctggtacccctgcttttcctgtttgattcccaaaaatgtaaatcacaaaaatgtcagcaggcaacagaatgcatgggggtgggggcagagagagaaacaggactgaatgagttgcagcctcattccgtgatctctgattcttacaacaagactacatgattgccctcactgtgtccatttcatggatggataaattgaggtccacagaagtcaggtgacctgcttaggatgacatgatgagtgagccacagagccggggctggaactcatacagggtagagagctatggggagagaggtagcaggtgaggctcgtgaggtggcccaacgcagagggttccactgggcatgctcaaagagcagcgaccaaggagatgcatgctccagaaatcatcctcatcacaggatagagaatctctcagagcattgactgccaaactctaatgtgcatgcaggtcactggggctcatgtgcagatgaagattctggtccctttggttgggaatggagcttgtgctttcgaatttccaacaagctctaaggtgacactattctgttagtccctgggccacacttagggtatcagggaatgaaaggagggcgagaccagggccaggggaccaacaggggacctgagaggacagacccagggatccccaagcgggagctctgagccctgtgtctgtcataactgcccatgtggcttggggctccttcggtgaatgggcctcagtgaacaaacccacagcatcccaccctgagtggtccaagaaccacactcattcagaagattgcgactctgaggcccaaagcacaccagacacagactggctggcaggtaggcaggcaggctggacgtgcagttccgcctgctgctgggattagaaagcaacttgcaaaaaccctttgattggattgaaaactgagagttcagcgttggagaacaaacacattctgctctatttaagtctcagtcaaaacgttaaacttaatgccatggtttccctcattcatcctcttaactcattgaaggtacctttaaaaattaacctatttaactcagtgaaagtgatttgcataaccttttctgtcatattttaagcccagaaggtggttttctctacacctgggcaagcccttcctacagatttgttaggctcaagtgcaaatgtgttgtttgttctcacgtggccaaggaaatcgattagaaatctgtaattcccttagtcgtgtggatattttctgtaacttaaagggagttttgactgcaggagaaggcagactctaacctgtcctctgaccacctagcagctctcccaggaggcagtggtcaatgtcacctcaaccagaggcaggcagtgctgggtctggaagcatcgtcttaatctgctcccgcctcctgcaagaccagctaaaaggcagaatgactgcctgactgtggctgatctctgaggctgggaggatcctaacagctctcaggggtcagctctccctctcagctttcaaggaaatgactgtcactcctgacgccccccagggatcagcaagtagatcagattttccttcaggctaatgtgttggggattcaaggctgatggagatcctccaagcctcttagtgcgactcccagctaagacggcctgaccttgggctccccggggcggagctggagatgtgtggctctctggctgtggcaggcagggctgcggccgcctgactcctccaggcgaggcccagtctcgctgctcctgggacactggctcaggggagtggccgttgtgcagctgcagttctaggctgctcaggtccccagaaggtcacagcccccaggtttcaccttccaggcagccgagtagcctgggtgggagtggggggagggcattgcttgaggaagtaggggagctaggaagagcatgatctggagctgtgggattctctcctctctagctgagtccggaattcagagcattcacacacgcctctgcccgggctttggtccatcagccaactccctgggatggggccctgggcactcagcacaggggagcagggaccctcctttctgttttctctcttcattcacacccacaagttccccttgccaacctggaagacagagaaaaggggcaataaagtcttccgcgtggtttatgcagtgccaggatgaaaaccaaaaccttccggcttcctaatgggcagtttgtagtgagaagccctgggcacccactgatattttttcttctagtttcacgcaggtgtgtgatccctgcagacaccctcctcccgcagtctcctccctccccccgcaccaaggaggtgtttatggctgttagagagagagaaccttgacaagttttcatcacttagggcctgtcatggcaggaggcctgtgacctaaactcagctggccccactgtggccacagcgtggcttcgagggggctgccctctccctgttaaccctctgttgcctgtgctgcctgcttggtatgcacaagactctggtatgtcaggggacagccctctgaggcaggtgtcatccatgtgtgctaagcagtgtggccaaatggcaggtcatactcaccagtgtcttccgacgggaagtgggcgatacagccaggttgataccccccatctagggaaccttccatatacactatcctgcaagaaggcttggaagtatttgctattcccatcttacagaggagaagactgaggctcagaaaggttgtagaactgagggacagaaagtttaaagcgacttggccaaggtcatatgcaaggatgtggctaagccacgacacagacacacatcgcttggttctggatccagatctctttgttctgggcacatcagatgtccaagtcaaggggccctgagctgccagaaagcccgtgcttaaacccttcagaacagggtacttgtaaaaggtcacacaggaggttgctagcactgcctcataacaaccatttccagggacagggcagctgtactgtttcaggatgaaggtagcaagttgctcggagccatcagcgaggcactggctgagcggggatttggttcacaagagaattcctcgtcccagcctctgttctcccaaggctaagtcttctctgcatagcccggtgctttcagcctgtctggcaccagccctgcaggaggaagattcctgttctattcatctgggcagatacggcctcgtgggggttaccaaagaatgtataaacaaaagaaccaggaaaggaaatacaccaaaacttgatgatctttatttctgagtggtaatattattcttttgacttttttatagttttcgaagtttccaaaataggaatatatcatgtataatcaaggggaaagacattattgaaagaccaaagaagcaaaagtgctagcaccaggctcttctctcccttgccaatgtaatcggtatgcattcttcaccttgtacttctgtagcatagaatctcctagaataaaataaaagtaaggccttcaatctcccaacattcaaataaaagtaaggccttcaatctcccaacattcctgtttgatgtgagagctgatgagttggggctgctggccagggagctgcagctgaccccaaccgggaggtcctgcctgctctccctttcctggctgtcttgcagggtcaaggagaagggagttggaggatccccacagcagcacctcaccggaatagcagctcatggcgattccggggctgagagaggcaggcggaagtcttttcatccagccccatgtccattcagcactaccggcctccactggccgcctggcttccgtgctggggtggggtgaggccaaggtggatgggtcagggctcctgtctttgtgaagtttcccttcgaaggagaagacaggcacataaacacagtggcacggtgtgacaaaagttataatagagatgcagtaagttgagttctgagatgatctggtgagctgagggccgtgctgagtggatgatggtggatgatgaaattaaccaaagggaaatacgcaaattcctcacttccttggcagccagatccatgcctgtccacgtaattgcattaagtttctccttatttcccattcacgtttcttctataataataaactcaattcctctgatgggcaccctccccattataacagcacaccacggtatggggtagtgactactgggtgaggcacctagagcgtttgctaaaaatgcagatccctcccagccctccatggaaattcagattccataaacctggggaggtgttggggttttaacaggtatctgcaagtgattctaatacaactggctcattaactggtcaagagtgcactggaaaaagcataatatgtgtaattagattcaacttcaagtcagattctaccatatcctagttgtgtgcctttaggtaaaccaattaaccaagacttcttggttttgtgattgtaaaatgataaatccctacttggcagcacgttgagcagggaggaggggaatgagtggcattaggacactgaacagttgctgggcccctgggatggttgggtactgtattacgcatgtttatacacacgcctcacatcattcagtagccacagcaatctttccgggtaggcacgattactatccccatttcacagatgagaaaactgaggttaaaaaacttgcccaagatcaatcagcagagcaggaatttgaactcagatctgcccgacctcaaagccctgcagtgggtctggattcacccaccatgctataggaaactgtgaggcccctggcagctgaagcccaaagcatgttcttcccaagaagacaggtacccgagtaatggagtatgaagtgactttggagaacaaaacagcctcaaacttgcctggaggctggggcagaaaatagatttgcctcacttccctttggaggcgcaggcaggaatctatagcaactgcaggtgcctgggagccctatttaatcccacaggtccccactccagcagctcatgtcctgtcctcagctctccctcccttgaggttagcagcctactgacaccttcctagctggttctcgctcagcatcagatgtgaagctcccgctacatctgtttccaaagcaggggatagagaacccaagaaaagcccagaaatcccaacagttgtgccccaggggtcttctgagggctctcaggtgaccccagggcacttcggcactccatttccataggacagttatcaccttggctaaagcttccagtttcatgtaatgcaagccccaattcctgcctgcagatgggggaggccttcctgcaggtggaattgagaaggccgtgcaggggagctcctgtcggagcagggagacagcccctgctagggggtgtcttctctccctccgccgactggcccagagacccccagcagcatggccgagctcacagaggtgagggagccagcccttcctgcaggtcttgccgggggcccagcaagaacagccgtacctgggccatgctcgcagcctggcaggggcagcagtcctgggactggctgcttggcctcacgagggcccccacttgctctccaggggagtggcagggaagttgaggaaggccttggcccctagtggcgggcctggccctcctcatgtgcaagctaaggacacccctgagtgggagggtccccaccgcatctccagtctgaagtgtattggcattaccagccctttgacgttggcaacacttggtgatagagacaataacacagccctacccaaccccggaccatgcttggtgacgtgtgacaggcagtacagttgtcagcgataagggagcgctcagtaaaggtgggtgaagcttgggctggggacccgccctgagccaggctgtgaggagcaaaaaaggctctggcagggacccggcacccaggagctggggcaagcgccacatgggaagtaaaaacgtaattgaatggtttgctctgtggttctgtgtatgaagacgggatatggtggaactagtaattccggaactcgatgtcctgtacaaagtgtgtggatatgggcttatttaattctcataaatgatcagtagtgtgtgcccatttaattacggtcaattattatcagtaagtgggtactattatgctcatgtagcagatgaggaaattgaagcttaggtgtggggtgacttgcccagggtggcgtcaccagcaagttgaagagaaggactttgaaccaggggctgctcctctgtcctttctactggctgcctctccacaggcctgggggcagtgggagatcccagagggtggcggtcagcccgggtagcagagggaggagtgaggtctccaggactgtcccagccgtggagacaggtactgggtaatggagtgtggaaaatcaagacttggctctggggaaatttaactaacggattgattcattgattcattcatctaacaaatggcttttgagcaccagagcatgccctaggcactgtggtggccccagtctctgtctctcctctggtgttttgtcatctagacacatgataaaaaatgaaaccaatgcccaacacgtgggtgccatggtggaggccgcatggaggggcagtggtagcaggcgcccatggggctgtcatcccctctgcagggagagggacaaaggctgagctggtcctgaagggtgacaggtggagaagggaccacaggggaggggacagaacctcagtgtggctgccctgtgggggcaagggcatcagagtgggagaggaggctggagaggtcaagggaacaggagggtcccgtgatacctttgaaagatttgaagaagcagggagacctgcccatcagcctcttgagtggagacagattgagtgaggaggggaggcaggcagggaggaggcccagatgctgggagctgaggtgcagaggacccaaatgcaggggtgggtgccagtgatgctgtcctctgggcctgtcctcacccagccagcagcagtcacatctctcccactctctctccggcacagaatgtcttccttgggtgtacagcttccagaacctcctcagttccaagatgcaatctgatgggaggggaggaaggtgatcagcatcctctctctgtgtagggcacatgccacctgtccagagtcatcatgtcatcagaggctgcactaggactggaacccagagcccctagtggcagatctaggggctcttcggaatgcatcactctgtccttcccaaaggccagcctcacccctgaaggtgtgtagtttggcccacaccttccaagtttgaaaaattaaaggcctgatcacaggggtagagcttaactcttcctgtggagtcctcggcagggcccgaagagcctcctgctctatgcctggctctggggctgtcgtctctccctcccagcaaactcaccattccccagggggcacaggagcccctggcagggaggatccctggaggcctggctcagatggactcatcttgctgtctccttcctgcatgcaagtcagcccagtgacaggagccattgcacctgcccccctcccatccacagtcccaggccaggggcctgaaagagaacccaggaccagccaggctcagagtccccgccctgcagtctctgggctgcagagcgtgagtgcggcctcggctcgccaggagagtcagcttcagctccctcccgctgggctgcagcctccccgaatagagacctctgggaaagaaactccagccttcctctggaaatcaattcacaagaccaacctggttcctaggggtgtttgcgtttctttcttcacatttccccggaacctccagttgcccttcagcagcgtgtttgaagggcactcctgctttctttcctgccagcgttaatctggctctttctcagggaccaaacccaagatcatgtaatacaattttacccaggcttctaagtggattctcctgcacaacactgacgaaaataataaggcagacctgcaggtgaagttaaataagataaggaaagagattacacaaattgtttcctgggttcaagaactgtgagtctcattcccaaatcgtgggacagtggaacatgttctgggcctgcacacacagctggcaaaacagcctggattttacacgcaccctcttttcagcatgcatcagagactaattgtagctattaggctgggataggagagataagagcctgactttaagggaccagacaaaatgcccttcaccaccttggcattctgtctgcctgcccagttctgagctgattaccacgctctccaggacacgcactctttcgcctctggttggcccctgtgcactgggatttctctcaagccagctttaaagatgcatccagaaatctctgccccaaacatgttttcagatttgctgccatcacagcccttatttcaccaaactaaaagaacagagggtttcataagccaaagcgcacacagccacattcttcaggaatggaagcattagacgatagaaaaaagacaaactattaatagggtttcgggtaagacttttgttggaaaggggaggatttgtctggtggtccgtgcattgcctttattttaggaagcagaaaccatggtaggttaaaggtaacaccttcatagagttgctccttgtgcttccaatggtcggacaattacatgttcttttttattttttatttttttttatcatactttaagttctggattacatgtgcagaatgtgcagatttgttacataggtatacacatgccatggtggtttgctgcacccaacaacccgtcacctacattaggtatttctcctaatgttatccctccctaccccccaacaggcccgggtatgtgatgttcccctccctgtgtccacgtgttatcattgttcaactcctacttatgagtaagaacatgccgtgtttggttttctgtttctgtgttggtttgctgagaatgatggtttccagcttccatccatgtccctgcaaaggacatgaactcatccttttttatggctgcatagtattccatggtgtatctgtgccacattttcttaatccagtctatcattgattgacatttgggttggttctaagtctttgctattgtgaatagtgccacaatgaacatacgtgtgcatgtgtctttatcatagaatgatttataatcctttcagtatatgcccagtaatgggattgctgggtcaaatggtatttcctgttctacatccttgaggaatcgccatactgtcttccacaatggttgaactaattttcactcccaacagtgtaaaagcattcctatttctgcacatcctctccagcatgttatttcctgactttttaatgatcaccatcctaactggtgtgagatggtatctccttgtgattttgatttgcatttctctaatgaccagtgatgatgagtgttttttatttgtctgttggctacataaatgtcttcttttgagaagtgtctgttcatatcctttgcccatttcttgatggggttgttcttttcttgtaaatttgtttaagttctttgtagattctggatattagccctttgtcagatggatagattgcaaaaattttctcccattctgtaggttgcctgttcactctgatgatagtacatgtccttttttaaatttttaattcctaaaatctttgggccgttttagacccatagacatcagtccgtgggatcagagaaagtattggagcagatctcattggcaactaagagtatttgcttcccttgaatgtgaagaaatcactcagtgttttagaccaagcaagtgaacacagatcagccaggggatgttgagtaaggatgcaaattccacaaaaatgctgcctttcccaaatgcacatcctatgttagactagcctttgccagggacagcatgaaacccacactgagagttgagtcaccccggccagcctctcgggcctttggcaaagaacaaaatccttcttttttttttttttttttttttttgccaattggtccagtaccctccttctgtggcccccatctccagtaaccccccagagaggcccttctacctcccagactactcttcagggtctcatcagcttccagtgtcactcaggctagagacaacatcactgagaccaccctccaactgtccaggctgggcccccattccccagcacctgcggccacgcttgctgcaggcaggctgaccggccatctctatttgcccaggactaaggaggtcccctggatgcaggattctcagtgctagaaccaggtaggtcctgggcaaactggattgaactgattgctctaaatttgcagactctgctgttgttgtttaaatgtcggtaaaatatgtataatataaaatgtaccattttatatgtacagttcactaaatatattcacattgctgtgcagccgtcaccaccatccatctcgagaacttcatcctcccaaatggaaactctgtgctcactaaacgctaactccccatcccctctccccagcccttggcaccactgtcctgctttccatcactatgaattggactacgctaggaacctcttctaagtggaatcctacggtatttggcctttagtgtctggctaattcacttagcataatgtcctcaagattcatccatgttatggcatgtgccaggattgtcttccttttcaaggctgaataatattccactttatggataggccacattgtgtggatccattcatctgtggagggcactgggttggttccgcctattggtgattgtgaacgtggatgtacaaatccaggttctagcttttgccttcatttgtttggggtgtgtacctggagtggcattgccatgtcatatggtaattctgtttaactttccgggacccgccatgctgtttcccacacctttcttaaggcttttgttttattccacccagctccgagggtaggagtcagctcttctgactccccaggaaaatccccaggtccagagagaccccccagcaaaccactggcttgatgcattagacttttctatgatctgaatgtcctcggctgaccttccccttgcgtttttcctctctgggtccttcttccagggccgccttggccgtctcctccagcccccttgccacaccctcccctcaccacgtaaagcttggaagtaaggaaatctctgtcctcttccagacccatttaattaccatctttagtgacttaatcctgctcttgggggtttgccttctaccttgagaaacaacctggctctctctcttgctctctttctttaattggtgtttaaaatttttcaaaatgacttcattgagataaactttacataccatacagttcacctatttgaaatagcaattcagtggtttttagtgttttcagagttgtgcaaccatcatcacgtataattttagaacatttcaacacttcacccaggtgcagtggctcacatcttaacgagcattcttgtctgcccccaaaaaaacaaacatctgtagtacagatcacaagcacagctgtttcaaaggggccacgtgtggctgccgcccttcccttcttccaagcctggtggggacaccctgtcaccacagtgcttggacagcccccgaccaatgacatctcttccctttcaacaagttctgtgccctaattatggggttgctgggattacaggctgcacctctgagaattcagcaagtgcttttgttctcagagagacaccaggccacgctgggagcggggactggaaattggcacatcctatggtagagcctttgccagagacagcatgaaacccacactgagagttgagtcaccctggccagcttttcaggcttttaatgagggcttaaaactgggaggtccttgctgggttccatgttctgtgccttggcctggagagaaaggacttaagtgatggtgcacctcttactttgatttggccagcgtagttcatattttctgccatgctatttgttgtcgaatttcattctcactgtccttagaagagatgagaagaggccttatctcttttctgtagatgaggacacagaagttccaggtggcagtgacttgccacccaacgagtgaggagtggagctcagcttgaacctgggttctaacccagggctgtggattttccctttctgccacccctgggcccagctcgcctctgagcagacaggagcctgggagagtcttccagctctgggtgctgacaggcccgagtgtggtccagatgccataggctggctggccatgagcagttcctttacttctctgagacagtttccttgtaagacagactaaaatcacacctgccatctagagttgtgggaaaacatgatgaaacaatctatgtcaaacgtgtgcggctgcagccggggctgtgttgtcatccccgcctccagggggccccttggcagagcttgaagggaaaacaggaggaggcactccagtcccagctcagacctgctctcctgaactggcgcagccctctgtgccttcccgggcaaccgccgtcctcccgactaactccacacaggaccagcaaagacatatcttcattgcaaatctctaaaaagattaatttataaaaagcttcttagccatcagaaaccagaggacattatgctaagtgaaattagccactcacaaaggacaaatactgtgtgattctacttctgtgaggttcttagagtagtcatacagacagaaagtagaagggtgggtgccaggggctggaggagggggatggggagttagtgtttgatggatgcagtttctgtttagaacgataaaaagagctctggagatggatggtggttgcgcgacaacgtgaatgtacttaattgccaccgagctgtacacttaaaaatggttaagatgataacttctatgttgtatggattttatcacaactagaaaaaaattctagaaacaaattaagcctcttattcttgcacattttgctcagatttcttcagagtctgtgggaactcgtgtggatttggttcaattacagcagagtgacctcctaatcggggctcaagttagtgtttaaggtgcaaagtcacctttgcaaaatgtctgtgtggcccagggagcagccgagcatgggcccagcacagccagggctcccgcatcacggggacaaaccctgttctttggggcaggagatgaatttgttgatttgtgtgcagggatcccaacacactatgtattgtgagcatctaaatgtgagaacccatagtgcatcctagcgagatgctcacgctgtgagatgccctcagaaccaaagcccactgaggaagttgcaattcccagccccctcctcatgttctctcagagcgcaagcagggagaccggccggaatcaccatccctgttgaagctgcagctttctttctcttttcacccttacgcagaattgaatgcatgtgcacagcatgggcgtgcgaggcaacgccatccaggcggcctttgtccagtccatggaaactgacacaggccttactgtcagccctctttctagctgcctctgatgggtcttaaagagtaaattgttctctgacctttgaccagatctgtcagccacagaaaaacagccccttccttcctgctaccccacagagatgtgtccgccacagcctgcgtctcacagatagtcttagacacctggccacaccccaaattccccgacttcaaaggatcttttcacaccaaagatgcaattcctggggccaaagctcaaatcttaaaccatagggttcctagtttttcaaaaagatctattgtcaaattacacaacactccaaagagaagtgacagatgactgtactaaggcaatgggtgttcgcagacaatatctttcaggcaggtttgacccccatctcctcagaagggtttaggtagcacctagctccgttccaggctcagtgagggacaccattacaaaacaaatgaccagccaccctatcatcattaatttggtgctattctagatcaatagaatttaattagcaataaatttgagtttcttcaatgcttgaggcccaaggattgaaaagtaaactaatgaatgtggctatgaactttaatcccaattttgccattagataccttgctgactcccaagcaagactttctatcttgatttttcttatatatgaaatcaggagaaaagagatctgtacaagtgcataaaaaacgagagaggaaaaaaagaacattgagatgctcgctggcaaggtcacttaatttttctaccctgcaatgtgctctattataaacctaacagggagaaagtgagaacactgccttcatttgcataactacagggcatctcagggctcatttttctaatcagtttggctccaggcaccaggtaaatggcacagccgagcatgtcgcagaaatactaaataaccacttacaagtggagacagaggaaatagtgagaaggattcagatctcgagtcaagtaggagcagctggcaacctgtcccagtgacaaagtgctgcttacagaaggcgctctgcactaagccagtccctatgtaccatgtcacaactgagaaaccagccctctgagctccagctagcatgctggctggtaaaatatggagccagactgtcctgctggtacctcaggagtggctgtgaggcccatcaaggttaaacatgagcagaaaatacatctcaggactccacaatcactaagccaaagggaaaagtcaagctgggaactgcatcaggcaaagctgcctcccattttatttctagataagatagctgcaaagacaaaacctacatacctccctcacaattggcccacaaagaacttccgtgttgggcccccagacctgtaccctaaaacagttctgttgaatttcaccctggcaatgtaaattgacatctgatcttctcaggtgcgggacaaaggacaaaactcaaagtcatccctctgctcgcctgagacgaatgcatacctgattgcttcacgtgccttgtgtttatgttatcttctataaaaatgcagattcagtgagccagactaagacacaagtgacttttcctctaccctaaacaaacatgtaaattgtgtattcggttgatcaaagactgatcaaccaaaggctgatcaaagacccaaaagaatgcaatcgtttgtctcttatctacctacacctttaaaaaatttcttcctcttcccccagtatccactccttcccctttaaatattaaggccctcaaaatcatctttgaggaaaggcatagacctgcctcccaggtgtgcatccttaacgtcggcaaaataaactttctaaattgttgacacctgtctcagacacttttggtttacagtgggtttgggaaactgggagtgtgaagccaggtgagaaataattatcacatctctttgttaacagaagaaaacaaactctgtaaaatacttaaagaggtttattctgagccagtgtaagtgaccatgggccagggaacagtctcatgaggtcctgagaaagctcgccctaggtggtccagttactgtttggttttacacatttcagagagacaggagttacaagcaaagacataactcaatacacagaaggtataccttggttcagcctaaacaggtgggatatcttgaaggggcttggagggtgggggtgcttacaggtcttaggtagattcaaagatatttttattgccagttgattgaaagagttaagttttgcctaaagacttgaagtcagtagaaagaaatgcttaagacaaaggacagttgtggaggccaaggttcttgttatgtagatgaagcctccaggtagaagcctttagagaaaatagatggtaaatatctcttttcagaccttaaatttgccagactctcatttaatctctcctagatcttggaaaggcctagaaagggaaggcttgattgcattaatggaaatgctctacagatgtaagtatctcccacaagagatggttttgcagggccatttcaaaatatgtcaaagaaatatacttcagggtaaaatatttttattttcttcagggtttgctacctgttatgtgacgctataccagaggcaggaatttgctaccttactgccacaaagagtctgttttgtcagtcttatatctctatttcaatgttaatgccgatctgctgtgcctaaactccaacagcaagggggggtataacaaagcatgtctgaactccattcccatcacggctgggaattcagttttcaggcttctctggggtcctcttgatgaagagcgggcttgttcagtcagttggggggcttaggattttaccttgtgtttacacatcaataggaaacatcaagccactaaaaatattaggaaccttctacaaggtcactaagcactctgctagctccatacaccacactgcagctcgtccttgagcagcagaacttcattgtcagtcattttggttctggagtccagctgtccggcttcctcatcccagctcggctgtggatgagctttgtgagccgacacagctaattccctggctgtgcctctgtgtcctcctctataagctgtgggtgatgatggtgacatcacttcacaggttgtagtgacggttaactgttgcatgttaatagacccaaaggccttagaactgtttcataataaaacacccagtacctaggaaccaatttttgtttggctgttttgaaactttactaagaaatatttcaggcattctaaaacgtttaaagagtaatgtaacaacatgacactccccagcgtaagaaagaaaacatggccatcacagtcaaagcccccatatacctttcccaatcacagtccctccttctcacctagaggcaaccatcctcctgaatttgatagctgttaccctatgttttcctttatactcttactccatctaaatgaaactctaaacaatgagaaagcactggaagtatcttctagccaggaccaatatgcatgtctttcagaaggacttagatacagcaactagcctagcacaaagtattgttttgcgaccgcaccctcatttgtcaccttgctttctgtgtcttttcacctccctgagcagggaaagtgctaatatttctagatggaccacttaatgaactaagacattagtcagggccctgctaaccagtctgtgcctgtcagggactcgagccactctctgctgaccctgcctgctccccctcccttccagacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaaggctgtcccgcaagggccttgggggaaattaggcatgtcagatgtgcctgtctcacgtgctgttgctgtcctctaagtattgtctcaaattcaccctaagtacatgactcagcaacattgacagggagctactaggaagggaaaatcgaaaggcatgacaaatgggcacttggggacgcagccccagtggctggcagccagtgtctctggtgagcctgacactataaggctgtgtaaattgtaaattctggcgtgtgctgggacatgtgatgggggcactagcgtagcttgggtgcaacaagcacagatgtccccattgtctcccctggccacatgcatctccaaagagcctcttcactgccacccacaccccagggtgacagcctgggagaccactggtgactgaaccaggcaggtcctgaaagcattttccataactgaattctcctgcaggggcgtgaccggggcctcctggtggattctggtggtgtcaccttactgccctctctggaaagacaatctagggagcccagaggcccatcctgagcctcctctgagattttgtgcctgacctaaacaactagttttaataagactgttactgatgtgttgttcacttgttagtaactgatttttgtccaaatgcggaagccacttgtgtaggtcaactacagtgcgtaggatttgattttaagagtttctccctcccaacaggcttgaggatcagcaagttaagaccccagcaggttagggaggtcagtctggggtcatacggcatggcaggggtccctcggccagacccgtagaatcctgagataaggagtgtttctgacctttggtgtcatctagtcgagtcctctcattagtaaaggagcaaagtgaaacctgggggaggagaaggacttccctcaggttgcacagctgtttaggctatagaatattgatgtgtgaaaccattattgataatgcctagtagatcacatgtcaatgaacttgaaccccaaagatggtcgtgatgctttgccaaacccgcacactgccaacccctctactctccacctcagcccccacccacatctcccagagtattgcaattcagaacatttgggtcaaggtggagcaaggcactgacagtggccccacagggcatgtgtcactaatcactgtcccatggtctacgcacggcatctggctgctctgtctactgtgacttcttcctgtgtaatctcagtggggcccgtgtccacccacacatcgtgacccacataggggagaggttgcttttcttttgtgggctgagagtaggacaatgcaaatgaatgatctctagtagacagaaaagaacttggtctcttttttaaaatttcaaagagccagaagttctatgcctccttcaaagtaggcagaacaacgcagccaagatctactgtctgccatgctctgtgcaatgaagtctgcaggcctgaggaccatgtactgctgtccttcctcagagctctgcacaaacactgccaagtcctgaagacgcattcctttcctgccaacctctttccagataagcccttgaggtctcgggctgacctacacacacacacacacacacacacacacacacccccacacacacacacacgacagagaacatgccataaacatccttgaacccatgcaggaaagcccatcccatattctgaaaaaatgccaaattaggtttttctttctttttggaaatcagtcattacagtaaccgaaaccattgggttcagcgaaaatggaaagatttagctgaatgtagtcagtccaattaagttggatgcaactgagtgatttagttgcttgggtaacccagtgcttgcttgctttcttcattctctgggtggaaactaagatcaagacacatgtttggggataagttaaatgtctgagctattttgctcggtttatcctaagagaactttattatgggatgaggaggtgacccaagatgagaagtggagggggacagcgatgttttctaaacatcgtccagtgttgactggcttccttactttgcacagtgaacacaactaaccacattaattcagctttgtgaagtccctgctctctgtgggtctatgagtcagcagcaacattggcctaacctccgtcccagcctcctggctcaccacatgtgtacagtgctgtttgcagttgtactcattatccatccatctctctgccatccccaagcatcgctgggtgtaaaacgcaaactctccaccgacactgccatgcgtggtcatgtcttgatgccttcaggggctcagtagctatcaaagaggcctggagggcctgggcaggcttgacgatgcctgaccgagttcaagacccacaccctgtagcaataccaagtgctattacataatcaatggacgatttatacttttattttttatgattatttgtttctatattgctgttagaaaaagtgaaataaaaatacttcaaaagaagatatccatataaaaataaaaggagagaaaaatgcttgtccttttagcttgtccctgttatagcacacacaggatggatggatggatggatggatggatggatggatggacggatggacagatggatggatgaacaacagatggaaggaaggagggaaggaagatttttgcaaccagatggaggcaggggagggagaaaaagattcacccaaatcactgttcttccttgtatcttccccttgaggaagctgcttggtggttgttactatccggagttccacaggtaagctgaggtagaattaaaaaatgcaggcttgattcctgagtttgacagaagccagagccaaagtaaacccactctcctccagtggccttttccaaaggtgatcatattatgctctgagatcttatgcctgaaattttttcagccacttaaagcacctcttaaacctcaaaatcgagcatgcatgaaagtcacctgggctgctgttacaaatgcatattcccaggagaagtactgggttccagccccagggattctggctgtgtcgctccgggcttcacagacgccccaggtgatggacacaggtggtctaaagacactttgagaaacctttggaagacaaagcaggtgagggaaggccctgtttttcactgatcccatctctgtgttctcagcaaagacctaagtcagagggtcaaagtgggtgtcactaatcccattttgtggaaggaaccgctgaacaacaattgcagatctctgtccatcccttgagatgatatcccctgtctacaccaagaggagtgcctgtgatgtctctttccacaaagagcacacagtataagctgcttgggggagcgtgggcgtgaggtgggtagggagcaggttactggggaatctgccattgccctgaccatgtggttcaaagggcattcaagaagccagggcctttccaccctgccggtgggaccacacatgcacttttgcagcccacagggaaatgaatgtgacctccaaacaaatccaaccattctaagtgccacagagaagataaaatgtgagacggcgccaggtgtggagggggctgcttttcccaagtggtcaaagcttcctggagaagagctcttccagtggcagtggcaattgtgcagaggtcagggaaaagagtgctctaggaaggaaaagataatcccagaccccgaggtctgcagagggaggccagcgcagcaggcagctgcagaggctggcgggggctctccagcctggtagggcagagtcaggagctgggattgtattcgagtggcgcaggaggttttatagggtttttgaatgatacgtgatctgatttaaactttcataagatcgaagtagaaagtactgtgtagagagtaagtggggaggaggggcaaaggggagcccagagggcaattaggggcagggacagaggacgtgagtgtgatctagatggggcagcagctgcggaggggatgaggagtgatctgatgggtatttgcttagggacatctttggggacatactttggggacaatttggatgtggagtgtgaaggaaatggaggacctagagatggccctcctgctggcagttggatgaagaggcagaggggtggcagcagtggtgctggttcacggtatatttaaatgtcaatttaatacaagtggggagtgcgttggacacagggcctggaattcagggaaaaggcccatgttggagacacaaatttgggagtctggattcagatgtttagataatattaaaagtatcataccggccgggcacagtggctcacgcctgtaatcccagcactttgggaggcctaggtgggtggatcatgaggtcaggaaatcaagaccatcctggctaacgtggtgaaacccatctctactaaaaatacaaaaattagccaggcgtggtggcaggtgcttagtagtcccagctacttgggtggctgaggcaagaaaatcacttgaacctgggaggcggaggttgcagtgagctgagatcgcaccactgcactccagcctgggcaacagagcgagacagtcaaaaaaaaaaaaaaaaagaaaaagaaaaaaaaaaacctctacctgggtaaactcaggaaaggagtgtaggagagaagagggctgcgcacggcagcctcgggactccagtgtatgtttattcatttatttactttcactggatattgacaaattctaattgtatatatttatgatgtacaaaatgttgctatatgtacaatgtggaatgattgaaacaagctaactaacatatccatcacctcaaatgctcattatttattcctcctgcctaactgaaaccctgaacccttggaccagcacatccccacgccctgctcccagcctcaagtcccctattctgctctctgcctctgtgagttagcttgctttcgagtctatgtggaagagtgaacatgcagtctgggtaccctgacatttaaatatctgacagagaaagaggcatggtcaaagggtacttaggaaaaaaaggtagctgtagaccaagctactcgggaggctaaggtggcaggatcacctgagcccaggaggttaaggctgcagtgagctgagattgctccaccgcacttccagcctggacaacagaaggagaccttgtctcaaaaaacaaacaaaaagaaaactaaaaacaaagcaaaacaaaaaatccagctagtaaggtagaaggaaaagcagctggacagggcatccggcagccttcaggaagaaactgtttgaaggagagagtcgtctacaccagcgctgctaagacatcaaggaagaagaggacagagaggtggatgctggcttcagcaagagggagcccctcctccaccgtgatggcagtgatgggggagatggccatctcagctcagtggtaaggccagggttgaggaggaggcaggagataaaggccaccttgctgcatccatgtgccataaagggagcagagacaaggagctggacaaggacatagataaggtccagaaagtggcttgtggttttctcataacgtcgtataatataatgaaggtgttgtcatgtgagataggtcagtgcctgctgaaagagagacgatgtgcacaggaaagagggcagccacagcacttgcagctctggaggaggggagagaacccccggcagagtgcgagtggagacccggctcagagaacaggaccaggcacttcctccttgaggcaagaaggcagggtgcagctaaaggggtgcccgttactgtcagggacattggaaccagggcgactgcggctcaaacaggctgggggaaatgaggctgagacctgctgggctgcatccccaggaagttaggcattcttagccacaggatgagatcggaggtcggcacaagacacaggtcacaaagcccccgtagataaaacaggatgtggtgaagaagccagccaagacccaccaaaaccaagaaggcaatgaaagtgacctctggtcgacctcactgcttattatttgctaattataatgcattagctgctaaaagacacgcctaccagccccgtgacagtttacaaatgccacaggcaaaggccagaagttaccctacatggtctaaaaagggcaggaaccctctgttccattccaggatttccccacccctttcccagaaaatccatgaataatctatcccttgtttagcatatgatcaagaaataactagaaatatgcccattcaagcagcccccgcctgtggagcagccattcttttctttctttcttcataaatgtgctttcactttactctgtggattcaccccaaattctctcttgtgcgagatccaagaaccctcccttggggtctggatcaggaccccttttcaataacaaatcagtggcacagaggaagggagcccgtgaggtcgctcctatttgtctgtgaaatagggaagtgagtcggaggaggtgggatattggaggtttgcaaagacatttttcaaataattacctgagaacgggtgagttaattaggaaagcgaagatggaccgtctggtctggtggcgggattgcccatttgaggctgtggtcataaatgtggggtgtgtccagcaagcctggtggagtgattgattttttcagcaatatttagaagttccaatacagacaaagaccaggcagacagtgggagataggatttgccaagcaggtgacagagaacggaaacagcaaaagtgaatgttttttgcaaaggagcaatgttagtgttagactgagtcaggagggaaggacgacgagaggaaacgggccgggagagccaacggagctggaggtaggtgcatggccagtggtctccacgtgacctgggggttgctagggtgagtccaggagagatcaagactgaacaggtggagaccagagtatggggagagggggagcgacagttcagatgtggtgtggcttcttcattcagagactcggcctgctgccacattagctgctggtgccctgctgagcgtggccaggtgccctgacccatggctggtgacgtcaaactgtggcttccttggcctcccagagatctcgtctctcttatgtttggaaagggtgtaaactccgtttacacacacccttttgacttctcaacaagaccagaagcacttcccactggctccttctccatgtctaagcctgaagtctgtggcctagacgacttggggaaggaggcaggcagaagaggaggaagttggcagtgaccagagcagacaggcctgtggtaaccagaccctatctgatgggagctgctcagcagattgaaggtttcagacagggctgtttttaagtaccccgttcacaggctcaaagcaaacagcaagggagacagctaggcggtctccaaaggaaattgattaaggaagagaaacctcagatgcgttggaacatttatcatttctttgaggatacatgcttgacgtgatggatattaattaccctgatttgatcactagacacggaatgcacagaaacatcactatataccccataaatatgtacaattattatacatcaattttttaaaaattaaaagggaaaaaaggtgttttagctaggcatggtggctcatgcctgtaatcccagaactttgggaggctgacatggaaggattgcttgagcccagcagttcaagaccagcctgggtaacacagagagacctcatctctttttgtttgtttttttgagacagagtctggctctgttgcccaggctggagtgcagtggtaggatctcagctcactgcaacctctgcctcatgggttcaagcaatcctcctgcgtcagcctcctgagtagctgggactacaggtgtgcactgccacagctggctaatttttgtatttttgtagggatggagtttcaccatgttggccagcttggtctgaaactcttgacctcaagtgatctgcctgcctcggcctcccaaagtgctgggattacaggaatgagccaccatgccccacccttgtctattttttattttttaatcataaaaaaatgaaggtgtttgcaggctgtaagaatccgtcatccaccactcgctgccaggaacattcccgcctgcaagatggttacgaggaaagtgaggcttggtgcagctttgcaggacagtagggtatttcctgagccatttgttaaacagaaagccctgcactgctcattctcttactcccttctccatgcaaagactactgaagctaaggggcatttgctaaagaacagccagagtcccaagggaaacctgagttagagatgacaagccacactccttggctcgctcccggagactcacccacccaggtgggcctggcctaggcctggagggagggctttcagggagctcacctctgctcccccacccactgcactctcggcctcatctgggaggggtacctgggcctggagcaggacaaatgcgtctccaacctgtcgcctctgcaccagtctgggtttggtcaataaagtggaagccccctcagtcttccatgaaggaaaggacctgattcaggaactaagggttcacagaacccttagaagggcggggacaggcagtgtccgggaagaggctgtgagaagaggtgactcacagagctcatccccaaagtcgcccggatttcacccagctcagcagggggccttttttgcaccgctgtagctggaacggctatggaaagctggtgattctcaagaggtctgtccacacctctgcctgctgccaccaccgggaataaagcttcacttgctattgtgcactgaattatgacccccaaaaattcacatgttgaaatcctgatctccagcatctaagaatgggactatgtaagaggtaactagagtaaaatgaggtcatatgggtgggtcataatccaatctgactgacgtctgcataagaagaggagattaagacacagacactcacagagggacggccacatggagacacagggagaagacaccacctacaagctgaggagagaggcctgagaaggaaccaaccctgccagtactttgatcttggacctccagcctctaggactgtgagaaaacaaatgtctgttatttaagccacgcagtctatggtatcttgttatggcagtcacacccaacggggatatttgtttttcctctttgacccctcttcctctcctctctaccccacccccagcttttaaagcccccacctggaagtgactcatatcatttctgctcacatttccttggtctaaacaagtcagatggccaaacctgacatccaaagtgtggagaagtaccagcttagcctgggcccccaagtagaggagaactgcactatttgcagatgggatcttagtgattacctctcattcttcctcaccccatccagagtggacctgcaaaaccccatcagcctgcagccctaaggacaccctgaccagcagactctgacttgcagtgtagacacggggcagtaccaagatgatgcagcatggagtgaaaggaagagaagaggccaggtgcagtggctcccgcctgtaatcccagcaatttgggaggccgaggtgggaggatcacttgagcccaggagttctagaccagcctgggcaacatggtgagaccctatctctacaaaaagtagaaaaaatagctacccacatgcccagctactcaggaggctgagatgagaggatcacctgaacctggggaggtcgaggctgcagtgagccacaatcacgccactgcacttcagcctgggccacagaatgaaaccttgtcacatgcacgcaaaaagacgagaacttctattaatgttttaaacctcttcttttctgctttcaatgtgctctaaatatgtataatatatgggtacagacatgtatattatataaatctgttggggaatgcacaaacattttcacagatggagggcaagtcagacaagagtgaggcccggcctttgcctgcgccac

SEQ ID NO: 527 - DNA, 1561 bp, Homo sapiens
cagcgccgagaattcaccggagctcggggaggcgaggcgggagccctgagctgaggccgggcagcgcggacccgcgcaggaggaggcggcggggacaccggcgagtccccagcagggcccctgggctcccggaagggtctccagccacctgcccttcccgagaagagagagctctgggccttcttcctgccagtctggtcttcgagtgcgttcaggacagatagaccttggcacaggctgccccgagattcctgcgacgctgtctgttcctgccttctgtggagcatggcacccacaggcttccaggacggatcatagacccgagcctccaggagggcgccctgtgcggctcactgcgcggtccctctcagctcccctgccacccagcctctgaggccggctcctgtcccggaaatgccctcgggcacctggatgaggccatcccagagcgggacccaactgtgccacccaccaagcctccccctgcgccccccgtgccctcgcatgtccggctgccagggcagactgtagaatgtctgtgccccagatccacgtggaagaagtgggtgcagaagagggggcgggagcagccgcaccacccgatgaccacctccggagcctgaaggccctcaccgagaaactgaggctggagacccgcaggccctcctacctggaatggcaggccaggctggaggagcagacctggcccttcccgaggccggctgcggagccacaggcgagcttggaggagggggagcgtggggggcaggagcccttgctccccctgagagaggctgggcagcaccccccttctgccaggagtgccagccaaggtgccagacccctgtccactggcaagctggaaggctttcagagcatcgatgaagctatagcctggctcaggaaggaactgacggagatgcggctgcaggaccagcaactggccagacagctcatgcgcctgcgtggcgacatcaacaagctgaaaatcgaacacacctgccgcctccacaggaggatgctcaacgatgccacctacgagctggaggagcgggatgagctggccgacctcttctgtgactcccctcttgcctcctccttcagcctctccacaccactcaagcttattggcgtgaccaagatgaacatcaactctcggaggttctctctctgctgaggagccctcagactgggcggaggggctggagcggagggcttgggctggaggggtgtcagaggaagctgaggccaagttactccagtgggtctcccggaggcaggggtccctgggactggcgactcaagggccccaggacctattcagtggtgctctcccacccaggggccctgggtgtggatgccagtgtctctgtgactggctcttgcttactacccaaagagctctgcagaagggccgctccaaccaagatgttaaaggagacctgggttcccaccataatccatccctccacggtcacgttcctgtttcctggaatcactggtgctatgaactgggattcccaaagggaggccccccaacaaagctgtcatttttgcagaa

SEQ ID NO: 528 - protein, 246 aa, Homo sapiens
GHPRAGPNCATHQASPCAPRALACPAARADCRMSVPQIHVEEVGAEEGAGAAAPPDDHLRSLKALTEKLRLETRRPSYLEWQARLEEQTWPFPRPAAEPQASLEEGERGGQEPLLPLREAGQHPPSARSASQGARPLSTGKLEGFQSIDEAIAWLRKELTEMRLQDQQLARQLMRLRGDINKLKIEHTCRLHRRMLNDATYELEERDELADLFCDSPLASSFSLSTPLKLIGVTKMNINSRRFSLC

SEQ ID NO: 529 - DNA, 211257 bp, Mus musculus
  misc_feature (1)...(211257): n = A,T,C or G
gtgaactgtgaactgcctgctctgcacagtgctgtgtgcaaccgttagtggcagctgacttcagtgtgcacaggaagcgctgggttaggctcccaggaaataatatggctggtgattggcggagaagatgcctctgaggtctatgcaccttaattacattccaaggactcgactgtgctgtgaagctgttattttaatatgcccaaactgatctctctaacaactatcagggagaaagtgaatagctttgcatcagccatataccagggccataaagcaatgtgaaccagcaaagcccagaccctaccactcttagaagacaaatatttttcaaaacaatattagaagtatgatttttctgtttaccatgcatattaaaatctacattgtgctttagaagtcataaaacactgagacatgttagtatggaagggactggtcttgacttactcctgtatgctggcattttcaactgttccatttacaaggatctcactgaatcctttggctgaaacacagatcttaatccataaggtagcttaattttaaatgcagtttatactctcaagattatctgtttttcaatgtatgtaatattggatatgtgggtgcctgtgagtttgcagcatgtgtgcacatgtgccacacacatgtgcatgtagaggctagatgatgacataggtatgttcttctattggtttccacattgccatttgagacagactctgtcagagaacctgccattcactgattgactagactggctggccattgtgttccaaggatttcctgtcccccctcctcagcactggtgttaccgatgagtgcaaccatgcttgcttgcttctttatataaatgctgaccatttgaactcagagccttgtgcttggagggcaggtgctttcctaactaaactatctcccctactccaaggcgatctgattttgatagtcattaggaattacttgtgttaatggggagagatttcatgaagtcaggaaatttccatcctacaacgtgtgcactcccaagtgcagaagtcagctgcagtgcttcagtgtggtgattattaaaagtatccccaacatgaaatgctctagctgaaagggatgatgatgaaatgcatttcttggggtgatgtggtgagcccgggagctcgggtgccctgggggctgcagcagagcagggagctttaagagcaccagcctgccctggtgcaagagctggggctcatggatatgaccagcagtcctgaggagggggatggctgcgcgaactgatgaagggtgatgacagggaagacacttcatctttctcttgtgtcactgacatgaagcacagagcctggcagagaaccagcaacccataagcttcccagtttgcttggctagaggatgggttcctccgctgcgccatgcatgccagggccgatctgctccccaccccccgtgtcaaccttcctcatccttcctgcacacgtctgcctcttcagtttctgaactaatgaactcatcagccctgctccagtccggagcaatgtctcggcctccatcagacagaaacaaatagcctggccacacagctgcctccattgcaagtccctgagcagctgagctcttgtccctcagggcaagactgagttcacggtgactggatcatcgacgggaagggcttggtgagtcctgacaggaggggcgggcagcacactggcctgctggtgactgtcatacagagaaacctgctgccttctctggagctctataccagattgagcccagaagaaaacaatttgattattttttaaaatactaatttaaaatttttcccttttatttttagttgactaaaaccccccacaacctagcacatggcagcagccgttgtcctgttgtcatttatctgtctttgtcttttccttaccgagcacggctcttgtagcctgttctctcatccctattcctttcacttcctgaggccatagaaaaaacacatatgataatcctttgaaatgattatataaccttctatcttagaacgtcataacttagttcttgttgctgttgttgttaacctttacccaattgctgtgtccccaaactgtaaaaacagaatggccaaagcagacaggactccatgggcctgcttagctagagactgttcactctccttccctagagtccctgctctacatctgagtgacataaaactgtccttatgatgtggaggggactcaaggcaggatctggtccgtattctggagagaaccctccactaaagatgactggtccaatattagatcttgggagatacatgggaaccctacttacttccagcagatgccttgaatgtatgatccagagaaggagcggcaaagagttagggtaagagtttgggagactattgttctgggaagtcagtagacttttcttttcatttcaggcccagtgagaatgttcgtcatcaggggtcattgcttagaagcagtactggttagtttgaactgccagctcaacacagcctagacttacttgagaagggatgctcgattgaggaaggaatctcctggataagattgtcacaagggcatgtctatgaggcttgttaatggaagtgggaatctcctggataggattgtcatgtgtgcatgtctacgtgggcttgtcttgattgttaatggaagtaggaagacctagcccattgtgagcagcaccatattatgggctaggggcccttaaccatgtatcagtgaagaaagatactaaccagcaaacagattaattctggacaagactatagataggcactggccaggtccatacctggaattccaagagaatgatagtgcacacattaatcaggtgttttatagaggcaaaccccacaaggctgtggggtttcctgcctttgtccaatgggggcaagcatacatcctaacatacttcctgtctacatacgttctgcctacatgtgatcaagcacaccctgtgtagttggggcaaccaaccttgtttacagcagtgagaacctgtggcttgctgctttgtatgaacagcagcccccagcattccaggaagttatctgtccttgggcaagtggggatcacaggttagaggcatttttattttatagatctcattgtaacttaaacttaaaacataactttagccctcacaattgcagatatgacgtgactagctgtctcaagaacttgccactaagactggcctttagtgaacctggaattataagccaaatcaacccccatccacagttgcttttatcagactattttgtcagggtgagggttttgtcccaataaaacagtttctaccacttaccactctgaagggctgggaacataaagaaagggatttctcacttggtgtggccatgttgggaagcagagggatggtattctaaaccatgtgtttcagaacactgactagtgcttgaagaaggaacaaaatggggccaaacgtgttcagtctggccagcttggtaaacaatggtgtgttcattatttcaggtctggttctttgaagaccccatggttctaaggatggatattgctcaatctactcaatcagctctccacactagacaactgctcctgagcatgaggctatcttaggtggctcaccatggggtgattgttaccacttggtggtgaaagtcttgtcccacaaggggtgatctgcccacaagaacaagtgctcctgggatcttgaaatcccagttttgaagaagggcaagagaagttaggcaaagttgaggcaaatcagccttacattgctagttcgaggcagtcactacataatctgaatgcctattgtagggctgagcaggaatctgatttaaaggcaagtagcctgcagaagagaagacacaaaatggaggcatagatgctacctcatgtcctgtgtcagctttcagtcctcctttcctcagtgtctgtgggctgaagtgagcttagtactttgtagcaagttcttgtcgcaggcatagttgggtccaaaagctcttcccacactgtggtgactctgagttccagtggctgagaaggacttctgggacagcagccattgttcttagactctcttactgggcaatatcccattgactagtcagtcaggaggagcctgggctcaggagaagcctaaggattggggtctgctctccccagccttccatttccctgccacctgccaccctctttatccatatgatacaggttttagccatcataatttgaacacaagtcagaccgcgtagggctgggtggttatgtatggatctgaattattgcaggcacgctattaggcagtttgctgtcctttgttcaagaaagaaaactgccataacatttagagcatcttagactttcacagaacaaaatccagtggcatcagtgtcttctgaagccttgaacatgtcccccgagcccctttcaaaatgcctggcagagttaactctgacccttgcttacattaacctttgtgttcctcaaccgtgaggctttcagaatagatgaaaatccacccccatcctcatatacccttgacagaggacacagcatcaccatgggctgcacacatggctttggaaaggcccccactgagcagggagcaggggcagggacatgtgctcagccagccagattggaggcctctaccctgctgtgactgggccacagatgtctctgcctgtcacccctcctgtccttccctgcaggaatcaatagtgaagactcagttaatacagtgttgttctgtttggtgaactagctggtttctgttgtgaatcacattactgattttgaagtataaacttacaaatgccaccatttacaaacacctctgccacccccaaactgttaagcaatgtaatatgtttaaaggctgtctcattctgtggtctccaacaaccttagatatgttgccgtagtggagtttcaatgggcaatgttcttatggcttccaggaaaaatcctttattgctgggttttgtttgtttattgagacagggtcttgtatagcccaggctagcctcagattctccatatagctgaagttgacattgaactcccgatccttctgcctctaccttccatgtgctgtcatgtctgggttttaatggactcacattcctcacatacccctcctactactctctccttactctaaagctgtatactgtattgtttcttttctgaaattttgctgtttgaggttctagtgacctgggatcaactataatccaaaacaataaaagaagaaattctagaagtcataaacttaaacagttttaagctgtgtgttgttctgagggacatgatgaaatattgcaccattccactctgtcttgcctaggatatagattgtctctttgtctgccttcccatacattagctgcttggcagccatcttggctaccaaattgatgtttgcagtactgaggtacctgtgttaaagtaatccttatttcacttaatcatggcctcagaacttatgagtaatgattcaaaggaggcaccaggaaaagagaaaaactcaaaagggaaaacaaaacaatagccttccccctcaaaaacccacaagcaaacaaggaaggacaggttaactgtgggactatgcagcaaggctgtcagtcagatagagaaagacagtgtacaaggttggtactgcctgaagtcggaggcatcaacctggattccatccaccacagacgagtgggtcctaactactgcctggtacttggtcaatcattgctgcaactgattggtacacgtgaggaggaaaacaacatctttttttggtcccatctttctgtttcgttcactcagggcaggaatggcaggtcattttactccagagtctgtctctgaataataaccaactctctgagctcttatactgagaatggaatttgaggtcatgtttagggatgagagaatgctgagtgattagtaatgtctgccatgagcacagacgtccaggaggaggactgagggaggaggagggggaggaggaggacactgtctcctgactcaaatcttgtctttttttttttttaatggaaatctcctacacagattccaacgctagtcttacagttgtacactatttgcagtatgacaggctttccatacctaaattaattctcaaagccacccatgaggtagttgaaacgaggaaacaaagtctcacataggttagttatatatcaagatcatatagccaggacatgggagagggtcaaggtcagatgatctccttccagagcccagcctgtcatccctagcctgtcctagctcttgcttactaatgttgtatagattgctacagggctgacataagacccaatgatctgtattccagaagaaaatgcaaaatcaattgatagaaatgattatgtttgggcctcaggctctggaatacaggagaaaagaggggcctttcaccagagaggacagcacagacttcctccttcctgtccagtgggcaacattttcatggctacttctgtcagctttgaatcttcccagaggcaaggagagaaggagctaggaaggggaccccaacatatgagggtgagacattagctccctgctgtctaggccaccccactggggcactatttatgagtggttattttaaatgttcactgtcattatgagggaaacataatctttgtatttttttaaagtatattataggactgtccatgtgtgcttaggttttgagtgcttgccttgtgcgcacaaggacctgagcacacttagacaagccaggcatgggagtgtgcttgccctttcagtgctggagagtcaggtacagtggctccctgggctgaccagccaacctaacctaattggtgacttccaggccagtgaaagatgatgtctcaaagaacatggcaagtggcacttgaggaatgacagctgaggttgtcctctggtctccacatgtactcacacatacatgaacacagacagatataatccatttgctcgtatgttacaacaatagttgagtcacaacaggctgtagttgatggtgtcccactaaggtttcattgcaaagtttgtgatgtcttggccatcttagtttgtgtaaacatatagaaaagtgataatccatttcttagactgtcacccattaagtaatagagcagtatgtgtgtgtttgtgagtgtatgtatgtctatgcactggatcaaataagttacatctttcatattgtcttgaagagacttttaaatgccatttgcttcatttattagcttaacaaatacttactgaacacctttgtgtcattacatgccaggataataggatatggccactgccctcctaaccagtccctgggagatttggtctttgtccatgtagtaacaggaatgtttagtgcaatccttgtggtcacggtagaggtatttgtagtagagggaggagagactttggagccattccttacagatgctcaaaggccaccaaaagcattgactctagcctcagcataatggggagccagcggagatggggaaaatatagttaatcttgactgtcaatttgattgcagactttcctagaaatttcataaagcatgcctctgggcatgtccacaagggtgattccattagcaaaagaggtggggaaccttccttgagtgtgagtagcattgcaggggccctggtgaaataaaggaggagatgggaaagagcccacagacacaggtcctctctgcttcccagcaggcgctctgttccatcctgcctccccactatgacagacctagactctgagactgagccaagtgaacagttcttccttgagactgattgctcagatggtgttgtagcagcagcaattttgatggatacaggcaggtacttgggagtttatgtcatgaaatttagactttttttttccaggttgaaagagagctgtggttacattggtgtattagttagggttctctagagtcatagaacttatgagcagtctctatatagtaagggaatttgttgatgacttacagtctgtagtccaactcccaacaacggtcagcagcagctgtaaatggaagttcaaggatctagcagttgctcagtcccacaaggcaagcagtcaaaaaagagacaacaaatcttccttcttccaattatgtaggtcttcagcagaaggtgtggcccaggttaaaggtgtgtgtcaccacacctggatctgagacttgctttgtcccagatgaccttgaattcagagatctcccagtcttaatcttctgggattcatagccatagctcaagatctcctcactaagatccaggtcagaaacttgtatctcccagcctccagattaggatcacaagtgagccttccaattctgcattgtagttcattacagatatagtcaagttgacaaccaagaatagccactacaatccaccccttgtcaacttgacacaaatatctcatgtccacatggaacaataacaaggtcatgaatacgcctaacatgatataatcattccctgtacaatcgcaaatgcatttgtaaatttacaatgaggcaatggctcttgggaacattcttttagtatctcaacttaaataccaattgatgttaaagaaattgggaagaaagacaaatatgttcttaacaaaataaaacacgtcacccaggcaatgcagcagagggtgctgagaaacccacagtttagataggaacttaagacctgctgtgacatggtcccaccacagtctagtgtcatatctcatcatacctggaccagatggttctgtactcagatcctttggcactcacccagattgtatccttgttgccctttgccaggctttagtagacctagtgtgactcttaagtcacaaggatgctgaatgtcatgatttagctgttcttcctagatatttttttttgtgcaaatacttatattcataagttacgtctttcatattgtcttgaagggacattatcaaatgtgctcagatggagcattttctggagttctctgtttgggggtcttgagaacaagtgtatgctggaagccctaacctcgaggctcattccatctctgccagccccttctttacactggtggtgaggcttcggggctgggggaatgttgagaagccctggatatccatggagtcctcaaggcagttgtgatactgcttgaattttggtggatgccatagtctgctgctgcacttcttactgaaataccaacttcatcagtatggtgattgttaggcagcatcaggaggaggtactcttactcagcctggattgtagggattcccttgttctctgggtgtggtcagcttcagtagagaccctctgaccaagggtccagcatttttcagttgtccagtctgttagaacttggatcctgacacattcatttacaaaacgacatgtcctatcattgagattgaaactcatgtaaagggctagggagatggctcagtaaagtgtgaacatgggggcctgactttgattcctaaaacccaagtaaaaagctgattgatatggcacatgcttctaatttctgtgcgggggggggggggggcagagatgggtgcaatctcttaggctccttgaccagccagcctattgagctgtaggccaatgagagaccctgcctcaaacaaataaaccacaataacaaaacccccaaaccaacaaaagtcaatcacacctgaggaaggacatccaaggctaacttctgacctctgaatgtgcatgcacacatatgtatgtctacttcctcaaccccacatgttcccatgcatgtgtgtgcacaagcacatgtatacaccccaatttacaaaaaacaggtacctgaaacttaagaggataagctttggtgtgttcctaactcctgaagagaaacaggctcactggcacatttaatgacatgtgttaggatgcatgtcaaactttacacttaaactcacatctctttctttctttttccagccaaacaccatgtcagtggcaacagaacggttgaacctttcccagagggaacacagatggctgtatttggtaagatatcaactcagaaagaaaacccaaatactgtgcaaagcttcctgccaactttcttagctgtagtaagtgtcctcggggcttcaaaatctgggctcttctagatatttacaagtcgttacagccaagaaaactcttgagttcttagtaatttctgggcccaggaatacttactttgtagaatccagtatgttttaactgtctaactttgacagcccagatagcacactgtaagtttgctatttcctttgtccatactcattaatttaaggtttgagttttctttcttttccacacagatgtataactttgtcaagttgtttggagttactattaacctcaccttcaccacacacacacacacacacacacacacacacacacacacacacacacacacacacactcgtaattggatggtctctttattctccatgaattgaacacatacatgcattggtagaaaacattaattaaaaatatttcaagcagggctgagtccagtccttagttacacttctaaaaaatatggttgtgaagttaagctgaattttttggctgattccaaaccatgtggtgaagaagtcttctttgcccgggttttccacctccatagtttctgtctcccacactgctttccaaatgtccctgcttctggctggcagctctttgcctttccctctgtccctccctccatccctctgtccctccctccatccctctgtccctccctccatccctctgtccctccctctctccctgcctcctttcctccttcctttcttcatggtggctcccgccttttcttccttgcttctgcctctggccttttccctccagcaaagctctgaggtcctctcagacgtggtacctctgaccaccagaattttaactgcaggtccagctttcacccgtggataagctctggatctctgacgatctagtaacttttatgtcacctgacttgacacctcctccagcagccatccagagggatgtgttcttcttggtagtctctgcaagggcagtaggctgcttgtaggcactgaaatgtacttgagttggaaaaccacctcatgtcagctcagtccctgaacaagttctttcaggagagaatgttctcttagtcccagtcgtagaatcagaactaaaccagaggaggggcagttgggaaattatgtaacaggtatccagtgtttcctaacagtcaatcttgctccaacgggctatcaccatttaagatgtacccacctgtggttaaaaatcactgtgcttagaaatgtaaacgggtacttcagtttcagaaaagactttatgtaacaatgaacactctgtatcttagagtctagaatgttcactgggatttctgatttagtcatattaacctttgtaccctggcagtttcattaccgtgaaatatcctatttattgatgtgcatcatccttgtgattatttttgtttgttttaagtctctcaaatttgacaaccatgacaggctaggaactacattctgtattgttacagtttaaatctggaatgtccccagaagctcagctggtggcactgtggggagagggggaagagtgaaaggaagttaagtcattgggagtgtgcccttgaagccactattgggatcttagcctgtcctcccccatatctgcttaccagccaccatgagatcatcaactttgctgtactatggccaccatgccatgatcctctgccttaccacaggtttcagatgatgagctgaaccatcatggactcaacccatgagcactaacttttttctcaggcatctttgacagagtgatgactaatatcttgttgggagtgacaagtgacacaggtctgtctcagcaggctgctgtcccctgcaacgtagtaggaactaacattcactgacctcagagttgaaaacatcagggcatgtgactctgtgctgagattccttttcttttccattccttattggttttcagaggtttgctacaaccctaccagagtctgacctagggcaatacaccgccctctccatgctttagctttctgttgaatggatctggggcctctctaggtctgggccctttgttctacctcctctctactcaagacctcagactcacctgtcaccgggagcctgggaagtgcactgcaattggccaactggctgataggtgtggtgtgaaaaaaaaaatgactccaagtgtggtagccatgcctaggatcctggcacttgcatcagggtcagaggcagcagggctgctatacatctgagtgctcatttgaaaaaaacaaaccactgaacaaacaaaaggagacagaccgcttgcagaattcaagttcacaatatctaaagggcaaaattatacagaacccaaaatagcatatgcctgacatctaaaaattctgtctttagaagtgcagcttggctctctctgctgcttaaatgaagttcccaatttggctaagtgtatgcagtcattgcacaatgggggttccagagctttctgctcctttcctgtcacttgtccacctgtctatgggagaggagagaacggttggcgtggggagggctcctgtcatctgggtcacctatagctacacggaaaaggccagattgagacagcgcttgactttcaccctgccagcattcaaggggctggtgggctagctaggcagttggctcagagaggtcatgtgacttactcagggtggccgggcctttggagcagggtttgagccagagactacttggtttggaactgacatcctttttctgatgtcacctttctctgcactgcttgaaggagcctcactagggcccgatagatttaaaaaatgcctttcagccggatccacatacaaaagcatgatttccagccaagccaatttagtaaattgatttgtaaactcctgtgtgttcccagagtgctctgaaggacccttgagatgcagcttttgctgggaaaatgcaaagactcctccagctctcccctaccccccttcgattttagtagcaaataatgcagacagcactggctacatctgcctgcctgtcagttacccagagcaacagtggtactttttacctgtccaaactcctccttcagccttggaggtctcaatacattatgccaaaacagtgtcaccaactgtaacttcatcaagtgactgaagagtccaatgtgctgagcggaatgcctgcatggcagctttatggtttgatccagtctgctggtgactgcggagctgcagttagcatttagatcggctttgagggatcgaggccacaccggtgtgagaaaatacagaggtgtgttgtgcccagcaatcagagacggctccttaaacgaagtccctggcattcagtctcagcaagttattttaaactcaagctattttttattctgctttttgttgtctgtcagtaactatcttttccccaggtcttctcccgctcccttcgtggactgggctgatgttatggggaggccacagcctcaggtccctgttgcccctcaggcttgctgctaatgctcactcacaggttagaggcagctgacactctgcaaaagtgaaagcgaacatttcgcagttacgcaatgcctttgtctgtgctgtctgagagcgccctgtggccaccctccctctaatctgcacagtgtcctgtgaagtgggcagagaaacagaagcatctggagatgaaagactcagccaagctccgagcctactttctcccttctgagaacaactttggccagatctccatgcctgtctcaggaaggtttttctccgctcccaatatcttaatgaaagtgacagctggtggctgtgggccactctgttcagcagagcattaggctatagcccccaggtcaggggagtgttgtcagctcagaacagctactcctactctggaaaattctccacaggcaagaggatctatcagaggaaaaaaaaaaaaagcttactaatggagaaggctgtgtggtaaaggaaggacaagagatgctggtcataactagagttgaaagaggagttatttgacactttagggctagagagatgactagtgttaagagcacagtcctcttgcagagacctgagtttggttcccagcactcacgttgggtagttcacaagcacttgtaattgcagcccagggagatctgatgccccctgctggcttcctcatgtgcctgcactcatgcacacagagactcacaaacaggcacatatccatacccagaatttttttaaagaacctttaagattttaaagtacagtctttgagcatctatttgccacccaaaccgttacttccaaatctgaaagcttgtccttgacaacaatgtctaactgcacattggtgtacacatgtaatggcatgtaatataggggcgtgagataggagggtcacaagtcctatgccaacctgggctgtatagtgagagaatgagactctcatctcaattaaactttccttttaaagaaaaggactagaactttaatgttgattgttagaaagggacagcagctgctgtcccctattgtctcttaggtttctaatggcctcatggtagattttttgagacaaccagcttctgagagacctatgatctgtgtcaggttgtcttgggggcccttcaacaaggagaacacatgccagtgtatcctaagacatcaggggacacgctgatacccttgccacctgctgaccttgccaccagggccagacctctgcaggcctttcccaaagtaatatacagaaaaactggtcacagacgcatggggaccagcagctgtcagaggcctgataatgtgctccactcctggggacacctttgtcactttggaagaatgagttcagtgtctctatgaggaacccatcacgagaacagcactcccctccccacctggaattgtgactttttttttctttaaacagtcctggttatttgttggccagctgagaaaacagacttagaaacagcaggcaatatgtcaggcttcaaaggaaaatgtattggtgtctcgctggcttgcagccaacattatgttggtaaataatcaaatcccggtgcggcgggtttctccctgaaccttgactgaaaactattgaagctgggtctgggaggagaagagtggcagccacgcattccaggggaaaggctgaggagaatgactgggaatgcttgtaattaagcaggccttctatgcccacaagactgatgggacagcaagctaagaactggagcgagcttccaagatgaggaagcactgggtaattagatagcacctctccctagctcagtggtcctcacccttcctaatgctgtgaccctttaatacagttcctcatggtgtggtgacctccaaccataacactatttcattgctatttcataactatagttttgctgttataagctgtaacgtgaatatttgatttgtaggatatctgatacataacccctgtggaagagtcatttgactctttccccttaaggggatcatgacccataggttaagaactactgccccaagtcctttgaagcaccttccagggcagtctttagttattgtagacttttgttttttgtttttgttgttttcttaagacaggatctcatatatcccagattggctttgaagtcactaagtggctaggagtcaaggatgaccttgaactcatgatccccctacctccagcttcttagtgctaggcttctaggcatgcacctctgcgttcccgttatgcaggactgaagatggagcccagggcttcctgcttgctaggcagaaactcttccacccacatccctagctttggagatatagtttaaggtaagtttgttttttgcatctttttctcttgttgctgatcttgacttccattttattcctagatgcagacaggcctgatgacagagggatggggcgtgcaggcctctgaacatgggcctgtggtgtgactgaggaagggtagccatgttgttttgagagacctagggtgctgctagatgaggttcctgccccttttatatacagtgtattggatgaagaggggggacaaggacagcatggagcttgtctgtagtggaaagaagagacatgattcttgaaagcatttccatctctttccactgtaattcaatgttgtcatctatacagttcatgtataagaaccacacagtcaagttgaaaaaaaaaatctgtgtaatttttagaattttgggatgggctgtcgttatagctaccatagacctatgggctgttggtgccacatcctggtagggtgtggtaagtggagtccaggtgggaattgtgtatacttgaagggtgctcctggcaggaataagatgtcatttaccacagcaacactttattggtttaggcatcacttttataccaactttagtcatttcggcgtgtagaagacccaagggtaccaggtggtggcacacatttaatcccagcaccaggcaaacagaggcaggtggatctctgtgagttcaaggccaggctggtctatagagtaaattccagaacagctaaggctatacagaaaaaccatgattagactccttccccgtcaaagaatcaaaaaagtaagccctctcaatagaacagctaaggggaagacctgggttctcagcggaattgtgctacagagacctagggtgctgctaggtgaggttcctgcccctttatgtacagtgtattggatgaagaggggggacaaggacagcatgggacttgggtcacattgctgtagagagtgcttcggggtcaaagggggcatgagatccccagggcattgctccttggctcactagaggggttcctgggccacccctccctgccaaggtcctagagagtgacctcagcttcactcagctccattggctcctgcctccctccttcatagtgccagacaagacctttgtctccaggacattgagagtgtcagccttgtgttctcagaactggcttcccatcacccaggtcccagtactgagctttctgcaaagccctcccacactggactggactagcccagcccaggctccctcccataccccgaaaagagctcttggtctcagctatgaagccagctggttatgaatgttatcatcttccttttctcctgatccccacccaataggcctgttcttttatttttattttttacataggaaaagggttaatttattttacaaatgtggcagacatttcttaaatttccaagaaagcatgcaatccccccccccctcgcatcctcccctgccccaagcgcttctattgtttcgcattcagttgtgtttcctttgtttctctcagcactcacgtttcacagacagtaaacagatgtagacaaccacaaaacagaattgattattcagcctcagtgaaccaagctagcattttatttttgagcactgaggatcaaacccaggtctttgtacctgcccggcaagcatgctaccatagaactgaacctgaaaccctggctagtatggctgaagaaaacctgagtaccatgggtcaagtacaggcaatataaaaatggcattctctctcttgctcttattctcctcagctatttatcctggacttgattgtaaaaaaccatgaaaacatatacaaggcacagtaaagcaacacacatttgaactctgctcgatcaaagaaaaataggggctggcgagatggcacagtgggtaaaggtcactgtcaagcctggggacgtagttcaagccccgagacccacatggcgagaagagagaaccggctcctgggaactgtcttatcagctctacctgcatgctgtggcccctgtgtgcccacttttcagtacacatgtacacataaataagtaaatgtaataaaagtcaaaaaagaattatgcagataaggaggagaagacatatttataaagttctgtggctgttaaacacttgccccaaccgactctccctagcccctgatgactcccatcctgtcttctgattttatcagtctgggtgtctaagaatggagtcaagcaatacccattagtgactggcttgattcacacaacagaatgtctcatagttcaaccacatcctagtgtactatatctcttcttttctatgctgagtaatttgtatttgtatgtatgtatgtatgtatgtatgtatgtatgtatgtatgtgtgtatgtatttgattatatgtatggagcgtggtctctttatctacttagccatccacaggcacctttagctgttttcagcaatgttgagatgaacacaagtgtgtagagctccttgaatccttgatctttatcctcttggtgactatacccagatagaatactctgctggggcttccttgaagtttgtgacacactaccactctatgttcctgaacagctggcccttcacaggctccagtaaagcacaagtaccatttgcccacatctctgccaacgctccttctataagaaccaaggtgtcaaccggaaagcctgtcagtgggcaaatggggaaagaaaatgcagcagggctcagcgttaacgctgaaggacaccacatccatcattatggagcatggaggagtctgaagagcatggtgctcattggtaaatcaggcacagaaagatggggccatcttctcacttgaggggtctagaaaaggcgagctcacagaagcagagaatgaaatagtgggtgccaaggcctgaggctggagtgcaaaaggaaggtggagagatgcttgtcaaagaatgtgaaatgtcactctgatacaaaatagtcacatcttgactgtaattgatatgacagacaccagaaaatcattagagagtagatattaggtgggcttacccactccctcaaaatgacaaattcatgggaagttatgttaattagcttgatttaatcactccacagtggatacatgagccaatacagtatgtaccataattatattcactttttatttagaaaagataaattaataaaaatagttttgagaagattaataaatgtgggaagaggaggctagtaaagttagtaaagttcttagtaaagttcttcctttacaagtgtaaggccctgagttcaaatcccagaaccagaaaagaacactgaggcagtgacacacacgtagaagaagcccacttctagggaggtggaaactggtgagtccttgtggctcaatggttagcaagcctaagcttgattgttgagccttgggctaatgagagtccctgtctcaagatacaaagtacatagtactcaagaaatggcacccaacattgttctcttgcatccacatgtgaaaacacagacacagacacagacacagacacagacacacacagacacagacacagacacacacagacacacacacacacacacacacacacacacacacacacacacacacacggatcaatgaaacattcaaggtaatatgctaatgcccactagagagcattttcagcctgctattgctccactcagagatcaaggacgcaagtgttttgacatccctagctgtttgctgttctacagcctccctcctgtatggccaggacccagtttgttttgggatagggggtcttggagcatacttgatataatatgtttgagtcagagacaagaggcaagctcattcccagagtccactttcagctgtcaaacagcacgtggtagcttatcggtgtaatttatatcacactgccctgcctcatgtaacatatgctcctttgtgtcattgtaaatgacagaatgtcttgctcttttagtttaaatttaattttagatttatttatcttatgtttatggatgttttgcttgctgtgtgtctatgcagcatgtgcatgcttgatgccaaaggaggtcagagaggtcatcactcctctggaattgagttacagacagttgtgagctgccatgtgggtgctaggaattgaaccagtgcccttaacccttaagctattgctccagttttccaattttgttattttcatggctaaatagtattccgcttcaggtgtatgtaaacatatacaacacattattattattattattattattattattattattattattattcaataagccaccatggacactggctaattctatctcttggttgcctggagcagtcctccagtgaatgcaggaacacagacatccctttagtacattcattcctttgggtaatacccagtagtggaattgttggatccttgaggaaccaccatattgtggtctattgatgcttgtactaacttatgtcctgtgtttgttgtggatatgaattgggagttatgcatgtgtatgagtgtgcagccaccagctgaggatatctggtctcctcctccatctctctgccttacttccttggcagtgtctttcactgaacctggagctctccatttttcagctgcactggtggccagcaggacccagtgatcctcctgtctccaacacctagcactgtggttacaggtgtgtgtgtgtgtgtgtgtgtgtgtgtgtgtgtgtgtgtgtgtggttactggttttatttatttgggtgctgggatctgaatccaggtcctcgtggttgtgcagcaagcattttcactcactgagccatctctgcagctcacattcttaacactgtagacaaggctgttgttctctatatggtcatcaatattttttgtcttcttgatcttagcattctggctacagtaagatgttatctcattgtggttttcatttgcaattttcctaatagctaataaggttgggcatgttttcatatacttgttggccttgtatgtcttcttttgagaaatgtccacttagataaattgcccatttaaaaatcatcaccgccatcattgccgccatcatgatcattaccatcatcattaccatcgtcatccttatctactattgagtcatttgagcgctgtatttactctgattgttaatcccttatcagataagtaatactttacaaacatgtatgccattgtgcaggctgtctcttcacaccgttgctcttcagaagcagtttattttgatataaccccatttatctctttctgcttttgtttgtgctttggaggtcttactcaaaaattggctgctcatgtctacgtcctgaaatgtccctgcatttccttctatcagtattgtggtttccattttggatttatctctaatccaccctcgctgagtggattttcctccagggtgctactttcatggctttctcatcattatttattgacagactgctccatcttccctcatgttcttggtgcctttgctcaaagctcagttgactgttactgtgtggagttatctcgggcttctttgtcccattccatggatccatgtgtctgatgttatgggagggccatcctgttttgattagtgttcttttgtagtgcattttgaagtttggtactatggtgcctgtaactttttaaaaatcttgttgctcaggtttgctttgactgaggttttgtttttggtttcattgttctgttttggtatgattttagggttgctttccctgtttttgtggagaatgtcattgttgttttggttaggattacactgagttgtcagtcactttgcacaggttgaacctttaccagaattaattctcccaatatgggagcctgggataatctttttgctttttggtgtctatttcaagtttttcctcagtgttttatattttccactgtatagttcatgtagtttcttggttaaatttattcctagctatttttgtgattcttgctgagcagggtgtcgtaaatctaggtcactcatggtatacagaaaccccaccgtgttctgtttgctgctttcgtgccctgcagctttgctgaatttaacgaacatttattgaccacttcctgaataccaagtgatgctgtaagaaggatactttggcagggaaaacactgagaactaggaaatgtcattaggaagaagtagagtgtaaatggctgcgtgacacatgttgcagggactgtgggtgactcagagggaagcacacactgcaataccaagttatgtggctgcctgtggagctctgcctgtggatttctggcaggccctgtgggctgagctagcagcagagacttatcacttctgttttgttttttgttttttgtttttaaccatctttctagagcaaaatggtgcctgaccaggtcacaagggctcacactgatactgctcagccccactcgaacactcagcttgtcagctgtcttgttcctgcctccgtcttgccacctgtgcactaagaggagtggctttgcactgaccctgccatctgttgtcttctcttattccgagagaaggagagccgtttatgctgaccctgattgtcttctgccattttactgcttttcaagaaagctaacagaggggcaggcagtggctgcagatggctttgggaagctttcggaaaaatgtctccatctggggcctctttcccacctccgtatgccctgaactctctcttaggatagctggaactgagtgcatccctctgtggtaactggcatccattgcaaatgtcatgaccatttgttcattgacattccatagacctcctaccctctatcaaaaggaaaaccaacttgttagtaccttgtagagtgcagagcccgtgacagatacatctggggaacagaagagtaaaggatgttttttgccatactgagtgctgggtctggttactctgggctcatctttggcccagccagctgctgagcaaacttgtcctgttctgctggcaccttgtactatctctcagccagccacatagccccaggagccttttgcatccttggaattgaaagtctgtgtttgtcaaatcctttgctatcctctggcacagcttgaagccactggctctccagccacctggagatttgttctgtctggttgcagagccaggcttcttcgtgcctggggcattctgttcaggggaatgcagggcctcctcacaccatccctggggaagcatctgtgggtctgctgtctttttaaaggccacagactcactggggtacatcgtgaggaaagcagatggctttggacgcagaggtgtctgatgaggggcaggtgtgaagacttggaatcggcatggcacaggggaacttcgtcaagctctcagggctgccatcacatggtcagtgagtcatcagattgtcataaggaggagaggctaactgtggtctttgtggcctcaaaggagaggactagaggaacagagggacattcagatctttggttcaatggaggaagagctttccagctgttagatttcccggggagaactgagctaagcttcttctagacaactgattgccaggatgcgtcaggagttttaaacattcacaaggcatctaagctagattagaggcagagtttttccagtcgtggggttctgattcttgaactttgtgtgtgtgtgtatgtgtgtgcgtgtgcgtgtgtgtgtgtgtgtgtgaatacagacttaagagagcagttctagggaagggctgaagcatggcagtggtgagaacccagaggtgcttcatcctgattccgaggctgagtagtacagacttgcacacatctgggcatgcgtgcaattagaggtgagcctgaagagaatgccttatcaggttcaagcagcattaggaacgtatgtggacagaaagcaattagtcatcatcaaatattaaaaatatcaatcagttcctacttgttatatgacatctctaattagcaaaaagcgtttttaaatcttgtagtttcaagtaagggttgtggtaaggaggtcatctcgctgagtcttttaacacaatgtgtaaaataaagtcattcaggagaacaaagggaataagtccatctttatcacgtgctcatcttctacgagggccaaagcctagcttcagactcttcctttcctgtcctttccttcattggatcagcagtggcttgaccagtttctgtcactaggacccacagagttgttattgttcctgtccctgcctagttcctttcagagcaaagatctgcactgccctttgtggctggacttgcatatccctatgtgccctgtgggaggtctcactagagtgttgatctgtcactttaaggaggacaggggacagtgagaaggaccttggagatgtgcttcatacaatgtctactccagtagatggtcaccgataagcgttgaagatgcaattcagttgtatagtatcccacaatcagatcagctgtccaggtttgaaaaagtccatcaggatcgggccattgattgatgttcccttagaggaggagaggctggggacggttattagaccttcacccaagactatgatggcaggcagccccctccaggtgtgaagagtatattggctggggagttaactggtgaaagggtccttcaaagtggctatgggtgcttttcaaccagtgacccctcacctgtgttctgtaaggaagccaataaactccttggtccccagggtgcaaatgatgcagtcatagtttagtttgctgctggggccatgagaggagggaatagatgttgtttgtctcccaaggaaaggaattcacgtaattattcccaggagagtgccctttcaactccgcagggtccacaccgtgtttatctagtgggtgatgcggaaccttctgcagagaaatgcagttcagaggctgtgtctagcttactggaaggatgcttagctgtctagtccagtgtctgaggttgtgtctccggtggcagcaggagagggaatagcagcttttcattccatggaagccttgtgtgaatcgcagcctgccttgcttctgttcttgtacaagggatctcagcaatcagagcttcgatctcctcctcctccttcgagtactgagtcttctcccagcgcttgggggaaattcatgagctcaaaaaccaattccttccttctttccttctttccttcctttgttcattcctccctccctctctccctccctcccttccttcctatctctcttccttcttttctctctcctctccctctcctcttctctcctctcctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcaaatgagcaaagcaaggggagtgaacatttaaaaaaagaacccaaagtagaatactatcacaggaaataagaaaggctcataaacagaaaacaagggtctgtaaatagtttaaaatatataaatagcaagaataaatatattaacaccactaataaaagcaagctttcaaatactgttatatgctgcttacaagatgcatacctaaaacaaagacatatggaagaattaaaaacaaagaataggaaaagagatgccaaatatatatatatatatatatatatatatatatatatatatatatatatatatatatatacacacacacacacacacatataaagataacccagggacagtattattaaaaataattttaagaacaagtcttttaatagcattcaatagagacagtaaacaaaggcacaatgccaaggaggtgaagcagcaagggacttggagatgctaacaacacagcctacaattatataaaaactaacagaacgaaagaaagcatgagatgtaagaggatatttcagagagctttatctgccaggatattgaatgggcccagatgatttaacttataatgtccaaagcttgtacatgaatgtctggaaaacactggacccaagccatcaatgttcctaggtggctttaactgtcaacttgaagcagcttggagtcacctgagaagggatcagttgagagattaccaagataatattggcttttgggcatgtctatgaaggattgccttggttgttaattgatataggagagtccagcccacagtgggaggtgtcattctctgggcaacaagttctggggtctctaagaaagctaggtgagcatgggtctggattgagccagcaagtagcacttcttcatggtttctgcttcaagttcttggattgactttcctcggcgacagacttcatctggaagtataagctgagataaacccctccctcctttaagttgctattggtcagcaacaccaaggaaacgaaaaatatttattgttttcaagtacatgtggatcacttagaaaaactgactgtgttctagttacaagttaagttgtaacaggatatagtaaaatccagtttctaatgcaatacagttaagttagaaataaagattaaaagatagaacaattaacagcctcacatttttaaagcacatactcttaattaatccatgtgttaaaagggaataaaatggtggatggagagatggcttagtagttaagagccttgacgcttatgcagaggacccagattcagttcccagcacctacacgatggcttacaaccatctataacttcagttccatgggatctcatgtcctcttctgacctctgggaattgcatgcacataatgctcatatgtactttgcagtctaatgaggcattcttagtaagatgtatgagataagggtcttttcatttttttgtactgaaaatgtatacaacatattatgatcacagttccccctcccatctcttccccacccatccaattccataccttccttcttcctctttagaaaacaagcaggtgaaagaatgcaaacaaatcagatctttttaaaagtgaaaaagcacaagaaacacacatacacatttaagtacagatgtgcacacacacacacacacacacacacacacacacacacatgacccataaacacaaaaccagaaaccattgtacacaagcaaaaggccaggaggatgaaaattgccaaaacaaagcaatatgagacaacaaataatgaaatctacaaagacaccattgagtttgttttgtgttggccatctactgctaggcatgaggcctatacctaagtgtggtttatatacccagtgagactcctttggaaaaaaaatgatttttccttagcaagttgtgagtttggagatagcttcatggttagagatgggaggtcatcttatgtcacccttcttacttggcattgtgcaacagtgccagagaggtgggaaggtatgaaactcccgtattgtagaatcaacaagaacctggggacaaactaatagaagtaatgagactccttaggattctctgagtctagaggaagtctactgaagtcagtgagatttctttattttagtagaaagcagtgaggacatttaataggagaacatggtatttaagaataacacaagccagggcacataggacaatgtcagataaagacatgccgtcttgtgcagaaacagtatcacggtgtcaaagactatccaagaaaatgtgtagaaatggaaagtgatattagactcattgatagaaagatgaggtattattaacatgccaaatacttttaatctataaattcaatgtcattctagtcgaaatcttaagagggtatttttatggaacttgacaagctgatattgaaccaaattgggaataataaagggtcagaatagcaaagaaaactttgaggagtaaggtaagaggcttcactgccaggcgtcagggctcattagaggaggtagttagaactcttgagctttcccaggacatttggactcccttcagggctctccatgcaaaccagtgatttgagatgtagccctagcttgctctttctctcactggcttccctcctgccagggcatcttttaaactctgtctttaaaatatgttccagggtctggggagatgctctgtcagtaaagtgcttgtcttgcaatcaggaggcctgagttcagatcatcagaatccacataaaagttgggtgtggtggatcacatctctaaccctagtgctgggcagaagcagaggttggtggatctctggaactccgtagtcagccagcttagcccaacctaggaactccaggctcagtgagagaccctgactcagagaaccaaggtgaggagcaactgaggaagacttgacatcaacatgtggcctcatacacatgggcacacatatgtatatcatgtacacatataagctacacaatctacatatatttatgtatatatacatatacataaatatatatatatatatatttatgtatatatacataacacacacacacacacacacatatatatatatattccagagtctaatcatggctcctgactggtcctctactatcagaatctcccacctgacaactattttcctacacattccctgagtctgtctggtcctgtctgttctccatagagaacagccggagaatcctcatgccttccaatgctcagccctcaccagcatctgcccatctctttcagatcaaattccaagaccttgcattatctgtcaaggcttgacctgattggcctcacatccatgggtacctctgctatccttcccatcacttgccacacagtttcttcccatgtgacagtctcctcattgctggtacatgagacttcaatcaggtatctaaatgatcaccccactgttgtggcatctgtttgaagccagcatctctttaggacccactttgagtagtgttaaatcaccctctccattcctgctctctctcatatggctctattcgtactttttaaaattcttttttttttttgtactctgcatcatctgtttattgatttctgtgtttgtttgtatttatccactgcaatctataccccagaaaaaggtaaggtcctgactgtttcttagttctgtactctaagtgcttagaccatttcctggcatctatactatactatacactgcataaatagtaattgaatatgtatatgaacagagtatagtctggatgtgaggacagatagatgaatggaatgtaacagagatccctggaggagaaaacctgtgtgtgtgtgtgtgtgtgtgtgtgtgtgtgtgtgtgtattatttagtaagtaactactgatttgggatatgtgccctttgtaattaaaaaaaaaaagttaaattgaatctccaccttatacaaaaattgacttccagatagtttaggaactaaaatgaagagtaacttagctttcctgtttaattgctcatgcacaaccacacacacactcaaaaccaagtgtagagtatttttattatatactcagtaatattcagtaaactcaagcattattttcactcccctcttacttctggcacaggcacctcctcaggagacattgcctagctggagcctggctatcctccccaccagggctccttgcttattccctagtaaatatttggaaattgactaccttttgacttgcagttgatgttttgcttttgttatagttactagttacttttctattgctgtaataaaacactatgaacaaggcaacctagagaagaaaaggtttatttgagcgtatggttccacagaggtgagagtgcatcaccatcataccttctaaacctccccaaacagtggggatgaagctggggagcaaatattcaaactaccacatttactccctgactcccatattctttttttttaattaggtattttcctcatttacatttccaatgctaccccaaaagtcccccatgcccacccccccactcccctacacacccactccccctttttggccctggcattcccctgtactggggcatataaagtttacaagtccaatgggcctctctttccagtgatggtctactaggccatcttttgatacatatgcagctagagacaagagctccgggatactggttagttcatattgttgttccacctatagggatgcagttccctttagttccttgggtgctttctctagctcctccattgggggccctgtgatccattcaatagctgactgtgagcatccacttctgtgtttgctaggccctggcatagtctcacaagagacagctatatctgggtcctttcagcaaaatcttgctagtgtatgcaatggtgtcagcgtttggaagctgatcatgggatggatccctggatatggcaatcactcgatggtccatcctttcttcacagctccaattttgtctctgtaactccttccatgggtgttttgttcccaattctaagaaggggcaaagtgtccacactttggtcttcattcttcttgagtttcatgcgtttagcaaattgtatcttatatcttgggtatcctaagtttctgggctaatatccacttatcagtgagtacatattgtgtgagttcctttgtgattgggttacctcactcaggatgatgccctccaggtccatccatttgcctaggaatttcataaattcattatttttaatagctgagtagtactccattgtgtaaatgtaccacattttctgtatccattcctctgttgaggggcatctgggttctttcaagcttctggctattataaataaggctgctatgaacatagtggaccatgtgtccttcttaccggttgggacatcttctggttatatgcccaggagaggtattgctggatcctcctgtagtactatgtccaattttctgaggaaccgccagactaatttccagagtgattgtacaagcttgcaatcccaccaacaatggaggagtgttcctctttctccacatcctcaccagcatctgctgtcacctgaatatttgatcttagccattctgactggtgtgaggtggaatctcaggcttgttttgatttacatttccctgatgattaaggatgttgaacattttttcaggtgcttctctgccattcggtattcctcaggtgagaattctttgttcagctctgagccccattttttaatggggttatttgattttctggagtccaccttcttgagttctttatatatattggatattagtcccctatctgatttgggatagataaagatcctttcccaatctgttggtggtctttttgtcttatcgacggtgtcttttgccttgcagaagctttgcaattttatgaggtcccatttatcgattctcaatcttacagcacaagccattgctgttctattcaggaattttccccctgtacccatatcttcgaggcttttccccactttctcctctataattttcagtgtctctggttttatgtggagttccttaatccacttagatttgaccttagtacaaggagatagaaatggatcaattcgcaatcttctacatgataacagccagttgtgccagcaccatttgttgaaaatgctgtcttttttccactgaatggttttagctcccttgtcaaagatcaagtgaccgtaagtgtgtgggttcatctctgggtcttcaattctgttccattggtctacttgtctgtcactataccagtaccatgcagtttttatcacaattgctctgtagtacagctttaggtcaggcatggtgattccaccagaggttcttttatccttgagaagagtttttgctatcctaggttttttgttattccagatgaatctgccaattgccctttctaattcgttgaagaattgagttggaattttgatggggattgcattgaatctgtagattgcttttggcaagatagccatttttcctatattgatcctgctactccatgagcatgggagatctttccatcttctgagatcttctttaatttctttcttcagagacatgaagttcttatcatacagatctttcacttccttagttagtgtcatgccaaggtattttatattatttgtgactattgagaagggtgttgtttccctaatttctttctcagcctgtttatcctttgtgtacagaaatgccattgacttgagttaattttatatccagctacttcattgaagctgtttatcaggcttaggagttgtctggtggaatttttagggtcgcttatatatactatcatatcatctgcaaaaagtgatattttgaattcttcctttccaatttgtatccccttgatctccttttgttgtctaattgctcccatattcttaaggccatcttataattcagatgcatttagtccaacttcaaaagtcccctgtgttttacaatattaacactgtttaaaagtctaagttcaaagtctcttctgacactcaagtccatccatcccttaattgtaaacccctataaaataaaaaggcaagttgcatgcttctaacatagagtggcataaaatatgcatcactattccaaaaaagaggaatgggggcacagtgagaaaatacttgaccaaagcaatatggaacctttgcagggcaaattcctgtagctccatatccagtgtcagaaaggcttagatgactccacccttccagctttgcactccctgtctgcagctctctttggcagacatccccatgactctggcatctctaacttcctgggtctttaaggcaatccaggctccactctcacagcttcctgtagggacctttcagggcctccttgtagggattcccctgccatatgcctggcctcagcagctctccttaaccatggaggaagattctgcaatgcgctgtgtatccctcatgtttctaaagctggaagcatgtagacaacactgccaagtttgactgcctgcttgagagggagcctggcccccttaaatcacatttgcaatctttttcctttgtcattgatttttaaaatccctttaggcccttcctttgtaagagttgaaagcagagctggatgacatcttgccttgaggacacccctccctttattccaacacagatcaggcctctcttaacccccttgtctgcaagccttggctgcaacattaagattcctggtgctctttttcttcattaaactgcttattgtctgacctgctcttttcatggtatatatacataggagtgattactaacaaccatgtgagagccaacagcagggcattgagacctcctccaccaaggaaatgagtacactactcaggcaagttctcaggataaaagcagacagccgttttctttgccaatatatcacaagaatgatctctggcccagctgctcatattgctcccctttgaagtcccttgagctggacttgcgtgattctcagtctgcgtgactctcagaactactgtcttctaggtttctagcaggatggcccattaagctctgcttaccattctcaaccacttttctaatccccaaacccaacgttttctgtacttctccagaagcagcatggccacaatgacccactcttggtaccagcttctatattagtcatttttctattgttatgataaaactttatgaccaaggcaacttataaaagggagagtttattgggacttatggtccaggttcctgagagctagaatccacgatagtggagcagagaggcaggggacaggattagatgctgacggcagcagctcagggctcactgcttgaacctcaagcacaagacagaaaactgggaatcatgtgagtctttaaactcaaaaatctcacctctagtgatatacatcctccaacaaacccacatctcctaagcttcaccaagcagctctaccacctggtgacctagtattcaaatgcctgagaccatggggacattttattcaaactgccacaggtctacttccaaaaacatgataaattttaagagcttatagaacagtcaactccctttatgggggagtgcttcaagacccttcagggctttcctgaagcaacagggcactatgcatacattccatggcttctagtcagtgtattggaatgcctgtgcatacccctcttgcacttgaggccttcactaaggcaggcaagtggcaatgcttgcactgaaataatgtcacagtggatctaatatctgtggcggcaatgtcactgatgggtggagagaatagacatgtggacaccagacaagagatggctcatgtacttactgggaggaatagggtaatgtgcaatcacactacatgaggtggggcacaatttaaaatctgggaactgattatttctggaaatttcaactgaatatttttagataaatgactgttggcaagagagtgaagccacagataaaggaggactgctgtactatacagatgggtggcctggacagcatggggctggacgctgtctgtgggcatccaccgcagcctcacgccatcacctccggtcatggtgcaggacagcactgctttgctcctggagctgcaacatgggaccctccataggcgctgttttcagctcacagggctttctgcacctctaggcgctgctcagctcctttttgcttcttctccagcggtgcctttggtctctgctcagcccagactctgcaagaagaccagcgtgccagcgatccctctgtcacagacatggggcactcagttttagaggtgctcagtacagtttttatatttactaccagcaaacaatttccttggcaacaggaaagatggtattacagtgggcagctcaaataacatatactcttatgctgtctttacctgttctactttaaaaacaaagtttgtttttcattattaaatgaatagtaatctacaacagataaaacagttttttgagcatagggtcttgctctgtagcccatgctggccttgaacttgaggaaatcttgccctcccagctttccctgtgctgggattacaggcatgagtcaccacacccaaggacagaaaagtctgaaaaatacaacagtccttttcacacatttcactctgatagaaccatggttacaacctgagtataattctctccagtctgttttggtatgattatttctttatgattataataaaagcatgcatataattgtgtttcttccttttaatttagctgtagataattatgatataatcatatacatgctgtactatcaacagaatggtaatttttactgcatcggatttcattattttgatctatcattgttgaaagctattaacctatttttgttagatttcttctcccattttatcaagtagaacatttctgaatatggtagaactttccgtcctccatctttttttagtcaccatgttgctctgagtgctttaggagtacaatattaacaaacgtcaagaaagtgataaatatatgttcttagattcccatcacaagtctatctagtgtaaagccatgtgagccggaggcatatgctagtgtagagtgtgtgagctggaggcatgtgctagtgtagactgtgtgagccagaggcatgtgctagtgtagagtgtgtgagctggaggcatgtgctagtgtagactgtgtgagccagaggcatgtgctagtgtagagtgtgtgagccggaggcatgtgctagtgtagactgtgtgagccagaggcatgtgctagtgtagagtgtgtgagctggaggcatgtgctagtgtagactgtgtgagctggaggcatgtgttagcttatctgctcttactttaccttgaactcagtgtggtgatttggatgaaaaacgttccccgtaggcttcgttattcgagcatttggtcgtcagtgcatggtgttgtttgtggaagttatggaacttttttgaggtacagctttgctggaggaggtccatttctaggggagggctttaagggtttatagcctcaccctacttacagttctttttggcttcttgtaatggttgaaatataatatctcagcttcctgtccctgctgccacgtcttccccaccattacagacacatcactctttgaaactgtaagctaaaatggactcttccttaagttgcctttggtcatgatattttatcacaccaacagaaaaagaaaagtaatcaataaaatcctatatggcttaataaaagcatataaaactctagcgagggagcagtcctgcttacgtatgggtggaagtaggacagagaacagcaggtatacagagccgccgaggaactgcctgtgttcacgcagccttcatgatgtggacatgcatggtttggaggggcaggccttagttttctcagataacaaagggatggagtaactggtgtaaatgaggtgactgtggctttgttgactgtgacttcttggctgcccgactccaacctcaagccccttactcatgcccaggaacagaactcagaaaagtttactttcagtgagccttgctttatcacttgcaaatttattgttacttacttttattaaaacggaacacatctgtgaaattgctaatttgcaataactgcctcagtctttgttggtcttgtgtgcttccccatttccatcgacagaacctgctacagtgatccagaagctgacgatcgcatacatttctattaacttatgaagtaaacacataaatatccttaaaatagttatccttttactatgttgttggcaaaagtgtgtttttgctactctgaggctttccatatttttatagtgtgagaataaacagatgttctatgcaaattatttttaaattattttaagaaaatttaaaatgtctgtttattattgttcacatgtgtgtatgcttgcatgtggacatagaagggcaacttcctaggaactgaagttccttctctacctgttgaagcctcttgttatttctgcacatggttcagggtgattcttaggtcctcaccctaccatcattttgccacagagtgctgggattatagatgtgagggcctgcatccagcttgtgtggctctgggcttggaactccagccatcaggttcccatagcaagttttacctgctgagccgtcttgctggaactaaatcattcttcagcattaaaaccttgctgtataagacagagtcttgggcctttttgatcatcagataacaggaacagcttcttcattcagctaacagctgtggcgacacacggtgacacacagtgaccaacttaatttggatacatgatttatctgtgttttgttctctgcaggaatgggctgcttctggggagctgagcgcaagttctgggtcttgaaaggagtgtactcaacccaagtgggctttgcaggaggccacacacgcaatcccacctacaaagaggtctgctcaggtagggacaagggggctcatccctactggtggtgacaagatcttcgaaatgcaaaatacatatatttaagaatatgtactctctctgtcctttttaaaaaaaaaaaaaaaccattcctgtaaatatacctctttgcttctcatgttgtatctgtagaggttgatgagcttcccatggaatgcattttattcttttgctgtggaaaaataaaaccacataacacttggttgattggaataattgtgcgtttagcttagcaaactggactgggctcagcttggcagatctttttgagtctttcctggtgtcactcatgggaccatggtcacctggtgggaagttcaaggagcagctgttcttagatgacctcctgtggcagtcagtgctggctgctggtctgcactgactgagaaatggggaagtctcagatgggtgtgagctaatgcaaatgcaggtatgtcttaagacctggaaacagcaagaggatgagccttgttctccatgtactcatttagtactgccccacggactaaactgggcacagtctggcttagatagtgctcctgagcccagcacagggatacagggaggtgtgaagaaaccaagaccattgctatcgtgctcttcacatgcctcagatgtctcatgccgtagacatattcttggggagagatcatgagaagccaggctgtgatacagggatctgtcaattaccactctctgcctgtctataaataagttttctaaagcacatttgtattagtattagatgctctaaaggaacagaactgatagaaagactatatatcttaaaggggaatcattagattgtcttatacaatgagggtagcccgacaatggctgtttcacagtggagaggtggagagtctggcatgaggctgatgtcgccacagtcccaatctggtgttggagacttcgaggattcctggagagctgctgatgttcagtctatgctggaatccccagcacgttgcttccttctcctgttatctgggccgccaccagaaagtgctgcccaggtaaggtgggctttactgcttcaaagaatttgcccaagagagtccctcacaggaccacccagcagcttctgttttacttgattccagatgtagtcaggttgacaaccaagactgggcatcatggtagtaatggtcattgctttgcttttccgtcatgtcgatgaacatgtttgtacctgaacagcgagagtgtgtgactcaggacatgctgtgtggatggcaaagcaggaagcgcttactgtctagccctttgcagagaaggaagtgctgaatgctgctgagggagaacacagggagatgcccatgcaggttccaacccagtgccagttcctgcagaggttggtttctggcattcaacagctcccatggtttcctgttgcctaacattgtatggtagctcttttggctagcctggaactcaccatgtagatcaggctggcctccaactcactgacatccacttgcctctgcattcctaagtattgaaatgaaaggtgtgtgccatcatgtctgcccccatccatctattcttggtactattgcagcagagcctgttatgtttccaccagaacttgttcctttttccacctgggagcaggttagtgtcctttctcacagtgtctctggaatattgatgagacttgtgaccatcacaaagcaagacacagtgggaatcagtgatggtcctccttccagggacctctgtgagcactcaagtgcacatacccacatacagacagacatgcatatatgcaactaaaaataataaaaataagtcttttataagaagaaaagaaaaagagacaggaggatgtagctcagtggtggatcacttacttgatatgtgataggctctgaattcagccccacttgatatgtgttaggctctgaactcaacccctagggccaagaaagcatatcaccaaactagaaggtcttgcttaggaaggcttttggagacctgtggtctaagtaatatttaaaaatatagctgggcctggtagtacagccctgtacttccacctgttaaggaggctaaggcaggagaattacaaattcagggtctgcctataaagtgaattcaaggccagcttaggcaactcagcaagatcatgtctaaaaataaaggaaaaaaagaaagttgaggatacatctcagtggcttgcctggtgggtgcaaggtcttcggttcaaatcccagtactacacagaaaaaaaatgttgttctaaatatgtaaatagttttatcaagataaaagcttgagggccaggcatgcctgtaatgcaggacgtggtaagctgagtcaggacgtgaataaaaggccagcttgggtcacgtaggtttaagcagcctggaccttgtagtgaaacccccattagaaacaaagaaaatgttttaaaatggagggggaaaaagcaagggctttgagggcagtggttatgggggattgctgggaccatgggcacctgagggagtagggaggaaccttgtttaaaaatagtcatgctgatttgttggtaaaagtatgaatttttcttctgtgtgtcactgcagcaatgaaggtgctataagaactttgttcttgtttttcttgctcatagaaataattgaaatatcctagcattaggaatgtgggacacagaatacattcttcagtagtcagtccatatatatatttgcttctgtttcaaaaatatagatgcttatatatgactatccttagagatgccagtgggccctggagatctcccaggcttactctcttgggcccctgaaatggaaatgaatagatgccttcctgcaattctagacgtggaataatggcttaggaagaaaaggttcctaagagaacccacaaagcctggggagatgggccactgggagaaaatgcttgctcacaggcaagatgacttgagtttgaatctttaaaacacaagtaaaagcttctgaaatcccaacatccctaacttggaaatgggaggcagagacaagagaatccatgggagttagtggtataggtaactgggcttaggaagcagtgcagagatgtctgtctcaaacaaggtgaaaaggtgagaaccagtaccttaggcttgtcccctgacctctagatgcacaccatgatatgtccacaaaacccactgtcttagtcaggaattctattcctgcataaaacatcatgaccaagaagcaagttggggaggaaagggtttattcagcttacacttctgcattgttgttcctcaccaaaggaagtcaggactggaacacaagcaggtcaggaagcaggagctgatgcagaggccatggaaagatgttacttattggcttgcttcccctggcttgctctcttttacagaacccaagactaccagcccaggggtggcaccatccacaatgggccctcccctcttgatcactaatttagaaagtgccttacagttgaatctcatggaggcatttcctcaagggaggctcctttctctgtcataactccatctgtgtcaagttgacacacaaaaccattcagtacacccacacacagggacacatgcacacacatatacacaagcatacacacatgcacaaattaataaagaaatcttgtaaatacctgctctccatactgttaccctcactctgcaaaggacaaaagacagttctgatactgtaatcacctgtttatgtaaccacgggtccctttctgttccttctgcctcactgacaatatgattgtcctgtgaatttctactgcatgctaagcactataataggtactaagtctttggttttattctcatgcaatcccacatagcatcccagtctctgcccattacaaaggcattgctgaggctcaaagagttcatgtgacttaccttctaccttagttgctctccacttatagtttatgccattgaccttggtataagtctcccaactgttgttatagtttggttggcctccattcagccattcacacatccttcctcattcagatctattcattggttgaactttaaaataccgcactgcttttctaaatgactcctgtgtgggaagtaaagaaggatttgctttgtcccacagatgtttgaatttgaaagtaaaaaaggtccaatttctgtagggattcagtccatgcaaagagctcgcatcaggatgcagcactgggtgaaaatgggattcaaggggttgggtggtgaaggaatcgtgcagagctgtccattccatctgaacaggactgccaactttgggcacaacaaaaggcatggttgttatggaaactgattcctgactacaaagagatgatgttgggttctactcagacactaaaggaaaggtgattggggtggggtggggtatctggattggttttgttctgattgtaaaatttgactgggtaaaaggtacccttgcctaggaatgatagaatcctcaaatccctaaaagtagggggtcgggagaacaccacttagggagatggtgactgagaaaggggtatgtggacagcacagggtcacttatctagactcccctctgaagcccccagtgctccctgatggcaggcagttgaaacacaagacagaattctgatagggtacccaggagagacaacagctgaggaaggaggtggctgtacagagacacaagggcaatgtctctgctccttttctgtcgctgtgacaaaataccatgaccaaagcaacttagggagtatttaattgggctcatggtttcagaaaattagagtccattgtggtagagcaaaggtatggcagtatgaagtgcagagagctcacatcttggttgcaagtaggaaacagaggtacattgggaatagcaggaatcttctgaaagcctgtccccagtgacacacctctttcaatgaagccgtgttttccaaacaatttgagtaactgggaataggtattcaactatatgagcctatgggcagacacacagcttctaataccatgccattctcaagtttccaccagtttcttgttctgatccatctgctgtagaaccttcttgtcttttgaccttccgtggaaatcactttcaagaagaagatacaataaggccatgttagttaggcagacagacaaattctcatttcaaatagaattggacgccacttgatgcttctcagtcaaggttgagattagtctgcagaggtcatctctgctggttgggttaacctgggtgggactggcagatggtaatggagcttaggtcttcaaagctgagaggcagaagggagggctccacagctccaccaaatgctgtgactatcatcttgcatttcccagagacccctcatctttcacatcgagctcacatttcattgtgatggaatttcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagagagagagagagagagagagagagagagagagagagagagagagagagagagaaatattagttactatgatggcttacatgcaaaaccacgatactggatactaataacacacaatgtgaagataacccaagtctctgtcttctagaactttcctatagttaaggaaacctcattctttttatgcttgctttaaggggttggggtggctctggttttttctttatgcacatgtgcccccatacaacacacacacacacacacacacacacacacacacacacacacacaccatgcattctgcatacgctctctcataggattgttatgcaaacctgctgattagctggcgctctgttgtctctctccattgattctaattgagctattcagagtcctcaatgccctggtagagaattattcttacactttgtaataacaaccatgcagatgaaaatatgaaaaggcattctgcaatgggtaagcacttcgggttaatttcggcacattagccaaatgtacaaacccggcactgctggtgaaggcgcctgggctatgcattcactgagtgaggtcttctcatattttgcttacagatgttcataacaatgccgtgtttatcattctattcaaaagccttttgaagtcgattcagccaagtggcaccagagccaaaaacaagaaagggggcaggccactttcccccctcgggactcatatggccaccagaacagcctgagaaacagctacactgtcccacaggggtgcccagtgggagctcggtctgagaacagccaatagtggcagtctttctgtaacctctcagtgctgtttgtctccaaggcaaccccctacccccaagcctcagtttcccctcttaaaaagcatcagtgaagctatggcatggttgtagttaaatacttttaaagtttatttttattttatcagtgtttgtaaggtgtattcatgagagtgtacgtggtgtgtgaccctgggtatgtatgtgaggaggacatcaggtgtcctgtcctatcgttttctgcctcgtctccttgagtcgggggctctccctgaatctagagctcattaaacatgctagaccagcaaaccccagtctccacttgtctctgctctaaggtgctggcctgataggtgtgctcagctgtgctcagcattgacatgcatgctgggaaccggagctcaggtccttatccgtgtaccattagggcttttactcactgaaccgtctctccagttccctgatttcttattgaaaataaaattatctcagggctgggagctggctcagtggataaaggtgcttgccaccaagcccaacagcctgagtcctaggagtgcatgtggaggagaaagaaagccaactcacacaagttgccctgtggcctccagaggaggtgcatgcccgacaggagttaaataagtgcatgcaaaaatattttaaaaggaaaatatttcacatcagatgtgtcttagaaaatctgggacttgggctgtctatcactgtactccttgtctatagggacaccgaatggcataggtgtaggtgtaggtcagtgtgtggcttggcaggctcagtcagcctctgcctatacatctggcctgacacccgcacctctccttcctctcacctcctctgggctcttatggatcttcttcactccttctccaagtacctgctagcatttgcccggagctccagagctccagctgggcattaaaccagcctttctccatgcgtgtaaagcactcggtgtgcctttttagttcaaggtaatttctgcagtgtttgggtggagatgcgaggctgcagttctgccatgagttaatggctccattcttcaaaggcgggaggggcttgggcacagctcctcaagtaatggaagactccccctcaatccctctcagactgcattcactctctcagtgcatagtcagcctcattgtagcgttgtcaatgccagtcaaggaaaattaccaagttattgacacgtctccccacacgcaagaatcctggtgtttgctccttgcaacaagcaatttgatggctttttgtgccccttatttgagacataaaattgggccctgaacttgtcacagatagaatgaaaacgcttttctctttcaaacaaacaaggagaaagaaagctcagaggctagggagcctcgcccctcacttgtaactctgacccggtgtaccagctcctcagtgagtagccccattgcccagatgactggagcataggtagaggagagagatacagttttgtttgttctaaacctagtcacccctaacaataagcttggcttcttaacaagtgccatccctctgggctgtcattatcttgggcacgggtcatggtcacatcacagcatttcaggcctggaagaggtttgaaccaacaactagtcctgtggttttccaagtgggtgactacagcatcaggctccaaaaagctgctgtgaggtctccacccacagtgaagtctgttccctaaatggattcgcatctgctacagacaaatggttacagtttgactctagctctatgttggagtcctgttggatattctgtttaaaatggctctttaaaatgaccagagcccacaggactccttgttttgttagttgagagaactgaggctgagagacagtaagtgatttaacagtgagattgatggagagaggttgatgctcacttggttttccagatcacagccttgctgaggcctgagagggttttgttttgttttgttttgttttgttttgttttgttttgttttgtttttataacgtcctgttcaggtgaggctctagggtggagggtctgtcaagtttgacatgttaagagcttaaggcattgttatttttgttagtcggtctttgcccatctttctgttaggatggattcccctctccctacaatgtgtggtaggcattctcccttgtctgtgtgggatacataccaaggcccccatagatgctggaagctataggcaatattgaaacctgcacgcatgttgtcattcaaaccacagcccccatcttaaagagaataagaatttattctggagccacagtgagcgaccatgacctagaaacacaggtttatgttactccaaatcccatggttttatgtggaagcagtttcatggggtgttttgtagtttcacagaacaaagacagtcataaatcaagacaatttttaaatgcattggttggcacatcagagaggcaggtacaggaagatgggagagctatcttacaggcccaagatgttatctgatgacatttttaactcttggattggtggaagcttgtgctctgctaagttaataggttctatgaggtttttatttattatcgtgaagtgttagttcagaaacagagctggctgttacacaaggctacaagtagcccaggataaagtaattagccttcaaacttacaaaactcccaatctctgtccagtactgacattcccatcagtcttgcagatgcagatgctctttccaggcgttttttttttgcacagccagacatagcttcttttcagaacttttcatttacatgagccatgctttccaaatacaggtggcgaaattcaatttatacattagaaacagcaagagagaaacacctcaaaacagggccctcatgacaaaatagtatagaaagttaagtgaatgagggctcccaggtactctccttccctccctccctccctcctctccttccccctcccccatcatctactcaccctccttgcgattctcttctcctccactcatcttattacaatccctctgccaccaactgtactacttgccttccttcctcttcttgagcctgagaaacaaaccactggtgaatgccgtgggtccagcgtttctggacttcccatggacaatgttcctgaccagggggaggctttcatgctagctgttatagctagaaatagagcggagggcctgacagagaagagattgaggggtatgccctccttgtgccacgttttcaaccccaccttttcccagctggcgcctgcctgctcagcctgagcccttgatctggaactgtctgtctccctcacatgagcccctgacctggaactgtctgtctgtctccctcacatgagcccctgacctggaactctctccctcccagctgcttcagctttggagcccagacaaagccactgcgctaagtgaaacccgccttccctctatgctgcagagtccaagcatgttcttgtcattcccatgtccttcttccatggactctgacaaagtcatgtcagagatatggctccaccacacctaaggtccccaaagctgaaacaaaattgatctactctcctcacagagtttactagatatatttagtttgttagaatgcttgaacccagcatgaatatcatagaggaggagaattttcttataatttcaaagaactgaaggctggcacacactattcaggaggtaccaggctgctgctgcccttgggtgacaagggagacccattgcagagatagcaattatgcatccctcctctgaccttgagattttgacctttttgactggtttggttagttgacccacctctttctttgaacaacttaaatccttgctagggcacaggtcagaggtcaacaggccagcagacttagtcaagcatgtcttctacttgtatatcactgaaagtaccacccagatgagctgttggaaaacagctcactgatggagcctttataacccatccagactggatgggggagctgttcactcattgtctcaggattatatcctcaaagatttaaaaggaagattaaaaggaagctgctaggttaagcagttcttaaaatgtaattgcaaaagccactgatggataggcctgccctgaaattttcacatgacatataacggagccataatatgtaatatgagaagataaccttactgtggcaggggccagcttctctggcaattttatgtgatgaactgggtcttaattacttccaaatgactaacagatttgtacagtcctagaataaggtttccttgttgatgtcctctataagttatattaaaaataaatatctgggtcgatgactaccccacctactgagcaaaaatcaccgaagagactctggcaaacacttggtggtcacccctatgccagggaaacacctaggcagctgagtggcccccagaggggtcactgccatttactagtttctacttctcaacagcctggaatcagttataatcagctgcagataagcttcacctcatgtgcttcagccgctaacctactaatgaaagcagtcaattttattttacaagtaaactagagttttgaaaactgcctgacgaacgtagccagggctctggagccacttagatgaccctgattcatagaaatgggaatgttatttttctttggttagtcggctcgtctctactgtttcttaaacattgtgtgtacctgtgtgtacccaagcatgtttctgcatgtacgcggaggccagaggagacagccttgggtgtcattaggcaccatttacctcacttgagacagtctctcttgtcaatgtggttaacggtcatcaagcccagtggatctctctttcctgtgtctctgaatgctgggatcacgagtatgtgccaccatggccagcctgttcacatgggttctgtggcttgaactcatggcctcaggcgtttgtgcgcagctctttaccaattgagtgccctctcatttttcatcccccgggtgagtttttaaagttagaggaaatatcagaatctttcctatagatgatcattttacttgttagccaactacgaaactctgtccaagatgcaccagctggaagatgggtctttcttccaccatccttgttatcctgttttcagttgctttctgagggttctgtcagttagcgcagggccagataccaccatactctgggctgaaatgctgggggccagaaggccttctgcacagcagtactcaccagaaccccatattcagtgctttcaaacaggaggcaggcagagagcaaacatcgcagcacactgagagggttgcccatgagcagccctgtttgcgtgatttccaggtctgtcacacaagtggtctgatcttcactggccccatatgtgagcctatttcctttgaagctgtgctcactgatcatcctggaggtagagagctgccaaccactgtgatacagtgatgtcctctgtggacctgccttgccctgggaggattgacagaagtgcctgaagctgaggatcttttgtgtacaaggaaagacaaccaccaccaccaccaccccaacctgtctcactctggctcaatttgatagtttgaaatgtttcagggacaggtacttgttcccactgagacaggtttttaaatggacaaagccacatactggaagcttaagttggtggagtggagtgcaggaagatccagaagaattgggggtttatcttccaatttttttttaattaataaacttttgtttttcaaacagttgaaggttcatagcaaaattgaacaggaagtatagaggcttcctgtgtgctctctgccttcacacacctacaagcaccccattttccacatcctgctccagaaggctgcacgcgttgccatggatacgtctgcccagacaggctactttaagcttcgtctccaagccacacattttgtaggttagataaatgtgtaacagcttatcccaccatggcggcatggcactggatggtttcagagccctgaaaacctgggctttgtctgcttagctccctcccctcctccttgacaaccaccaaaccacacttgctcctatctccatgggctcgccttttccagattattctaaagatggaagcaccagcacgcagcacacagccttttcagactggcttcttttacttaaggataggcactgggagctccttggtgctgccaggattttcatccttggttaatgatggaggagcacccagctcactgtgggtgacaccatccctgggcagttgggcctggaccatataagaaggtgatctgaacaagctatggggaacaagccagtggacactgcttctccctggtctctgtttttagttccctgcctccaggttccttcccaacttccttcagtgatagatggttacctgaaagtaagataaaataaatgctttcttctcccaagttgtttttggtcagtgtttttggtcatagcaacagaggaataaactatgacatcctccatgaattttcagttaacacccccttttcagtggtgaatactatttcattttctgtggcttatttatccatcatatgatatcactggccatatgaacatgctatcttcatttctgttgcctacaatgtagcaacatacttttattacctaatttgatttttaaagcttctgatggataagcccccaaggtcctgatatgagccaaaaatattatcccatgggaactctgtttcttccatagggcaggcctatggaactccttccttcatcccagatatctagagttaatctctctgttgtatagtctcatcctatatttatagaaactttataaacagtttccaaagcctggatacaatgtgggagaaaggcagctgtgcctcctccctctgactggtttctcaagactgatgagagatagagtcccattgggaaggtgactcacttggtctagaaataatctctcaaacctaagacatcatcttgttcctccagctgcacatgcagtacagcagagccatgagatgttaccagctcattcaggtggcttttgcacatgaacttgaaaagagaatgatgacttcatttggtgtttcccacgagccaggcctcactgcaagtcaccccaccccagcggcttcttcagttcttacaacagctcggtaggtgaaggatgaacactagctagtgtggtcaccaggaacatgaatgcaggacagtgtccatctagactacgtgatcaacaagtgataggctagaattggtaccctcccatctactgcagggtctttacttagcatctttctgtatttctcttaaagagactgagaaagtacaagtgagtactgtgaaaagaactccatggttggttaaaagtgtttctccctctcccacaaaaaccaaaacagccaaacacattgactgcttgactgtgcgggttgggaagcaggagtagttaccagtaaagggtcctcccattggctgtcatttccctggggttgtgccatgtcctttcatctctcccataacacctagcacagggcctcacatgccctaggcccctctctattgtgtattgggcatctgttaatacccacatgcattcaacagggcagtgcccaagggtccagttgggaagacagggtggtaacttgtacacatacttttaaagcccaggccttcagtgatgcttcctaagtatggaaccaaacaaacaaagaaagacaaacagaaaatagcttgagaacagtccagggatctgagtcatgagcaagaaggggcaaggacttcctggtgacttaagagaaatatagaagaggccaggcttgcctgcgatggctcctagtgcttggcctgaatgacctgtggtgggatatctcctacctcgagaggacagcagtggtactcatctgtctgctgccagggatcccatgagcctagtgcaacctttgtgggacatagggtttcatactgggaaagatgaagggattcaagattgcagcactcaatgctctgtcagcttttgctctgcctgcctcaacccctgctgtgagccctccctggtcactgctccattttttttttttttttttttggccttggttgggcacatgccttttgataaagagaagatccaggggccctgcctgctttgagtctgtaccacatgccaaaggggcgcatacagatgaggtatgaggttcatctcccagtgtggactgaaaataaatgacagtgacaaatggttgtgccatagtgtaagctccttccaaagacatggcagggctgagagttgtgtgcaggcaggcttgggatacagaaggttcactctgtgatttggaccagttaccacagagtaaaagctccttcggatgaagaatcgcacttgtcaagtcaaagtatgtccccactgtgcctgagctatgaatggtggctctgaaagggcatgtctctaaattactgcccactcagcatccttaatgtccatttaggacaggtacagatgcttttaaagattagccgtgtattcatcaggtattgtggtgacatggaagggccagtttctgccttcaagaaggtgtccatactttaactaacaagttttcggagcacacatgggtttgcagggaaatgaagcacaaagtggttgaatagatttcccatgatacccaacccctcccgacacttgcacacttattccctgctaacacttggcactgttgtggaaacttgttttcactgatggaataacaccagtatgttactattagttactgtccctggtttacatcagggacactcttgtgtatatgtgtgtgtggtgggtgtctgcaatctatgagctttgaccagcatataagagaattatttaccattgaaatgccataacacatagtgcccctgttgtagaatgtcctgtatctctatttatgtccagccccacgacttttgtgaccactgagtgactccttgttatgttctgaattttggcttgttgttagacacatagtagtgtctccttgttttgctttacaactctcgactgctgtgatctggagtgtctttctctgtgcgtttttgatctatagatcttcctaccagaagaagaccagagtggctctagagatgtggttttcaggccttcaaaggaggctttttatttccaaactactgaagtattatcatgtatgtcttgctcacttgtattggtctgacactggcttgtacacttggctttctccccccccccccttcatttatttgctaatactcctctgctgttttcttagtggatcatagacagtttccctgacttcacactctctctattccctagcctttccatttgttctcattatgtacagacagaagtgagcgacttgtatcccagactaccacagtcaaccgtacatacgtcatacatgtataccactcagagaaccatggaaatacatggcccagttctttttttataacacattcagtgatagaataataaggtcattaagggcaatcagcattttattccatccttgattatattcctgattatagtttgttgtctttcttaatatgaaatatgaagcatgtctcttccacctttgatgaggaccagcctggtcctgggctgcagtgggaaaccttgtccacagcctgattgcatattgtttaccccaccccctccctggtagggtaatcatggctcctgacacttcctgggaggacacagcacttaatcacgtaattatgtttctggatggctgtcctaaacgatgggaggcacaccctgccagcagctcacggacagagttaatttggagagagacaactaggcagtgtagacatgactagattttgcttttttctcgcttgtccttccatcagggcactggcccgtgagcagagtgtgactcgggctgcaggctgcacttttccagggatgaagctagttcagtcattcctgagaattacggaagggctcagtgttcaacctgacctgtgctcatggccacagctctgcatagcaacagagaccaatagaaatggacactgggctctgaggatcagggttgcatcctgaaagtccctaacacctgctaggagacctagactgagtcctgtggggcctcctagtatgcctgccttatctcgcaaacaaggaagaagagtataatagtgtgggctattcagtgcagtgttcctactaagaccaaagggacaggcattcctcatctattcattcagaagcatggacttggacttgttcagtgcttcaagtattgattggtcttccctcctccaggaaccacttctacaccccacatccctcgtctaccccattcctctggcaggctttctttatggcatttactacactgcagtggctctttcctgctggagtaggagtctcttcaaagccttagtgccatgtaataaacactggatgcattaaacaagcaaatgaatagcttcgagggtgaactggcagcatcgtgttaaaagactccatggcctcatggagaagacagcatgcctgtgaactgcaatgagcaattcatttattcattttcaaacaaaaatgaggcacttcattcacatttcatgaagtcacttttattgactcttaggatatttgagtgcaatgtgtattgctgaaaaaacgacttctaaaatgagtagaggagatatggagagaatttactcctgggtctggccattatccacttgtaagtcttggcttcctgtgatgccccaccctctcctccataaagtatgctagtcactcaatccacatgctcacagcactgttggttgccttccttactctagttctttctgtgtttgtcgaaggtgcatgcatgttcatgtgtgtaggtgtgtgtaggtcagaagacaacgttgggtattagcttcaagcacactactcattgagacagggtctcttattggcctggagctcatcaattaggttagactaactggccagtgagccccaggggccttcatgtctctgctgtcctaaagctgggatttcaagcacaagctagcatggctggcatttgtacatgggctttaggggttgtcaaatttaggttctccagcttgcaaggcaagcattttaccaactgaatcattactctagcctgcctgcctgtctgtctgtctatctatctatctatctatctatctatatctatcaaatctatcacctatctatctcctcccccccttatcctttagagaagggcctgatatgtagttaaattctcagtaaactatcattactaggttaagcaggtgctctaccaagttctgcatgaaaaagaaaaagacagtaatgcaggtctcagaagtgagaacatctcaggtgcttctttgccaccacgggatactaatacagtgtggggacccagtattccttgtaagaaagactacatggcagtttccttttctcttctttctccttccccttttcctccctttcattgttttaattttgacagaactctgtagttctggctggcctcaaacggtcaatcctcctgcttcccccttccaagtgctgatatttcaggtgtcttagttagggtttgtattcctgcacaaaatatcatgaccaagaaacaagttgtagaggaaagggtttattcagcttacacttccacattgctgttcctcaccaaaggaagccaggacagaaactcacatagggcaggaacctggaggcaggaactgatgcagagaccatggagggatgttacttactggcttggttcccctgccttactcagtttgctttcttatagaacccaggactaccagcccagggatggcaccacacacaatgggccctcttacccttgatcactaattgagaaaatggcttacagctggatttcatggaggcatttcctcaagggaggctcctttctctgtgataactccagcttgtgtcaagttgacacacaaaagcagcctatacaagtgtgcagtgcaatgcccagctcatgctgtgtttttaaacaaactacactgagccatcacatccatctctatacacctagtggagctcaccaacagaagagagttgtttcatgttaccttcctagaatccaaggataattcagcttctagctgctgagacacagttttacagcggtaaccttctcccacctcctgggacccttacttttagtcttctggaagacatgcagattggaacacaatgactctgagcagataagacatcccctgaaacccacctgcaggccggctctctgttttcagctgtcgtttgtctccaggtctgaatacttctccagtgcctgtattggcagctgaaaatggagtgctagccaatgccggtacattgttaccgcaaaatgcaactggccaccacacgttgtgttcagataatgggcaagaggagaatttatccaaacaattgtgctcaaagagaccacactgcagagtgaggcatttaaatggttccattgtacgattagtcctttgtggactcttcactgggaagataaaggtttaaaggaattccatttcttaaagaaacagaacttagaatcagaaatatgttatgctgtaaacctgcctctttaaaaccaaaccaaaaccgaaaccaactgtattaccaatgactcctggattgctttttgttgattctgtgagggttttggtcacaggacatacacagtgtatggagaccagggatgggtacttaatggagtcagtacggtggtgatgggcatgggtcctagagacagcaggcatgggaatcagctcactcccactttagaggagagtgtcttctcagcttcctggaggccttgtataaaagcatcagagcagattaagtagattcatagcactgtgtcagtgaagggaagcgatgctggttttctggaactgtacattccataatatgatgtcgttagaaatatttgttttgttttatatacccatcttttaaagttttagttatattcccacattctattacaaggaataaaataaagtcctagacttgattggttatttttaaagaagatcatgaccttgagatttgagctgtgttgtgtgtgtgtggggggcggattaggagagttagaaagagaaataaatggaaggtgggtgtggttatgtttcattgtatccgttataagattctcaagaataaacaaaaattaatataaaaattagcgtgctgtggtggctcatgcctttaatcctagcactcaagaggtagaggctgatggtctctatgaatgtgagaccagcctggtttacatagtgagtttcaggccagccaggactatataaagaggccctgtctcaaaaaacaaataaataaagttctgcctgtttcttgcttctagataatgtacagagatgtggaatcacctgtaaaagacaatgtgatattgtgtgggggactgtcaggacgtcacatttctatttattagaaactgtctccttttggaggaatacaggaaacaatccatattggatgcattgccttatgaatgtgattaaattttaacccaagttaattatagagagaatggaaaaggaaatttacagattagtggttggcaccttggtgtttatcacctatgatactgtcacaatgatgaaggggacagtcactaccagcaagtcaggagttgtgaagccatatcagaacaactatgcttctaatatgggcaggatgccagggaggagtctatacaggattctctgatttcatgagcatcaacatgagggcttggcacagcacacaacattagttcattcatgtgtgaaaaagcaagggcctgcctcattccatagtctttgggactttcctcaacaggagagagttggccagcaggccgagggacacagtgtgggaatcttcagccgggactaggtatccaagctgaaaggcaggctgggtacctgcccacagcctggctgtgcctcacacaaacacggaattggcaagaatctcatccgtctctgcaacaaaagcctgggtctatttcaaatcctcactttcctggcacacgatttgctttggcagtaaatgacttaaagtctgtctgcaagttcccttttttctctactccacaggggaataaaagttttcatccttttgaagaatgctcaaaacttagtaataaaactaacaactttttgaaagtaggcaaatcctctgaatcaggtcatcagagaaaacccacagatgccatataagattttttttttgaggtgttcaacatcattagttatcaggaaaaatgcaaataaaaaccacatttatctgctactagcattcttttaaaatagctaaattaaggaaaatcactgtcaggagaggagctagctctgtggctaaagcatttgccctacaagtgtgagaacccaatttggattccctagcatccaagaaaagccttacacagtagcttgagtctataatcagagcacctctaaggtgagatgggaggccgaaacaggagaatccctgggagcttgagggcagctagcttggcatgcacagcagaggacaataaagaatactaaagacagacagagaggactaacacccaaggttgtcccctgcattctacgttcatgtcgtggcccacacatattcctcaacatactcacccaactaaagatgagaaaacaactgtcagcattgagaaccaaggaggacgctgcgctcctgggactcctgctctgctggtggcaacacagaacaccatggctatgtggcaaaaaagcatttgggaatatcacacagagtttaatgtaagcgagtcatatggcctaggaggcccactcctgtaccaaagagaaggaaaaacttaggtttacgttaaaaaccctatacaggaatgttgacagtaactatttctataataaccccaaactagaagtggttataataaccccaacctaagtggttatcaaaaggtgaatgtataagcaaatgatgatacatccattcagtggaaaaccactcagcaaaatggaggacaaggcactgctatgacaaaatggggggtggggctcaaaacagttatgcttggatacatttttctgcaggaaaaaaacaaacaaacaaaaagcacatgttgcactatttaattcctaaaatgtaaagtagtctatagttacagtgatgggaatactcaaatcagggatgggtcagaaattagcactgaaaggtaggggtgggggtgtgaggaaatccctgggagtgccaggcctctgtgttcattactaaggctaagtgaagacttcaaggacaagtgaatgggttagaacgtcaccgttccctttaaacatgcacgcactattgtatggatggtgtgtagctcctgcatcctatggttttaattctccgtccactgttggtgtagtaataattgttgagttggaaacatcattgtgtagcaacctccaatgaagtggagccttcaggagatgctcactctgcagagagcacttgacagacactagatctctagatcttcgtctccgtttcttgccctgatgctgaaaaaaaaaaaatccctgacagaagcaactcaagagggagctgaccacttagtctagaaatagagggagtctctctctgtctctctgtctctctgtctctctctctctctgtctctctctctcttcctccctccctccctccctccctgtctctctctgtctctctgtctccctccctccctcctctctgtctccctccctccctctcttctctctctctctctctctctctctctctctctctctctcacacacacacacacacacacgtggatgtttgtacaaatgtctgtagtgtgtacttatgtgactactatcctgctctatctctgtcagccttatttccttaagacagggtctttcactgaacctggatcagagggcccagtgctaactgtgagctggggatttgaactcatcatcattcttataagcaagtgctcttgccagctatgccatgtccttaccctaaaggaagcatcctcaacttaagagacaaaataatggaatatgaagtnnnnnnnnnnnnnnnnnnnnccagtcacaccagctgccctcagtcacactactcacaccagctgtccactttcacaccactcccactagctgcccacaatcacaccactcacatggcatggcaaagggaaccaaactcacccaggacagtttcaaagctaaacttcttgatccagggttggttcctaaattttaccccatgtgtcaagcaaatcaatgaagggaaaagttgctcaagtcttagagagatgccagaaatgcataaattagatgctgccctggcaaagggccaattctcatgtactgcaaagctgttccacctctccatacttcctccataatgaaaagctcttacctttctaccaggagcttcacctattaacaaatagtatgaatgtttgaacagatatgctggcctgtgtaccctgcatagccactctctgcagactgctacagtgttacccatttctcagatgagatgagacctgtgacagcaccaacatttcaatccatcattataaagcctgagcctgtcctctcagccacttccactgtctcccttgaagtaatatgcttaaagtcggagtggataagaaagaacaagctagcttcttttccaataaaatattgaattaaatatagacattctagaccaagtagatactccaaaggattgccatctcaggtgttcttatgctgtcgaaaatgtagcacatgtactgggagagaatttgatggctttatttgggagacaccagaagaacataattgcacttgggttttttatttaattttgttatgtgttcactacctttattatcttaaacttaaaggagtcagctccatttggtagtagcattatagtcatttgattgacatatgctttaactcatattttacatgccagtctaaacttgaggggctcctactatgtggagatctttgaacaaaataacaatggctcagttatagccaaataattatcaggcatatgatgtaatgcatgtcagattctaaaaaagaacacatataaaagtgattaactcaacttatgctgccctaaaatacaggtgacttttgcactgagtcatccaatgtaagtccactctcaagagacagaattggaaaagaaaggagttcctggaagagggcacagcatggtccagcattataaaagaatagcaaggtataattcttttattgctaacggatccaaattatttaaagggcatagtaaaagatgaccccagaaaagcccgttagaggcagattataaaggtctttgcctggctgtatacttagatttatggcaattggaagtcttgaagaatttgaagctagaaaacaccatgtttattattcatttttgtctgaaatcctgctagactgcaggtggaagagcttgacaacaaaaacaatagcatgaatgtcaggttaatcattccaagcaatacaagaatctaaagaaggctaccctctaaagtatgtattgttttagatcccattttacatgtgaggtcaagaagcagaagaatacagtgagtagtctaattctgcaggagggccaggatttgaacccagagagccccactgtggtggctcctgcatagttcactaccctgtcagacagaagggtgatcatggcatatagcaggggagagagaggaggcacctaggcaatcattcgtttggactccagaatagagggaaacccttttaaacagtacctggtcactgaggaggagaaagccagtagagaatgatgacattctatttcagatatgaagttcagaggacccttgagagccaagatgataggcagctggtaaaatcccaatcttgaaatccaggggaggcatggatggagaatcaacctggacatgaaatgctattgctaagtgccctagcttctttccatgttgctgtgcaagagcaactttatgaagaaagggttttgtcgggctcacagtgcaaagtacagtccatcaagcagggaaaccaaactggctggctgtatcacatccacagtcagaagagagcaatgaatgcattcctgattcttggttctagatctccattttatacagtgcagggtctcctacccaggggatgggtccactgactatttattaagatggctcctcttcccacatcaatgaatgtaagcaaaataatcccccagaggcctgtcaccaaggtgattccctattctgtcaagctgcaacttgactctgaccggcacagtaagcctgcatcatcccacccaagacctcaccctggaggggtgcagaactcaacaccaggagaggcacctcagaacagagatgcccagtagacccaggcccagagtctccgaggagctatttgatctcacctgctacactcctcctcaaatcagaggctttcatagtcatgtagaaacaatagcaattcctttgccacctgcaaaggtgagcattgaaaactacgggacgcagccaacacagtgcttttcaaaaataagtgcccaataagcagtaatagtaattatcaccattatcatcatcatgtaagggatttgttgctgttggaaaaacagtgtaggcagcaagcagagctccaagcccaatgactctcagcaagtcctctgtgacactcggctacgggaaatttttactgtgtttccaatccaaggaaagaagaattatcctgaaactaaaaaaaaaaaaaataaatgctctatgagaaaagaaatcagataaagcatgcaatataccattaaataataccaatattgaaacaaggtcaactccacattctcttggatcctatgtgcccctggcaaagctgtgctctggctcatttcatctaaagaagaaccagaagcacaagaaagaacattctcaagcagctggaagcactgccctgtgacagtccacttgcctagcaagcccagggcactgagttcaatccccagtacaggagaaatcaacccactaaccaactctccctctctccctctctctctctctctctctctctctactctctgtgtgtgtgtgtgtgtgtgtgtgtgtgtgtgtgtgtctctgtgctgctgtctctctctgtctctgtctctctctctgtctctctctctctctgtctctctctctctctctctctctctgtgtgtgtgtgtgtgtgtgattctctatggtctacagagtttgattaggcttgcttgtatgaacagggggtgtgagcttcttattgtctacatcactgaagaacagtgacttctgccagcaaccatcaattgtgattctcctcagctgagagtgaggtctcatgagtccctccctctattcattaactggcttgatcttatggtgtgagttcatgtaagttttataacaaagcaacaatgttaatgatgactgtgctcgggtctagaaacctagctctcctcgccaccttcccccatgtgccacagtctcatcttctcttatctgcatccatcacactttttggttaaccagtaaacagggttggcatctcgaccatagacatgttccaccctggagtagacacatttatacactcgtgccggctgggcttcctttgtatcctcacgctgtatgttggacagtgtatactctgcaactcagcatttaaattctgacctcttcctttgctagcatgcacagcatggtcctcttgtatgggacaaccctcaacagtgatctgagcactcctgtcagccaggatcactagagaactgctcataccacacctcgtgctgtactgtacagatggggtggtcaggaggctaggtgtaagtacacacatttagatttgtgacatttttggtttaccatctgtgagttggggtgtaacattcatgtaaactgaggaaacttgaatttaggtagagttttttttaaatccatttttattatttttagttgtgtgtgtgcatgtgtgtacaggtgagtgcatgtgcctgcagagatacaaatttagatcccctagactggagttcaggaagttataagagcccaacatgggtgctaggagtcaaacctgagccctctgaaagagaggtaagtgcttttaaccacggaaccatctctctattcccctagagtgatttttaatgtttatagaaaagagactatttaaatgatttaagctgagttggggtttgcagtatgaggctcaacatagtatactggctgaatggcttcctatctggatgatggaagggtaccctcataggtcctcctgagcctcctgagagcaaactgctctgtagaataagggctggaaaaagcttaccctgtaggagtctgaggcaggaagcccccagaaccagaagaaaaccttcttcctctcagattcctccatgcttaaatactgacattctccaagccataacatcaagagaccattcataaggccagctccattatcagagagcatcaatacaagggtggctctgaagcctgagggattctgagttacagactgggtttcctcccaagtccaaaaggcatctaatgtgctgttgttatcaaaggcttggctctttgtggtggaagaggggtgcatggcagcaggtttttagtactagaagagccatgcaaggggcagggatttgctatcattgtttgagggaataacactagagaaagagggtagggagttgccttccgtgtgccaggaggactttaaatgtgtttgtctgaatatctctaacctccttcccaagaatcatggtgcagaatccagggtgactcttgttgtcaagccttgggactggaggggtgatcaagctccacaacctccaaggtcaattttaatttggagaagctgtgaacttctcttagttacttgtggtaagaatgcctgtatatctgactacctatgccaccatttgcttatgtgtattgtccatccatccatccatccgtccatccatccatccatctatgcatccattcatctatcgatgcattcatctatccatccatctgtctgtccaaccatctgatggctatctatccatttccagccagttacccagccaccctttatccatctgcctatccatctgttcacccatccatctgtccatctgctagccattcatccatacatccttatatcctcctacctatccacctatttatccatctgtccatccatccatcaatccatgctttaagactcagcaaagtaatttcactcagttaaaattaatgttatttggatatatttattaattggctttcaagagctatcatgttaattgaactaaccaaaggcattatatacaaatccataattttcattctgcttaaatattagaatttgatttttcattttctcacttctatagattggcatcctttttctaaaagtttctcattacatgctaaaaggtcaagccatgaaagtaaagaaattgacgataactgtgtctagccaagcatctcaatgagaacacatgcatgttatacaggaaacgaaggactgcaaggtaattctgcaccattgtctctgagttgggggactgacatggacagctgtctaaagaagagtccaggcaagaacatgtgtcttttgttccagcaggccaggacttatttccttagcacaaacctacttggaaagggctagtaatggttttactgtcctagtctgaatatgctttcttttctgacacttgggagctctgggagataagagtcctacagcagaaaggatatggtagaaaatggttctctttggccaaaggtgaagtcactcccagcgctgacaccagtcacagctaactgaagatggagctgagcttctgcctctgcatctatggtgttcccccttaggtccactgcacccccatttggggggctgtgtggggaatacagagctgctccactctagtttctaagctctgaaacacaaggctgtgagtggtggtttgagtctgaagaaaacaagaacacacacctaccgccctggtgcctacagccggttacacatcttaacgcacagcttgttctaacctacatttgtcacaaaggcagccagccatcttgcttatgaatactacagtcccacttggggaggaagtccccttttactgctcagacatgtgagtatcatataatgtgtgcatgctggccacaagaaatcctgcagtagcggcccgatgaccattatgctgctgagtgtgggggaaatgggcagagggaggcggctgtcctgcagttactgcaccattgccttcgagcctgcctgttcctagtctgtaagcctcggtagtgggccttcgagtgtgcatcctgcagcagctgcaggggcctgagagagcacgccacccatgccggcagtgagtttggtaatcatatataatccaccctgcagagggccgccctgtcattgttcaggaccctttcaatgtcttgcaatttcctttgtctctgtacttctggtcgcgtcctgaaaactgtcaggcttccgtgtggctgtgaagaccggacaattctaacctcacaatggagctcaaattggaccagctgcttcctcaatggagcaggctgcccagctccgaggcattaagcccaaaattatttagaaaattgaagcctttgacttgctgtggattaatgtgattaagcggggcttgctttaattcatactcatctcttcctttattaataacgtctcatcggtcagggccgcatgcatgtgcatgagactacagaaagttagggtgattgcagtttgtccataagagaagtctttcatgtttcagaagcaactgattcaaggcttcggctggggcacactgaaaccgcctgttattcttaatgtttttttatggaaacctaataagcaaatgaaccattcctccttctccccctttatccccacccccgtggaggtccccatttgatttacagctccccgtaagtaataaagaaaggatctctttttcatctgggttgtatcagcgggtgagatctggacgaaatatccttcagggttaagggagatggaattaaaagggatttgagggttttttttctccccatgtaattgaaagtgtatcaccaccacaatgattatgaatcatccagtagcttttctaaataaggaagtattacctcattgcgtgagactgtggttttttataatgacagcaacagattatattgggagaaattagggcagtgccttaaatcagagttttaaggtctgtgaaattattctgatgatgtttattctggcaaacttaagatggcagcaccgccaagtcttatgtcagtctctcatagcataacaaagctaacgagcatatatgtccaagtatttgtctttaaaaaatacttactttggtaagacagccaattgatttacatagcgtttctgcactaggaactgttcacagggcttgtctggtggcaatgggttatcatctttagcatctgagaactagtcatagtaagcatgtgaggtgacgcctatgccaatagctggattgccttgtcccacactggatacatatctcagaatgatacattgttactgtcctcatccttgtgtcaaaacactgacaaaaaacagtttcaagggatgaggtggctcatgttttaagctagcactggactcaggctgagagcctaggcagcaaagtcctaagaagccagcatcactcactgaaccatcactcagtgaaccaagtaaagaaacaaagtaacagtgaaaagcagcagaggggggttctttaaatgtggctacactgggcagaggggcaaataagaccagagaggcttaggtttaagataggatgcaagaggtgtattgtataactaggcagtcctggtgaaggtgttggtatacccatcatcatctctgctccactcttgtctctttagggtatctatattcctgccaggatagttacaccatcatgatggggaaagagtcgcccagcttctggtagtggggcatgcaactaggctttgggccagaagcagaggcagaaatagactttaaattctaccctgcagtgactacattggccagctgcacctcagaacacctctctttatgggacttttgcagttttaggttgtctctttgagttgacttaaaagtactgaggtggctccacattcctgcctgactcactttacatctggattgatcctcaaaattccgagttgtgggtcttgcaggctcagtttgattcgtgctccaatggacagtggctgtctccatgagcatgcctggtggcctgacacttggattagataggtttcttttctaggagttctttttgcagaaggtatttaggttgctgatttatgtgagaattctgtgaattttacctcttactgtaattgttctcaagactctgctactgagtggccattttgaatgcctcttgaagcctgtctgttcaccctcataatgagtaaagacgggggtgggggggtatggacatctattttagaaacacacattcttcaaggcttaaaaattggtaatattggggttatgaagatggctcagtgggtaatggtacctgctgccaagccagacaacccaaatccgatccctgggattcatatggattcatatggtagacagaaagaaccagtgcctgcacgtgtgtcttctgagactgctgtgaccagcatcaggtaccccctatttctaatatgtgttcaccctcgttgttgggcagtcccagacctaccaggattgtaatgcattaaaactgtcattgttgtaagaaaaagtattaacattttcatataacccaacatccagaaactgagctgttttgttattgttcatcaactggtgggaccagctcttcttttgtgtcccattcagaacctgtgatgctacgagcaatgctttctggagtgtgctccctcgtatattccaaggacctgcagactccttaagtagaggccagtgtctagttttggctttgtcttccacaataccacacagcagtgtaaagcagggcatgcttccagtttgcaggtgtgtgtcttaaattctccttttaaattataaagattggaggtctcataagtgggtgatgtaagggacacaacagcaatcgcagagtttagcaggacagtacttgtgctaggtcgtttgttggtgactcattaaggatgtcagcgtgattgacaggagattttcctgctctaggcttttgtgtgtgtgcatcatctggttccattggaagaaacaccaaatttggaatcagatctgattgcagattcagttatgccatttataggcgcgtgaccttggcaaaaatattgaacattttgctattttatttgcttttttttaaagcctgctttataccagtgatgtgagaatttaatgagctccaagatccactatgtagttgtttagaacgctctcagcagtaagctgcaggaatctcagctaacattggcttaagaatggggatgtgtactcttcttatataaccagaagaaatcagaatgttcagaggactaaattcagtattcaaaaaaaaaaaaagaaaagaaaaaagaaaaaagaaaagtatttagaataattcagttcctctaattctgctctgctatgtgtcatcacgttcccagagtgaccgtcacagcgtcatccatcaaggtctcaaccccagaattccaacgtcaagagacagctttttgtcctttagtgaggagaactttctagaagtcctccaacaagccaccatcttgtatctcttagccagagctgtttcatgtgcccagatctaaactaatatctaaaactgtgaataaaagagctatatgagaatagtcaggggatgccttgagacattgcagggaccccacctgcctgcaattattttccctgaggaaggaaaatctacaggtggatagctgttgggtggccagcatgttggaagccaaaccatgtatcaggacttgtctgaccatctaagatagtgactgtggtcgtttgagtgagaaatgacccccataggctcatgtttctgaacacaggtttcctattgctagacttgtttgtgagattatggaatccatagaaggtggagccctgcacattgaggtgatggcacttaggcaggcgttaaccagtgtacacctgcaaccctggtgtgggttcttccttagggtgtttgtttcgtatacacataagccaagcttctcgttattcaaccttatttcatatagattaaacatagtctccattaaaatgctataggatttaatacttagatacatccatttggacaaaaagtgttctctgtgagtctttaaagtaagcagctatggagaatgttatagacagtctacctgcccactgtacaaatgctaagacaaaacacctcttccttaaatgctgggctcacaagagaactgttcccacatggtgatctgatttgtcttcctttcgatgacttcatatggagacctgatttgcttacaaagactcacagaattaaacttagaagtctttctaggcatagttttacattctgaagacatataaagatcatgactttgttttactgcataatggctacaaggtgaaccctgtaagtgcattgtgtgtggcagcctcttctagcagtattcctcaccaccagaccatgaatcatgggcatctctgtgacaaatgaatgtgacataccctccccccatccttcccacccagaaacctaagaagagtcacataagtggatgttttcttatgacctcagaccaaatgaataggctcctggggatacctggtaacttaccatgcattcctggaatctgggagaatgaggtaggggtgtagttactccctggaaggatagagatgaactcaagggctcgagctgtgcatgctactaggaagagtacacaatggtacatgctacgtaggtgcagccaggcttccagctctaagcttgtgtatatttcagagttagaccctatggaagacagtcactatgacatgtttgtaaacacttctctcctgcagacctgaggatgtgtcagtcaatgtaggaggcactaaagtccttgtactcttggaaaactaagacacacatgaggttgttacttcaaaagaagggatgcataacctgttatctgtccagagggctgggaatggattcggttcctagcctggtgacattttgctctatctatgtggttgagaccaccctggatcctccccagaccctttttatgagcttgtcaatctatagaatctatccttatagaaagtgtcacatgtagtcaaactatagggttcattgtggaagatgtcacatgtactttacagggacctccaatgtagtcttgttttagacattattgtgcacacagaattgagttaattatcacttggaacattgtcaccaaattatgctgtgcttaaatatgcctaaaataaactatttggagtcagactcccgatgtttgaaccaactccagctatttagttgtattgaaccagagtatctccttgcctcctcaagattcttactctgatggccatggtggctgcagatccagtaaagtatttgccacacaagcatgaggacctaagcttgattcccagagttcagtaaaatagctagatgtgaaggctgtggaaatggatcagttggtaaagtgctgtctacaagtattagaacataaggttatatccccagcatccacataaaatgctaggcatggcaacagcatgtctctagctccatcactgagggacaatgacaacagagacaggtaaatccccagggttcactagcaggcctagctagccaatcagtgagttatcaattctgtgaagagaccagaccctgtcaaaaaaaaaaaaaagatgaaaagttttaaagaaagatacctgatatagacctctggcctctataggcatacatgcacacacacacacaagctgggtgtgatagtggcaattgtaatatcaacattggggactagagacaggtgaatctataggacttactggctacccagcctagcctgcttggtgaattctgggtcggtgagagatcttgtttcaaatatcagaccatcatctatgctcctggtatctgtggaggctagaagaggacatcagattccctgaactggagttatgaatgactgtgagctgccatgttggtgctgggaaccaaacccaggtcctctgcaagcgcagcaagtgctgttaactacttagccatctttccagccctttaatttattcaccaaataaaatttccaaatacagccccatcctgaggtcctaggtgttgggcttcattatatagtctaaggcgaaggacatggtgcagcagcctctgactccacaggttttagtcgacatctttgtgataaaaatgaccatttttaagtctacatgtaaggcaggcctcttagcatgtacaccatgtatatccctcagacaggatggggagtgggcaggccctcgggaaggcctcaccagccttatcaatgctgctcctgggtcaaggtctaacttttaattaacccagccctctcgtggtgctatggccatggtttattttctagttcattttaaagtttgctgcagaaagcaatcttgtttaacttcctggtagataccttccaagaatcagggcacaatctccaaacattgttttagattctgtcatttacaaggctgaaaggtaaaggtttggaggttaaattttaatagactagggaaagggggcttcagtctcaaccttggcaatgaaaacaattgttttcaggtgtacatttctcagtggggtcacagagaaactcagaactgtcaacaacttgtgtatttgcatggataattaaagttaaattctcaaatgcagtgttagtaataacttgttcttaagggtgaattaaaagttaatgctgtagttttgcttttctatgtgaatcactatgagctaggaagctgtccaggactggaccaggtgctaatttataagaaaaatgaggcatttgctctacaaatggaattgtgtaaagtgaactgaagttgcaaagcctagggaaaccgaacccatggctctactgcaaagctcctacctcactgcagagtgaagatgctgggtgtccctcatatccagtcttactcctctcctgcatccactctgggaaggcagcagttatccggcttctgctcttccttgacagtgtgtttgtgcgtgtgtgtgcgtgtgtgtgtgtgtgcttgcttgcatgcacacctacacctcaaagcaacacatctattttgcctgtctgagccattcgtaagtgctgtaatgctgtccataccttgaataaatttcttttcaccaatgttttattcttgagatttacccatgaactctagtagagtggctttcttttcctctctcactggccacttcttctttcatagttgtttttcataagcatccttttaagcttacttacaattgttgactacagaatgtcccacacaggcacctagatttgaacagttggtctggcagacctatctagggaagctggggaaactcttggccatgaggtctctctggcagatagacacgcatctgtaggggccagatcacagcgccatagcccagggctgctttccatccagctctgccacacacttaggctgctatgggcttacctgccactgtgcctttcttaccatggtggatggagttcttcacactgagccaaaattgcactttgccacaggttggtgaagattatttccacgttcccttctgtggctgcatcctcacgggtgctcctgctaactgcccaggttactgtgtctgtctgcaggtgtccaggttgttgggactctgtagtcgcctcagccactgattccaaggtaggatgtccctttacaggaggtattttgttgttgctgttgttgattctatggtttttaaatggcatcttgttgtgcttttaatttgcatcctttagtttattctaattttatgtgctggttggccatttatatttttcatctgtaaaatccctatttataaatatggctaattttcttctactgagatttgttttgttttgttttgttttttgctatacccttctttattttaaagagttatttataaattctggatgctaattctttgatacttttgcacataacatatttttctttattgtgtgttgtgataagcaaaagttctaaatttaatctttttcttcatagtttatacattttatatcttggctaaacgtatttccctaacccatgatcacacttgtagtaccctctgttggctctaaaagacaaagatttttgccttttataataacttttcatatttagagaattgggttttaattattatactgggatctctttttttttttaaatgaacaatcagctccgtcagagatctaccacagagccttagtcatattctaagcttactgtttgcctggctatctgagctcctgttttatccttgggtctatatgtctacttctccatcaaagcgccacagtggtcattagtgtttgggaagaaaggcctttcctgagatattttggggggggaggggtgcctgggccatttttgaatcatgcactgctctgccacacacactcaaaaatcaactttcatgaaatgtgcccaatggtgacttttattccgtttggggacaaagctaaactgcatgaaattttagcattctcatgggtatcacttggctcggtttactgttaagtttgatttggtgtctgcactttggttcattgatgaaatgagcttctaactttcctttctcacactgtgtttatctgattttgacgttagatcatacccgccgtgtagaatgtagtaggagggttaactccccttttctatcattttgaagagctctcagtgatgcatctattttcagactgacagtggtgacagttgcccaactcttgatattctaaaatccctttgaattgtgtactttaaatgggtgaattatatagtagcaaattatatcacactaaatttgttaccaaaggggaaagcatttcctactaaaatcaccagtaagttaatattgccctggtctccctactttaattctgcatgggacaattcttatcccctttaccccaattcccaccttgccccagtttctctcctctcttgttcctccccattggaagtatcaattaagaaagtttaacttattatcacaaagggttgatttaataaaaatgagttgggatgatagatccatcactttccagcaaggatcgttgtgtgccagcagtctaggccgaaacagcttgacagcatggcatcccttgctcactagcaaactcagcttagaccctcaggtcctgagagcacaatgctggaacaatgaaggtctggggatgtgggagccagcacactcagtataacccacttcaggaaagtgtgagacatacagaaatgtctttaaaggacaattctggcttgtgctacagggggaaaatggtatcaaagctacacaatgaccagcctctgtggagtgggtcctctgtagggaattctactttgttctatatgccagaaaccttgaccccaccctgtgtgtgaagcaaggggctgctttgtgaaggggcgctgatcaagaccacagccattattgtgctgggagccaaacatctgaagcttatcatcacacacaatagtggaggcttcttcgccacatttctaattatatttccaatgcttttgagataaagggacaaagaaatatgggacttacttttcaggttttgaggccactctgaagtgttctctgtaaaatggagggaggtggattttgttctgtcatggtgccgtgaacaagagtctctgcttctcaactctccacctttgtaaatgtgaatgtcagagatgcattgaaacctaaaacaattcatttgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaacagaaaatagtcctggtgacacagggctggatgccgtctctgccgtccggtctgttctccaatcattctctccttctcagctcctgacaactatttccccaggctccatgtagtcttgtgcatacctgaacttgagagtggttgttttttttttaatttaagtttcctttggagtttttctaccactaaacttgacttttaatagaagctttacatcttttctagctttatttcttctataggttgctttttgactaaattattcaattacaagataaagaattggtgtaaataagtttggggatgatggaaacttttttggtgagtgtgaccaatggctatgggaagagaatgctggcaccaacccagacagagccagcacctgggtcctatgggtgatcaccatagaaactggaatggatcaactgcctaagaatcctttccattcggttgtgtcccaacttggtgtcatggtgctgtcatttttgtcacccatggcttccacactctatccctgtgtgtttaaattgtaccctgccgtggcttcagtgtaatatttggtccccaactggtgttgctgctgggtgggttatggaacccttaggagatggagcttttgttggaggaagtacttcaccttgggctggccttgaggttttagagcctagacacaatttctgttgtctccaggactattgatgcatgggcagatgcctctcatccctgccaccgtgtctttcgcactacagtggattgtgcccttctagaactataatgagccctctttctagaactatgatccacaatgagcccccttcctagaaccatgatccacaatgagccctctttctagaactgtgatccacaatgaaccctcttttcttcatgctgctcttgttgtggtgccttacgacagcaacagaaatagaactgacacacacccacttgatgatctttctctatggcaccttctctgctatctccctttatgaactttggagaatcatctgtaccattcccacagtgcctagttcatgctatcctgttttcttgagttctctgtgtgcctgcttagtaaactgtggccttagccaccatcctgggatcatttttattaaattcccaccctgtgaggctggagtagagaaaattaagtattgggctgcttggtagtcaacaaaaccagtgttttggtgtgtgtgtgtgtgtgtgtgtgtgtgtgtgtgtgtgtgtgtgtgtgtaatcctgatggagtgccctctgtgtttgattatgtaatcctgacactgtgtccttttgacatctttattataactgcattgtggccgaggggcacaagactcagggaagccaaggaattcatctgagttacattctcactgcagtaccaatgtccttggcacaacttctcagcacttcactgttgaaaccattcagtatgctcctaaggacatgtctttggagtcctaaattaattactagctgtcatcaaagcttactaatcaagtctaaaagattcccaatatcaatctagttacagctgagtttggctctataggaagccattggtagaataatttagtggctaccccatagctaggagtttatgggaataatatcatggtcattgagaaaggtttaattagaccccagtgagctaagctcctagaattgcctggtttggggctatacatatattctaaaggacatatgtgtgtgagtgtatgcatgcatgtatgtatgtgtgtgtgtgtgtgtatgtatgtatgtacgtatgtatgtacgtatgtattatgtattcatgtataaagatgtagtcttggttgcttatctggtttgcatggttttgagataaaatatcagatggatttatttgtgtgccctgtggttcaacagggatcttggacctgaacaggtgggaaaagccaaagctttcccacacaaccaatagtatttctatgaaggactatgttctgaatacatctgaaggcttggcttttagttacatttcttttaaaagtagttaagctggggctgggctagagctcagtacaagtgagcatataaagggacttcagctcaatctctagcaccaccaggaaacaacagcaacatctaaataagtcaaaaccattcttaccctgtgatcatcggggcgtattctatgttggctgtttgtgtacaatgtaccatgccaactaggagagtatgtgatcaccacacaaactttaaaagcaaatgccatgtgagtccggtgctgtgtgggcagttatatgtgaatggctccaggtagctcccaggccatacagtgcatgtgactactggattataatatataatagcagcctcttgtaagatgctgtttcttgcccctgttattcaaagctgagaatttttttatgagtatgaaaaagtacctgactaggtttcaagacctctttgccaccttggtatcagaggggtctctggctgttttctagtcctcatggggaacaaacactttctattgcaaacctgctctcaacagcttacccagataaatccacccaagagcttatcctaccaatacatctgtgaaaacccagatcctaaatcttagagtctcttggggatgaaggaatgaagctgcattgtaatgtggctcatcactcttggtgtgtgataacagcaataaattcagtaactgaagacggagtgtagattcgattttggcaggtacattcctaaagtgctttccattgcctgtctgtacttgaaggcttatgacacagtagttagtacagaatggatgagactgtattggcctcactatttcacagacaaacaacttgttgttaaaaggaaagttagtgaatgtcagctgagcctcaggtgtagggctttggactcctagttagtgcccacttaacagcccacaatgctttgaagcttgagccttctgaagagtcattgtggagaggtgaatagtctctgaaaggcacaacttggccccagtgtagaaggaagtagatttttgactcagtaaagattaaaaatttcatcaactgggatattctaacagtgctatgagctactttgcacagcagtgtgtgccctgtgtggatggatggtgcagtggggtaagatacaatgtgtaggtaaccttcaagacccttaaaattctgagactgtttacagccttgtgttcaaaatgcccagttcccttttcagctctgcatagacgtacccatggaggtcatgaatgtgcccaggcctatcctcaggtacccttggttggaattctagttggaagtcaaggggcaggggtgagaatgagttttgaaaggtgtcacagaagatggaagatagttttgagaacttgctgttcttgtagagggcctgggttcagttcctagcatctacctatagcagctcataactccagtttcaaaggatttagcaccctttttcagtctacaaggacaccaagaacacacacagtcggtagtacacttacatacatgcaaacaaaacattcatatatataaaataaaagtacataagaacccaaaagtacctagatgctgtagttgtgacctgctctccttgtgtatcccacatggaaaccatcatgaccaggcacgccagcctcatttcatactgagggctctaatctcatctgttcaaagaatcttgttttctccgtgtgcaatacctgtgttactagcaggccatccagttaagtttgcatttgttctttaagctctgaaaggcctgtgcctggcagacttgtctgctaatatctataccacccacctgtttcatggtagggaggtgttagtggtgctctgcaaaatgaacatcagctactccacacatcagcccttcatacactcactgtcctgtaaacccagcccactaggtgacggctgcctctgcaatcagcatgctgcaaacagaaacgagcaagctgcccattctcatcccaacctgcacctccacattcagtgttaggaaacctctagtgtcaccaaaagttacagtgaaccgcagtctgcattcttgggggattttcctgaggaagtatttgcctgccattatagcagtcccctgggagaagagtctcaggatggtgtgtccacataaaatacccaccagcagattctgaaactccccagcacgtctccccatggacagccagatttttttttaaaatacaatcactctaacagattcccccccacccccatgtttcaatcaataggatgctttttaaagcttacttttctcgttggacgctctaagtgacggatgagacaaaaggaagaaagccaagataaaatggcagcgtagatgctcctcagatcctataatgaactccacagggcatccaattttgatgtattaggacttttttttataatgagtacattgttagaaatcgcattttctatcggcgggagctggagatgaaactgagctgacaccttacctctttgtagttaattagcaggagaaaagtagtgttttgaatctcgtgtgggaaaggggaatattattcatccaccctctctcccccgtcttctcccttcaaacacctgggtctttttgtgctcttttatttggttccgtggctcagctgactctggttggcagggaaaggatgcgggatattgaagaatggttattatttaatggggaaaaaaaccctctgtaactcacatctcccattccttcggcctgcagggtaaataaaatagatctggtctttttattcaaaagatcagttccttacctagattgtgacatgaggcaatgcccgtgggacaggggctccttgttattctattaccattcatcatcattgaatcctcaatacctggcccagcatgtgggactttgtaggatttgattcatgcttataaatcaatgaataaataagatatcttgttggcccatctgtacagtgttattgttgttttggttcatctggtatcgtcgtcctctgggaggtaggatgtccattttaggatgggaagcgagttcatattagatttgggaggtcagaggcagggagatcatgcatacatagcatgtgccattaggctagtggacagtgtgggggtcttcataagcctccatctggccaaagactagatgagtagtgggaagattcagaccatctcggtatttggtccatgcgtgttcattcacattgtatcttgtgccctgtcccagggagctgcagggagagcagctgttactgtctcttctctctcggagctccttgtgtcctggatggggcattagaacatacttgaagactgggagcatggaggtacctgcagagagctgacccttggggctgagggcccgggggaggaataatcatttgcacaccttctgtgtgctgggttctgggtgcagcactccccctcacagagacctttcgagtggcctcagggggaaacagctctcctgcagcattaggccttaagctaagtccttggacttcggtatacaagttcttcctgtggccctcgactctgcatggttctggagaacgctgggtatcaagaggccctggaagtgggcaggggttttggattgcagattagaggctctgtgtatgggggatctgggattagtgaaatgaggacctggatccaggagagtgtgggaaaataagactgggatcacatctatcttggagggtactggggccagaccagggctccaatacagaggatggggagcattgttgattgctaagttctttttttctttttaatattttttcttaagataaggtctctcttttttttttttttttttttttttaaagatttacttattcatgtatatgagtacactgtagctatcttcagacataccagaagagggcatcggatcccattacaaatggttatgagtcaccatgtggttgctgggaattgaactcaggacctctggaagagcagccagtgctcttaaccactgagccatttctccagcccccacttgctaagttctttgtctcttttgctcatgagcctagccttgacttattttcttccttccttccttccttccttccttccttccttccttccttccttccttcctccctccctccctcccttccttctctttcctttcctttcctttcctttcctttcctttcctttcctttccttttcttttcttttcttttcttttcttttctgagacagggtttctctgtgtagccctggctgtcctggaactcactctgtagaccaggttgactttgaactcagaaatatgcctgcctctgcctcccaaatgctgggattaaaggcatgcaccaccactgcccggcagccttgattttactatcaataaaaatctatctagacagccacccagagtgtcagtgatattgcaagacacacagagattcagaagcaatatgcaagtcatgcacaggggttcctgtctcttattgacaggagtaggtacctagggaatggacaactgtggacctttaacaatgacaggaccccaagagcccctctggacaaaaagttcaaccctatttccatttaccctccttcggactcacccctgccttctctagccacaaggaacatgccctctgactctgtgacagtctaagagatgggagcccagtcattataccatcttcagtatcttcccatttcttgtttcattgagccatcttaacagggctcaaatcttgtcttcttcacactatatatatttgggaaagatatcgtggtttctgtttcttggttttctcctccaaagactgggaataataatgttgcctgcctcgaggtatttgtgagggtcagcttgggccattcatctccagggcttggcacatattccacctgtctatactgttattgcccctagagaatattaggtgcccattctccacctgctccccactgtcatcacagacctttgcaaagagttaataacctttgtttcctccatcattgaaggctctgagcctcctgtgccttctgaccatagagacagttagtgcaaaaagcaggaaagcagggctgagggcaggtccctcaaggtgttcaggagttcactccagatctgtggggttcaaactattagaaattttctagagaatcttgcaagggtacagattctcacgctaatttttttttaaataacagcaatttactaatcataacaacactaacaattattaataaagttgatatgggtgcattctgtgttctgatatgttcacacagcagagctgtttgtacagctgtcccccattgcaaggaagcggtccactttataatgagaagggagaatcacataggacttaggggtgaggaggataaggcagaagagcacgtcactaggttaagaggacaatgttgagtctgcaagtacccccatcttgatgaaggctgagtgggtttggggaaaaatctagtacggaactaatctcaagtataatcccatgcagccaaagctattaatgttcccattttgcagacagtaaagccaaagcctagagaagagcttcaggaggccaaacagttgctaaatagcccagaggctccccagctactcaggcttccaagcttccaggatctgctctgtccgggtggcccagccatgcttgcccagtgcacattccaatatctcttcctaggtgcttagttttcaggcaacagtagcccatcacccactcctctgaagtcaagttccttcctttgggtctggagggccaggctgaggagcaaggacgctcagaaaaggcacctacctggtccttctcctttttcctttcaagatacttttgtccagcagtgcgaagccacctgctgtgctgtagctgactgttaacaagcatgtttgcacatcgctcccatcatgctatttgcacgatggaatgtgaagacacagctcgaaatatttttaagatctggcctttttatctcaggaagcacaaaacagtgtttgcagtttggcctctggaatgaaattagctcagcgcattagctccttcctgccaagctggggcatttccataaagctcccgagtcccttgaatccttttgatcctttgcagtgtgtatttttgcacaggttcttttgctttggagaaataaagtaaagacactgaaaggtgagcttggccagggcatcctctgcactgtttgtcaatgcaaattggggcttgaacttgaatgatggtttcctttaaatggccaggctttttaaaacctctttccaaataacatcagtggcaatcatagccagaagtgtttgtaaggagtaaatttccttttcctgggccagcaagatggctcacaggatggagcttattctgaaaacatggtgacctgggttttatccccagaatatagaaggagaggaccaacgtcagagagttgccctctggcctgcacacatgcgacctggcgtgtacacacctactctctcacctcccctaccattccccacacactagtaaaaaaaaaaaattcttcctgaccccacattgctatcacaaaagaagacgctattttttttttttttttttttgagcgtgagtatccattgccacacagtgtgacttttcctataaatcactgtttgtgtggcatttgctgtctcctagtgcattcaggctcctctgttgtaaaatccctccttgggtgtaactgggtaggcaaatactttacctccactcaaaacttggtggtcttggatcctgttgcttcctagaggtgtgatttctgtgagaaaacttgtaaagagaccttggcttgctcatctgtgaaggaagcagtgcctgttttgcaccagtaaatagcgatatttgtatcctgtgttaatagaagcgaaagggcagaggcaactcaagtgtcctttggtggatgaatggataaactaaacatggtttgcacgcacacacatgcgggtgcacacacacacacaaaatgagacaaaaaaaaaaagaccttctagcatatatgtcagcatagatggactggaagacattatgccaaatgaaataagccagccaccaaaaaagcatatacgatatgatggcacgcatgattgccactgttatgtgtagccaaaatggtaacatttaatcaaatatgcgtttctcacattactctgccattgtagagatggcaaagtacatttcatggtatttgggtatcttcccattcctgggggggttgcactcgtgagctgtatttctggtcacatgatcgaagtacacaaacatcttcttggatctttccacgttcgcaagtgacctttctaaaatggcttggtcttcttttccccctgtcatgggtcacgtgaggcaggtcactgtccattcagcatcaccagcacactttcaagcagtttcgccgcaggtaataaataaaagatggtagcctaatatttcagcgtgcatttatttgcttttattgagtcataaaaatattgaacttttttttttttaacatcacagtacagttactgctttctatgtgaggagtctacttgcatctctggtttatataccttgttgggtttcaaggcttttcacatcaaatatgttgtcatgtttataacctatggttaccacttttaacattcagagggcctaagtactttgtgtatgtgtgtgcatatgtgtatttgtagttcatgatgtattcatgggtgtgtgcacatgtatgtgtgtggtggtcaaaggtcaacatcagatgttttcccacatcactctccacagtgtgttttgagacagggtctctcctggttgatttggccaggctaactggctgatgagttctagtgagccacccgtcaataccactaacaccctagcattcattacagataggagccaccatgccaaactttctcatatgggtgcctgagatctgaaccaaggtccttccatttatgaagtagacgctttaccactgggccatctcccctgcctgttaatgcttttcatattatcaagttacatatcactttagtagttaattcattcattttgacattgcaaatgattaaatcagatgtgtaatagaccaaaagtgttttgccatcaccaactgttatgcatgctgaatcttctaagctccccatggcctccccttttagattcgttagcataaagtctacttacaggattgagaaaaggctcaatggttaaagtgattacagtgcagtgtgagtccatagtttggatcagcagaacctatataaatgctgggtgggcatggtggctcaccgtaattactctgaaggtggaagcaggaatccccagagaaagttgaccagcaaattgacattggcaatccctgggtttgattgcaggatcctgcctcaatgaataaggcagaaaagggatcaggtgattgcagacatcaacctctggcctctgcatgtacagccatgcagatgcactcacaatacatacatacatgcaaacacaaacacatacataccacatgcacatgaaaatggaaaaagtaataaacaaatataaaatctgcttagatgctaaattctatgactatggtattggaataaagttgtatggatcgaccaattaataataaaattttattataatttcccttaatagctcatggggaaaaaagaacatgacaaacattagggcaaatcaaaagctaaattggccaacaccatgagattcagtgttcacttcagtaacatgaaacgacccctactgcagcagaaccctctcctcctgctatgaatgctgcagattaaaaagaccacagcagtgagggagaccagccctcatggtgcctatggggaaggaaaatgtggccagctttactgaggagacgtttggcactggacactaagaaatctttcaatatttataaatgttgattcagaaattcaagttagtcagctgcggctagagatgcctctgaagtgtgggaaaatatgtatgtccatggttagaaataggatcctgtgtaaatgcccagtgataagaaacgatgacaacgtagctggacgacccgatggagtgttatgcagtcattacaagtgccatttgctcaaactttcatggtaatgagtggtctcacctgctccttgtttctcctcttatgtttcttacatcttttcagcttaacattattcataaacattgttcctataatcaaaaagaaatttacatattaaaaagaatagagagaacaagaaatcctattccttttctggactcaggctttctgtgtttgccttgctcagtctcctttgacatagcaagtagcccctggttgtggagtcagcgggcatatgtttttaagcttctgtgtatcttggctgtctggtttgtaaaagggagttgctgtcagacacaactgaagtgagaaagccctcatgcaagcggacactctggcctactgaggcttaagtccagagtcctccccggactatctcactgttggtcatttgcatgaaagaccatcagaattcagtgaaagattagtcatgatttattaccagggcacaacagggctccaggccagccagggaggcaaagtgcagtgttggggtggattccacaggcttctgatctttctccagcagagctgggataatctccagcatccatgcatggcaattgctcatcagtaagacctacctaagctttggtgtcccaggattttatgcaggtaccagccatcctatcagcatggtcaacagagtgatccccggtgtggttggagtcagcctccaggttagctaaaagcatgccaaccaaaggccccatggttgtactttctgcatggtcagtcctaccttaaggctgctgtatatagttcacctcatcctaaggtccactgtgaacagcctcttttctactggatatctcatagtttttctcacaggcaccaagagaaaaggtcagacctctctttggacaaggccaattttttaatgatacacaaggcgacagaaaagagagcgtgcacagatttgaatacagagattgtgttgtgtgggaggggccctgttcctacatgcttctgagactggccaacaggaagaacatgaccttgacagctataagaaatacacaggcatgcacttcgttccccattcttgaatcttcagtattgcctgtgagaataaacccactacggtgaacactgcaaaggacattttctagcacagatattcactacagagaggaactgggctgagaaaatacaactcctgggtgcttgtctctgactcagtgttcagagcacggcaactgtgtctgaccactaatttacctaatagggatgagttctcagtctatttctgaaggtttctctctctagcattattctggtctgtccttcagctgagcctactccttgtagttagagtaatgtaaaaagaaattgggaaagtcccctttcagagttttcactcctgagcaccaggtcagactgattggctctcgatttcctaaaaatgagactagaagatgaaaatccaggctggggacatggttcagcagttatagcacttgctgtctaagggtgaggaatggagttcagattccacagaacccccacgtaaaagcagcagcacacctgtaaagtccagcagcagggagagatagaagatcctcagagcaacaagactagccagtcgtatgatcaagctctagtttgactgagaagtgttgcctctgtgaataaggtagaacagcaatcaggaataattcccgacgtcaacttgaagtctccatatgcacacccacacacatgaacccacacacatgaataaatgtgggggcagggggaaaatgaaaatggagttgagttctcatatgaaagacacagaagtcttcatcccgggaatctccagggaggataactatgcttttataaccggggacggagactgggatgagaccagcaactgaaatccaattacacttgtacccttccatcagagagaaaagtccagctcccatctgcaggatctttggagccccagtagcttacaatgacttgatgttatcagtaaaattgggttgtatgttctgtctctctgtagaaaaaactggccacgccgaagtcgtccgggttgtgtaccggccagagcacatcagctttgaggaactgctcaaggtcttctgggagaatcacgacccgacccaaggtagagtgatgagtgagccagtatttaattatcttactaattacagctgggataattagtgtttgagctgcatgggagagatgaaccttgaaatcacacaggagctcaagaatatgattgcagacatttactgactgaacggggcgggagcacatggggagtggggggtaagagaataaaggcagaggcacagccagcgcccctccccccattacagctgtcaggggtgggaaaattcccacagagaaagacgccagacaatggcgatcccttcacctttgattattgcattattcttccttaatgcagccttttgtctacaaaattaaagtgtcttcccagtaaccacagttcccctgatttatggtccctttgttttctcagagtttagcttttctcatctttttgacgttatcgggtttgttttttaaagaaatgtctgtgggtgattacaagaaggaacaaaaagaatataaaggtgaaaaacagtgttcagtagtccataatgcaacttgggctatccaaacgtttcatttgtcctctttggaatatgtcatgtggggatattaatgtattttgactacaaacagtatctggtggccaaatacattattcggatacactcacaagcagaaagtctcccgttgactaatactacagtaaatagtgaaagatttctccactacatcctagcctccttacaagggtggctttatcagtgccgtgctcggggacggagaggcttcttgcacaagcatcctttgcccagcctttgtctactcacataaacaagtttccctttggcattttctgtgagaggtttgcatattgacaatctcttaaggagtggagatttctagctacgtttgtgcttgtggtaaaatcttagcatgagcccaacagagcaagttggtgggtcttaagtgctgtgtgttgtatcaagtgtgtcccccaatttgccccactagaactacccactatgggggtcatttgcaaagatcaaagatcagagcgaaggcaagtacagcagagagagagagttgttacatcatcaggtgagcccgccaggtacataagggttaagacctgggtggagccgtaatggaaatgtctggttttctatggggatgggtcctgagatgaggtgagagctaagatgtgggccagtaggtcaaggcctacagggacaagagcactgcagtccaaaggtttgttgtcaccagagtttggaccactgggttgccctatcacatatgtaagaccaccttgacagcagagataggaaactctggctgttgcttgtatccaagagctcatgctagtgagtcttcctcgggtgctgcagacattcagttatgtcatgtaaagccggggtcaagatagaatgctccgagcttctaaaccaccggggagacccacattaggaatccagaaagcccaaagcaaggtcctgcagggcagcttggagcctggaacttggctgcctctcacaatgttctgttcctgtagaaccccctcacttcagtggcatttcagacaggaccacatcactatttttctacctttacatcctcccttaatatcttacccattccaccatgcccttatcagctcaggtatgttaacaggtatggcccctgaatgtccaggagagattcagtggacggcccttgtacactctattctcttccacacttaagttatatttgcctcagcagccttcctcacctcctcttggttttctttttgtttgtttgtttgtttattgtctgtgttactcttctagcagggtataagagtgtatgaatgcctggatggcctccaaagcaagaatttattgccttaaaattctggaggcttctcaaccgtaagtcaaaggccaggagtcagcaggctttctttttcctgaggcctctctccttggtgtgctgatggccctcttctcctctctggtcctcatgtagtctttcctagatggggttccttttcttacaaagacaccagttttattagtgactatgttatacttaattaccttttacaaaacatcagttgggctggagagatgactcagcaggtaggaatactgtctgctctcccagatttgattcctaggatccacataatttcatttctagcctccgagggcaccagacacagacatggtacacaaatatacacacaggcaaaacacccacacatgtataataaaatgcttaaagaaccaaaaactactcttttaaatctacaaatgcaaccacattctgtggtataggagcagagacttcagcttgtgaaaagaggagggatacactatgaacccatcacaccgtgcaccagagtggctgtacacggcacagctttgcctgctttttttctaggggtgtttttaataccattcatagactcatgacctggaagtcattttaaaacccatccaggtgagcatcctggaccgaagccttgactttcaatgtgcttcccatgccgttaccagggttactttggggatagcacaatgcagtggaacatgctaacagtctctcttccttctccctcttccctctcccccttcctcctcttcttcctctcctccccctccccctcctccttctccctctcccttatgaggtcccccaggaaccttctagatgccaggctagattcactggcctaagggatgacttcaacttggccaggcttttgtcctattgtttaggggatgggtagatgacttagcagaggtattagagtcatcccctagggctgttacacgagaaaagaaggtatctccctttgctggggtgccaaggctaaggtgctttgtatgtgctctgttagttcaccaggaaggaagataaacagtgacagagacatgtaagatgcaccaggagacagactctaggggtctgagacctgttcttcctgcagctagctgcctactctgcctgctgtcacatggcttcctaagccccagagccacgtgctcttcctgctctttagctagactcaaattcctatgccttcaatcacagaaattctaactcatccattcatctaatttcatctctgtccttaccatattaggactgtggctatgctcatttataaatcagaggtctaagacatttgtctaagactaaatagtgcttcttcaagactttgtggcttgattaggggtttcctcagtaattcagaataagtattcagggtttgagagatgtggtcagaaaatgtgtgagactcccctgttaccatctctgaactactgtggaagtagttgtccatctaggaccttgtatgtcctctgtttgccaggaataccatttggtgatgctaatcactaaatggtccaaataggtgggatgaatcagcccctgagacagggaaatgtgtttttttttaatttatttatttataatatgtaagtacactgtagctgtcttcagacacttcgtaagagggtgttagatctcattacagatggttgtgagccaccatgtggttgcttggatttgaacttaggaccttcagaggagcagtcagtgctcttaaccactgagccatctctccagctccggaaaatgtgttcttgtaagaaagtcagaacccagtggaccaagatcagctgagcactcagataagtatttgtgagactgcatggcatcatcagaccaagtatgagtggacactggaaaaactgaagccaaaactcaaattcagaaccctggatcatattccagtgaccacggaagcttcaacttgtggtcatgtgtaacttcagaccattgcatgaaagataggcagtcatcaggagaaagttagcctgtgaatgaaagtaggttcccctcctccttgtttcccagggaaatggctgtgcaaagagagccccaatgccatgccatgggtgagggtagggaacatatacaaggcagctacctcatacagagaggaaattttcaggagggaacagcatggtaggtgtggacaactctgaactgtgaagcaacaacccctcaaatttcttttccagaagcaaaactaggcaattcctaaagccacccagggaatgcttccacctgtatgagtcctgcttgtccacaaaaaggccgacagtgccgaagaagttgaggaggaccacttggcctttgatgctaggatacgcccagaaaacatgcgtgtcttccccaaaagcatgactccagagacacagactgtaaatagcatgttggaagattgtagaaccttcttgatgaagttgttaaaggtctgaatgggccactcacagttttggattggagtttaatgtatttggaggggaagtaaaacccttggatgatatttgcaattatggtttgtttgtttgtttgtttgtttttgctaatgccaagggtccccccacagaagtagcagaatttaagcttaaaatatctattcaagtaagtcacatcctcaggacatagaggaaacaggaaatcctgtgtgtctgtgcttccaggaactgaagcagcactcctaggtagaatagagtcacagacatcattactgtgtagaaggagacaaaactggcaagacatggaagattctggtatgggggctcgggagacaatttcatcagtgatgtgcttgctatacatacatgatgacaagagtttggagagccactgtccatgtcagaagcctatcaggatgtcatctgcttgtaattccagagctgggagggtagacatggaaggatccctggagttcactggctggccagcctacctgcattgagatctgggttcaatgagaagccttgactcagaaaatccaagtggagagtgattaaggagggcaactaacatcacacacacagacacatgtgcacacacatgtacacatgagcacacacatgtacacatacacacatgtacatgtatatgtttacacacatgcacatgcacaaacacacacaggcacacacagacatacacatgtgtgcacatgtgcacacacaatgcacacagtatgttcatacacactcacacgcacatgcatacctgggcatacacacatgcatgcacacacatgcacgcacacagatacacatagagctatagataggtccagggatctgtccttccatagtcactgtgtgatcgtttctcagtcccaagagattgtctctcagtggttcaagtggagtaactgagcaaaaccctcagcttacatttggctagagaagagaagactcgcctcatctaccagttaccacaaaacctgtactttaggccagtgcattctgtctttacccagatataactataggtgtaactatttggtcccctaactgctgaaattccccagggaacatggaagagactgagattgaagagatttgggttctggccccaatttagaccctctccagcctttagatgttgggccaagacactcaattctgaactttgctgtttttctttaacctgctttattagtcagggttatctagagtcacaggtcatatggaatgagtgaatatatatatatgtatatgtataagtataagtatatgtatatgtatattcttataggctgcagtccaactaatctaaacaatggctggccatgaatggaaagcccaggaatctagtagttgcttgggtctcagctggtcttctgtgtgtgctggaatcctggagaagtaggctccaatgccaaggaagggatgcagtgctaacaaggggaaggcaagcaggcaaagagcaaaagcttccttacttgtccttatgtaggctgccagagaaggtgggcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggtgggccccatgtttgctgaagactcagtctagtttctttccttagctctagaagacagcaaacgtctgggcaagaggacctcctcctgtgctaaacatgctggtcctttatgataacagttctgacgtcagtgtcctttttaaagtgagagctgtaaaaactagctctatgtatttacttctactctaaagtgaaggccacgttttgttaaccatagcagccttacttacctctgggaaatgggaatggctacccataatatgcatcccatggccactaggccatgccagctcactgtgggatttgcaagtctttcctggtagttctaaaccaagaataatttttagatagtccattgggaaccacggcctgttcatagtggctactgacccagtgtctattacttgaatagcttataattttagctggatatacacatactaatagaggctcaaactttggggctggagatatgacttagcaatgaagaacacctgtgttcttgcagaggatccaggcccaattctcagcacctacatggtggctctcaactccataactctagctccaggggatccagtgccctcttctgacctaagcaggcaccaggcatgcacatggtacacaaacaaacactcatatacataaatttttttaaaaaatctttaaaaaaagactcaaacttccataaggcttggagtggagcatggtatttgttggaagtgtgactattcaggcattagtgagtgtgatgggttcaagttccaggctctgtacttctaggaaggatgttaatcagctcaacatcatctcctcctcctcttcctcttcctcttcctccttctcagtgtgtggatgcaatggtctcttggtagaaggatgtcctcttccctcttcttcttccccctgatcgtgtgcatgcattcggtgggaagccatcatgggcctcagggatggcagagctacagcacagaagtgtcaagtcatcgtcgcagtctgagctcccaaggaaagaaccgccttgcctaacctcctgttaccttggttcatactttgggactcattcccttctttttttaccagtagcctgtcctgtattctcaccagcacagccacagcaataagctgatggtgagctgctgtcacactttaattaaaccgctccatggtcaagacatctgtaatcgcatttagtgtgtgagtggggactcaggatggtgatgccatctgtagctttgagcttggcccacccacataccagccacgtggccatgtattattgctctcatcttccttggctatactcagggctccttcctggctcatcctgctgttaccagggacatcaaagttccctcttatggttcttaattctgttaatagaagannnnnnnnnnnnnnnnnnnngctgtaagtctcagtagccaccaggtagagatggagaagaggaaggtagaaggccatacctttaagagatagggtccaagaaagccagtgtgttcagcagtggatgtcagtaagcagatgcctgcaccgtggcagcgggggcttcagagaataagtgcaaaagcccagacagccaggaaacacatgcttagatctttggctggtgtccaagttagaacaccagagttagagatcagaaaagaaggcaggttcagcagtgctgcatgagtggtactctgcaagctgctgcataaagggaatggcttctgggaaatgcagcacatgatctcgttaagggtataattattcctcccaatctccttagcatgtcttcatggtgaatcagccttcctgaggggtgttctctggaccaggtgattgacagaccccgatggattgactcctaagaaggagacaatagcacatgatattctgacctggggcacatcagaatgttatgtctccacgcagggtcagaggtagaactcagagtccattcttttgacttggaggaattaactgttactaaatgtctcaacaaagcccagaacctccatgttttcacacttgccatttcacttctagtaaagcttgtccttatagcatcctcagggtaataagaggcggagtctacgtggattataagggagagctccattctcagtggcctccaagcctgctaggtcctgtaccgctaccctttcctgatctattgtccaagatgttaaatcacaaaacaagcctctctcatgcttcaacacattctctgattgcccattccctttggagccatttataaactctaaagtggccaatgtgacctcagattaacccatgactttagattaacgccccctctctgctcagggcatcccaaatacagagaccttcatttctttattctgcttctagacaacagaaacattttcttgctctagtctggcactactgctaagtctgcccacagctcttgacaagcatggctccttcttgtcctcttgatttctactgtcttccaagaggcctttcttgaccttcccaagctaaagtagaactccctgccctcatagcctgtgtagctgtacaccaacaaacctgaccttctcagcatttaccccaaatgtaatgattggtatacatcctggttttctaacttgatataatgagtgtgtgtttgtgtgtgtgtgtgtgtgtgtgtgtgtgtgtgtgtgtgtgtgtgtgtgtcttatcagactggtttatagggtgtggtctaggtagtccaataatggctgtctcatcctggagacactgagattgtaagtgttgagttcatgcagttggatgtcactgcagtcccaatctagcactggaggcctagagaatttctggattgctgctggccttcagtctatactgaagtcctgaagaagtgggttctagtgaaggcatgcctcagcaacaagacagatgaacttgccagcgagagtaagggcagcaacaaaaatgcaaaaacatgcaggctttctcagcttacacttaaggctggaaagtcccaaggactttctgtgtatatgtgtgtgtatgtctatgtatccatgtgtccgtgtgtctgtgtgtgtccgtgtgtgtgtgtgtgtgtgtgtgtgtgtgtgtcccgtgtgtccgtgtgtcccgtgtgtgtgtgtgtgtgtgtgtgtgtgtgtgtcccgtgtgtccgtgtgtgtgtgtatgaaggtaaacttatataggccagaagttttaacaggtgtcctgcccactccctctgtgaacatcactccagccgtctcagtgcggctgccccatagcctctttccaggtgcatggaagagcagccagtgtctcccccatgcacacccccatgctgtctactgggaaacattaattgcagggagaaatatcccattttcctcctgtttcccatcaagtgggtaattaggtgctggtgtgtgtatatttgaacttgccaaattaatatctgaactttattgtgctgacccttttaagttagttttttttttaaataagtcaccagttttgaaggactatcctttttttagatcatgtataagaaatctatcatctgcaaataattagacagtgggaatgatattgtattgctaatgagcagatgtgcatgcttgcagggagggaacaaacagctgcacacacacaaaatggaaaagtggctcaaacccagcattacagattctgagaggggtttcattctttaaagaatttcagggaacagagaaaaatgaaacaaagaatctggtatttttttcattattaattcttctctcaagtgtgcttcccccgcatagcaccatcatacatgtgcacagcatcgctgctgtttgcactctcgagtgtccctttcagagaatgcttatatggaacaggtttgctcggcctttcctccaaactgattgaaggactcagtgggtagcattcccatgctgaccacggtgcttgggagcgtatgcatgtaaaatcctattggattcttaaaggaacctgtgaaagttagacccattctgcagatggacagactgccccagtgaagcaagaggatttgcctggagcctactagtacattaccattatgtgacaaagatggaatttgttcccctgggctcagttccaagccttgtgttcctcctctgggaaggcacgtgattccatattgttaagtgatgatttcagagagcaggaagcatgacctgtggtgactggaaccagctgcacacttgccagtgtctgtgaactcctgcggtgtccgttacaatttcatacacgctgttaaggattagcgagaggaagataattgggcttttggaaacattcagaggaatcacacacattttacatcatcatttagaatctgaaaaattttacactccagcaataaaatatgaagtcagaagaactactacacttcaaacgagagtcctaaattaggaaagggagatcagagctgagatcattggtgggaactggagttcctagactctaataatgtcaggctgggctgttccattcagctcacaaattaataacgatttaggatgttggattgaacatttagaatgcactgagatcatcacatgcaacagccgacagattgtaaggaacgaccagattaagaagaaaggaagcaggagcaagacaggcagaagaagacgggagacgcccatgttctgagagaattctccagcaccataaaatgtgggtttgggggtccttaccaatggcatcaaaggtgtgagcacctcagagccctgaacatatgaagcattgcattgtacctaaaaatggcctgcccttccagtcatacacagagcataccctaagccagaaaaaagattagtgtggctaaagggtttaaaatcatatagattagaattctcttaccaccattgcattctactggaaaccagtagcagaaagttatccagaaaagttctcttatgttaaaaagaaaatttaatttctaactatcttagtattttagtttgcatgtgaaatttccccacaagctcgtatatttaaacacttggcccccagctggtggtgctgttttggggttgtggggcctttaggaggtgagggttatgaggaggaagtggcccactgtggggcaggtcttgaggcttacagtgggatcctgcttctcgtccagtctctgctccctgctgtccagtgagctaagcaagcagaatcgaaagttctgccactgtgcctttctccacttcatggcaccatatccctcaaaccattagccaaaataaatcccctttaagttgcttctcactgtgctgacaagaaaaatcactagcaaacctagttattaaggctaaatcatgaacaaaattagaaaatgctttaattaggcaatgattagggtactatatatatatccaagttcacagggcatggctaaacagatcgtaaacccatctgtgagaagacagaagggcatccatctcaagatgcaagaaaaccaaccacaaagtaatctcaaatggtaggaaagagatcattaagaacataaaccaatgatgtggagttcaaaccacagcagaggagacatgaaagccaagacttcctatatgtatattcaactggttaactgttagaatagttgatcaacaacaacagaacaaacaaaagaataaaacagggccgagaatcccagtatgaagaataaaaacatggaatctcaatacaaacactggacatactgccagactcagaggacacctgcagcaatgaacttgagacaaaaagttacattgaaaataaaccccttaaaaaatagggcccaacagaatgaaacaaccctgggatccttagagaaactgaatccatacttgataagatcacatgcttcaatgagttttaccaacatttactagggaaatagttgccggcttgtgggatgccttccaagggctgaagagaacggaatcttgatacccacatctgagcacaggagaaagcaagatcacagtacagtctcacctaggagaatgtttgcagaaatccccagtgggctgttagccaactgagattggtggcatcttgagacaggatccatgaccaagtggattccagagcacatggttcagcagttcagcattaaccgagaaaaccgaacagggtgtttcctggacagatgaaaagaaaaacacggctactggtatgcaacacaagttagtattcataaatgagaaaagcatgggaaagagtctgtacaaagactcactgggtgcacatgcgctactgaacagtgcactactcagaaactgcagcgtgttggagcaactactgtagttttgtttgtttttatgtgttttgcttgtttattcatttcttactccctctgtagcccagggcaacctggaactcattatcatgtagcacatgctggtgtcaaactcacaagtgttgccgttagcgatgtacactctaatctgccttgtactggcatgggtagggatcctccttcagacctaagttaaggagagaagcaaagggaatgactgaggaatgctcacttctccccagctctctgggatttcctcttcttctagtggtcaagtgactgagttctgaccaatggaatatggcaaaaagacatctgccacttccagtcttaactcctaaaactccagcctagcccctgagctctaaaagtgggaagcaacttgagtagggaagcaacctaccaaagagacatcagcctccaccaagctaggccccctaggcactcagggggcaggaggggttagcagccctttttactaaatgaactttgcatgagcaaaagataaacgattaggttcatccctgagaatttcagatagaggttccttgagggtgagtgtcgttaatgaatctctaattgtgttcacttagccatggggcagctggaagatccagtaatgaacggacttcgcttagacttcctcttagattattttgtaaatttagtataaaccccagtgaaaacctacagtcctgctgctgtgctgttgctattcttgctctctcctcctccacccccttctccttcagacttaaaaaaaaaaaaagattcccatgtatttataaaagcaaatgttttcttatataacaacaagaacacaggaacttttttcttctgcaagtcttgactcattgtgaacctcaccagttaagctgcagtgcatttgatgtggggaaagataaacagacagtgcaggggagcaaagtaagatgtggatgtgccggaggacagagctaccacaccacccgcttcgcccactactggggagagggctttttagttaataaagacgcctttttgttgtttgtttgttgttttgtctttccagatccttaggagggagaatctgcctcatgccatgcacaaaaattagtaccttgtacatttaagacctaagagcaaaggtaaaatatgcaggacttccaggtgaatgacttcactatagtgtggggtctggaagtgattcctataaaagacactaaaagtgataaccaaaaaaaaggcaaaataagtttgataaattcgtccttctcaaaattttggcttatcataaatcattgtgggggctggagtaattactaagcagtttagagcactggctgctcttacaaaggacccaggttcaattcccagtacatcatggtgtctcacaaccatctgtaactctagctgcaaaggatctacaccttctggttgctgaaggcaccatacagacaccaggtgtacatgaaggtaaacactcctacacataaattaaatataaataaaaattgagcaaactaacccattgtaaaaaaaatgccaagagtaatgagattatatctgatagtggatttatatcaggaatatttaaaatatatgaaaaaggcttttttttagaaacacagattgctgcaaaggaatgtggccaaggtatttaaatagcagtggggaagcataaaattaaaaacatcattatcaattgggaaaatacaaattaaaatcaagtgagactgcatcatggaccaagccaaccgacagaaagtggactatcagacatgggaacatctatgaactgaaagaaagaggactattagacatgagaacatccatgaactggtaggttctcaaagcttccagactctgggtagagcaacatggactttgtaaagcagggccatggctccaaagagtgactcacatgtagttacatcaaagacatgcgaacctcagccaaaagctccaattctaggtatgtacccataagaacatcatgtatttgcatagctgagagcatgttgagaatgtcctttgcagtcccgggctgctcacaggctcatcacaggatgaatgcatccattgtgggtgggtgttcacttgagagatgttctgaaaccatcaaatgaagaaaatgggagattgaaaccactgtatagctttgttctgtataaatttcaaaaacaggccaaactaagttagaaggcattgtcatcaatagggacacacaggcgcacaatggtactccgtttctttatgttggtggtctttatctgagcatccactccttggtaataaataatgatacggtcatgtaactgtaccattgaagtgtacacttgaatacacttgaataactcatgtactgtgtcttatgtacttttagtacatgtgtatacatgcattatatacttttctgtattgaatcttagtttcgatttctgttgttgtgttaaactaataggacaaaagcaacttaagggagaaagagcttatttttgtcacagtccaaggtgcagtccatcatgacagagaaagcagtgggatagctcgaagtagctgtcagactccatttatagtcagcaatagagatgatataatggatgctcatgcacagttcactttctccattttatgccacttgtttatgcttggtgtttattctgtaaacatccttaaaaagtctcactgatggtctgtgttggtctatggtggtcactgatggtctgtgttggtctgcagtgatcactgatgatctgtgttggtctgcagtgatcactgatggtctgtgctggtctgtagtgatcactgatggtctgtgttggtctatggtggtcactgatggtctgtgttggtctgcagtgatcactgatggtctgtgttggcctgtggtgatcactgatggtctgtgttggcttgtgatgatcactgatggtctgtgctggtctatggtggtcactgatggtctgtgctggtctgtgatgatcactgatggtctgtgcttatattacacgtgaccaccactgtgcccagctttttcggtgggtgctagagatggaacctaggttctcatgctagtgcagcaagcactttattgactgagccatcttaccaggctttgttagttattttgatggcctctctacttccctcttgataaaacaagggctatccattcattctctcattttaaatttaaaatgagctgtcagctaaaattgacaaaattaattttccattcaggtaaagtgagactgttcaatattcatgggattcatctcagacacctgagaaaaaggccaggtgtggcaagaagagctcttggattgcagtaagaagccgtgtgtcactgtgagggagagaggcttgtgacctggtggagaaggctggaacactaggaagatcctgttttccagccccagaaaggaggcaatgctggaatgagccgtgtgagccatggtcttctgtgtcactgtgacgtgcaggctttcagtgccatctctgtggagacaaaccagtggggtcagttcataagcaaagagaataccagcttcccatttgtgggaaatgactgcagtttctgggacatttatcagcagttttacttttcattgagatagatttttagataagcaactggaggtgttcagaattttgtagatagagccatagcttctgtggtggttgggaatatgcttggcccagggagtgacactattaggagatgtggccttgttggaatgggtgtcgctgtggctttgttatgtcactgtgaggatgggttttgagatcttcctcctagctgattggaggtcaggcttctcccatttgccttcagaacaagatgtagaactctcagctcctccattgccattcctgcctggatgctgtcatggtttctgccatgatgataatagattgaacctctgagccggtaaactatccccaattaaatgttgtcctttataaaagttgccttggccatggtgtgtcttcaatgtaatggaaaccctaactaaggcagaagttggtaccaggaatggagtattgctatgataggcctgaccatacttttgtttggaggaatgtggattttgggactttggaaattagtagaatgctttaattggggctagcttaggttcaaaggttcagtccgttatcatcaaggcaggaagcatggcagcatccaggcaggcatgatgctggagaagctgagagctctacatcttgatctgactgcaaccagtataaaactggctcccacacagctaggaggagagcctcaaggttacacctacttcaacaagccacacttcctaatagtgccactccctggaccaagcatattcaaatgaccacagcttccgagccccttcatatgataagagttaaccacagaacacagatgcaccatcctaagtgggaccaggtggtatataggactatgggcattctctgagagtggcagaatgcaagcagcaatagcatgcaaaggtgggctgcaaatcagtttgaatgagaacagaattaatgactagcatagagtccattagcttccttgatgcagagcctgaggcaggggataagtcactggtgcctgtgactggggaaggacagacgggtagaggggagaacctataagcaaataagagaagtagagaggggaggagaagccgagggaggatatagtctcaggagaggtcttggccccttggatagagttcaggaagttgaggaggtgcagccatgtgaccaagttctgaccattgagatataattaatggtgcagagcaaagcttctaggaagactgtttaaagatggaagaagtcagggtgggctggaggctcagcaggtgaagacatctgccatgcaagcctggagacctgagtttgatccctgaagcccacataaaggtgactccaaaaagctgtcctctgtctttcacacatgcaccatggcatgtacctacccacctatacacatcacacacacacacacacacacacacacacacacacacacagacagtagtaataataaataaataaataaataaataaataaataaataaataaaagaggtagtaggtgatagtcttgtccatccacttttctctccatcacttttctctcccttatcttggtctacactttggccttggtgattacaagtccagaagatgatgtttgtttttgagcgtggagccatgtgctaaaaataattgtgtgaaaagaaacccgagtccctggtgaccatgaagccacaggttcccagcttggtaaagcttcacttctttaactgataaaagaagcacaagtcagtcttgctacatcatctttgtcttcatccctggtagcatcagtgctgttcccatggacaccgtgagacgggacaggcccctagagattcttgggcagtgtgatagccaccctggtcaccagcaaggacagggtgatacgtcagtgctcctcctttatcctgcccagatttttaaataagcaaaaaagacctattatgattttctttatacagttgagagacttatatctaaactgtatacataatcattttaatttttacttactacaagactgttgttttatattttaaatatcacttgaaatgctgccttggaacattaagtcctaaatggatgtcttcatcaaccccctcccctcagggctcagagaactatttggaaaaggaagcagtaggattgtaagggccaacgcaaaggaacagtgttttccagacacaataggactgacacacttatgaatacacagagactgtggcagcatgcacagggcctacacaggttcaaggcagatggggatccagtgctaagaggagaaagtggacatgcgctcccattcataaccaggaaattaccttcaattgacaaccacttgccgaggagacattattttcctacagtggaatctctcactgagtatacaagccacacttaagggcagccctgtacccagcaggagatgctgaaagaaaatgagctcaaggatatttttgtagattttttttgtcctcttttgctttgtttgagcatttttttaaaaaagtcttacttatcttctgcttatatattatggtttgcaatttgtgtttgttatgggtcttgaatttgcacatctgtatttgtgtgtatgtgtgtggtgccgtttctttgttttatcattctttttaaaaattcgcctgttagttttcaaaagccagagatagaacgcaccgagttgaatttgtggggaggtgaggatctggaaggaaatgagggaggcgggaagcaacatcagaatatatcctctgaaaaaaaatattttcagttaaaaatgctgtttgacaaaaacacatttttaaaaaccttgtattctcttgaattcagacaaagtcagcacgcaacgtgtatgtatgtgagattttaaaataataataaaaagttaaaagtgtaaattaagacaaagccaccctagtgaccacggaacttagtgactacaaacccagatatgagcatggaggactcctatccttcccctgctcctacccttctaaggctatcacctcttcccactcctccactcagctgcctgggccatgaaggcagtatacaatgatatcagaagtcacgctccattagtgtaaaggaatatgtctcaaccagaagcagttttgcaacccaggggacatgtagtagtgcgtagagatactcttgtgtgtcacaattgggtgggcattgaggtatagggcctaagggtgctactatgtttccaagaatgcatatggtagcccaaggaccgagggtcacctagctctggatgtgagccgtgcagaggctgacgtgtctgtgaatagagagcacccattgtgtattagtccttcagttgtctggcagtatcattaaaaaacacctagggtttactttaaggatctaattgatttcttcactttccctctagcttacaaatagcccaagggagctttgctctacccgcagtgacctagttaacactacccctagctgacagctcattagctcctggtggacaagagctaacagaaggttgatgcttaaccatgatgtgcattttgatgttatctcctgggtgctgtgacttagttctcaggggttgaacatgtgtataatctaagcccaatgattgctttaaggctttgatttatgttttgaaagcctttttaaaggaatcatatgtgtacaggaactggtcactgtatatgtgtcggcccttgtaaaacttaacgatagactcaacaagttgaaacttttagtctagcgtaaaaaactatgaatgtatgtatgttttataggagcaagttacagagcatgctcattttcttcatcctgttttgctctaataatgaggaatattaaagtcatgtccctggggagaggagtgaaatgtgaaggagcttggaggcagagatgggggtcacatagtgggacaatccaccagggacacacagtaagatgacccgcagctcactcactcagtctgcacactgtgctagttactttctcagtgctgtgaccacagatttgactgaaacgaaggaagaaaggcatatttttagcttgagttacagagggttcagtacatagttgtttggctctgttgactctgagccccatggtgcagaaagagcataagacagagcatgctcaccccactataacaaacaaggcacaaaaaactcacgaataaacagtccccagttacctactttctccagctcggcctccctgctatagttccagaaccttccacaacagtgccaccagctgggaaccaagtgttcaacacatgagtctgtgagggagtttcatattcacgccatagcaacagtccccaatcagaagctttctggacccagctctggaccgtgccctgcagcagatctgtgggttttatcaccacaccctatggtgggaggcattggtgaagggctgcaggaaacaaagggaaggctgggaggtgctgtaaagcagggcctactccaggcttggtaggagggatgctcattccagagatcaaaggaaaaaggccgttgagagaagctgggcttgagaacatccaggggtctagtcacatgaatgctgttgggaatgtggtaccatgtgactgaagcctggaaggggtgaggaccaaagattcaactgtgcagactgtcgccgggagtgaagaagctgccgtttttgaagggtccagggcaggaagtgggcagctgagttcagcagtgagtaggacgaaggaaaagcagatggcagcagggtggttaggatgtagtgaagggcttacatcagagctgttgtgaagatagttaaagaaggaagaagtagagaaatgtagaacaaagaaaaccagctaaaacnnnnnnnnnnnnnnnnnnnnttttcttttcaaagatgtatttatttattatatgtatgtacactatagctgtcttcagacacacaggaagagggcatcagatctcattatggatggttgtgagccaccatgtggttgctgggatttgaactcaggacctttggaagagcagtcagtgctcttaaccgctgagccatttctccagtccggctcttctccttttcattcagtcttgggagggggcagccaatgaaatgatgtcacccacattcagggtaggtcttcccacctcagtgaacctaattaaggacatttctcacactcatgtccacaggccagtagatctagcctcactgagactccttttccaggtaacactagattgtgtctagttagcaattaaaactaagtgtcacggtagatgtgtgagcatgtgagtgtgacatatgtgtatggaatatgtgcacatatgtgtgctagtgtgcacttctgagtgcacatttgtgcccatgtgtgtgtgggtcaaatttcaccaggtatccagctgtgtcactttccatcttgagacagtctctcactaaacctagaggtaacctggtagccagcaagacccagtaattgtcttgtcttcccacctctaaccatacacagctacacatggctctctctctctctctctctctctctctctctctctctgtgtgtgtgtgtgtgtgtgtgtgtgtgtgtgtgtatctgtgtgtgcgtgtgtgtgttcttgaaattttaactcaggtcctcacacttgggtagaagcattcttacccactgagccatctccccaaactcagaagccatttttaacagaatgtccagggtgggggaccaaagcaatgtattatagacatctctcttgcctaccaaatatataaatgaataatcttcagtttacctgtgaccctgagcccttggtcttaactgtactgattatgaaacatgcattaaaatactacttatgcaaagactcctgcttatcttaaagaaagcactggaggagctggctgggcccttctctactgtttgcataaatgtccctcggatgtctctgtgtatagacacactccccaattcatggtgctattgagaagtggtgggattttctggaggtggggccttggggagttaggtcattgggggaggggggtatactcttaaggggatgatattgggacctcagcccctcttcttcctcttgtttgtgaggtgagcatctccctccagcatgtgctcctggtgctgtgctgcctcaccatcggccctggcactcagcagctatagactgaaaactctaaacctgggagccaaccgccttccctccttataggtgggtttctcttgggtgtttgctgcagtgtctgagaactgactctcctagagtactccacctaacacatatacatcatagtgataaataagtaagttatttgctaagtgctttcatataaaaatatttcttaaggagtagctagtataatccaggactgtgataagtttaccgaagcttagaaacatttgttatcattaacgatttttttaactacatgcatgtgggaaaatggtgtgtgtatgctgagtgaagactgggggcataggagcccctggagctgaagttacaggttgtaagccaccctacctgggtgatgggaactaagttcaggtccccttagaagcaaggcatcctcttaaccactgagtcccctccctagtcttcttcattataattaaaacatgtatttcatcctcatttcaagaaactgatgtcgagataaaattaaaataagcacttggtaaaactggtcacaacaactatgtccactggtgccagcattagtgtcccagcatcccctgatcttctctgttctcaccttcaggcatgcgccaaggcaatgactttggtacacagtaccggtcagcagtctatcccacatccgctgtgcagttggaagcagccctgagatccaaggaagaataccagaaggtaggatcccccaattctttcctccccaggacaatgtgacctgggccagctcagtgttagagggaagtttggctctgtacacctgtgaccatacccgaggccatttctgccagcctcctcgcagcgccattgtgccaaagaaatgtgcatagcgagtgtctaagggtgagcccatgtgtacttttctttaaaaaatcagctcatcctggtgaatgaggtgctgttgctctgtcagaatccgtctcacccgcagacattgcttgtctctgttctgcagctggagtctggaatcaaggcaatgacaaagggggcttctggggactgagagaaggaaaggtccagatgctttccccgtcaatgtcatatgtcactcgctctccgtgtgtctcctcactcctgcatttgtaagaacactggtcctactacatgcaggctaaccctggtaacttcatgtaacttgatgacgtctatgaagacccaactccaaataaggttgtggtctaacagcttaaggctccaacagatcctttctggaagacatagatcaacctgtcatatatacttttcactgccagctacagtaaacctaattataataaggccatttatcagaaagatatacattatatcatgaaatatttgtcctattaattctataatccttgagggaaaaatctcctccagcatcgatttgggtcacttacaaacaacttgagttcttttaatttttagagctcagtgatgatacttaatttttgattatgatatttcctgtattagaaacagagctagtagctactctggatctgtgaagcataggacagccaccacagtggtagagtgggtaatgaggagcaggctgggatgcagcttctgctgttgaggtggcctggtcagatcggctatgataggagatggggctgagagggatgcttagagggacccctcctcccatcatatatctaaggctgtgatgtcagcttggctgacatggtaggcagtctagggcacagtccctgtggctactatcttacttgattccctctatgagtctgggctgaattttgtgacatttcttttattcctttctggagactgtaacatcaagaaatcttgatactgaaccaggaaccaaagtgtctcatgatgtatctgtgggttcagggtgtgaataataaggccaactatgtaggtatctaggaaactactatgatgtctgtcttacctctagtcccactagtggcagaattcaagataagggacttgtgtgtgaggattttctgggatggttggtaggatcagagtacaggagaagtagaagagaggagtaaggcccacactggctgatatcagtatcaggttgcttgagcctcgtggctgtggagtacttctggctgtggagacttcacttcagggtaggagacatgacaagctacagcagcaaggagtgtgggatgggcatgtgagccccagagcctgaagtgaagaagtgcttctgattaagcaggtgcattccagtttcatttatgttgctgtgatatcatatcctgaccaaaagcaacttcagagagaaacaagttaacttgccttacaatttcaggttactgtctatcatctctggtaaatcaaggtaggaacttaagtcacctagccatattatagcaggcagtagaaagtgaaataaatgcatacttacatgctgcctccctgcttgtacttagctaactttgtcctcttttatacagttcaggaccccctgcctagggaatggtgctacccacagtgaactgggtctttccatatcaatgaaattaattaaggcaacctcccacaggcatgaccacaagccaacccaatgtagataagccctcattgagactctcatccaaggtgactgtatgttgtatcaaattgacaattaaagctaaccatcacagtatgtaagcagcatcaaaagccattatccacaaagtgcccttctcccaccagctctgtgccctagccagaaaacactgctagtgccaaaggctggtcccaccacgaggctctctggaagaaaagcttgaggtgacttcccaggaggacctcctgctgtgatcatgtagtcacatgggagacagctttagatacagaagttatgagcagagtgatgtgcagtgcataaacagccttataatggcagaggcagtcatagtaagattgcaactacagaaaagggtatttactgaatgccagccactcttctaactttacatatataaatgaaatcttttacaaatctttggttattcatctgtcaattacctatgtatctgtatcatctatctgccacttagctatcatttatatgtcatttatcatctatgacctggttttcatctatcaatttatcatctatgtgtagatgtaatagatacacttagatgtagttgtatgtatctctctgtatctttgtttaaaattgtatgtattagtatagttctgagactttgtttctaccttgagagttcctgtgaatttctgcccattctctttgtataactgatatctgaaacttacctccaaataagtcaataatgtccctatgaaaggtgacacaattgtcttttatttgctaaatgaaccatcttctcttttacatttaccttaaaagtattctggcttccaaatggctccacatcaccaaggttggtcctagattctgccttttgtcaccatagctgtccagagagcagttctgaatggccttgcctgtgccttatatcaatgctaaccttgggcaaatttctgacaagacatttactcttaggggcatcgtttctttataacaccagttagactcttgccttccataatcttgccccaaacattcaggcttatgctcagagtagatactccttcagttcattccacacaccctcttcccccttcagaggtcgccattacaggccttccatcctggccattgatcttctctgtgtctgcagggacccttgcatactaactatactgttgacttaggttactaatttgatagtctctgctagtttgtcccccagtgacctgcaggaaccagcttcttcagcaacttctttatatgtggcgttggagtgactgcactgcttaccacagagcagccgtttgaacataaaattagctgattttatcacagggaccgattgttgagctaattagatgtgtaggagtgctgaggagccagaaaccaaaagtgattttttccctccaaagtgtggttttctgcatagttggctgggctgtcaatcccaggcccaccagcaacctgaagaattcttctcacttccgatctcctgacggtgggtggaggcaggaaggcccaagcaggagggtcaaaccttcaggagtgaaacccatacttcatcttcccaacctcacccgaataaatcagaccctctgggaatggtaagtgtgtggtctatgtgggattccttcatactcaaaatgggactcttcttcatttacgaatttagcattttaacccctggaagatggtaggtcttgaaactaatagatgttattgtggcccaagcacacgacctaacttctgcccaactcctcaagacgcatgaatggaagacatgatttctttgaatatttttcttgtcagaagagaagaaaaatcagcccaaatcagccccccccagtatattttagagcatattgtactctgatgagcacaacacctttctgaagtatattcttaattaaaaatctgtctttttagtctctctgttcatctatccaccacccacccatgcacccatattttcacctaccacctagtctacccatccatccatttacacagcctctttcccagcaacctgatcattctcccatccactcatctcttccatctatacagccatctagatgatctctatattgccatagtctttaaataatttttataattttatcttaattttcaattatttgccaattcatcatctatcatctgtgcatttcattatatgcaatacaatgtgtaatttaaagaaaagcacccaaaaaggaatatacaaaacagtatgtaatgattgcttcaaaacagccagcaattttttttttaaagctcatctttgattatttgattctcttcccacttagattgcatccaggtattcactaatgccacatcatcctagcaaggccaacatgcatgggggcggggcagtgcacagaaagagacagagatggagggatggaaagattgtattctcaaataacctccccacctgtgctaccaatgaagcttctgccaccttgctctttgtgtagtataaatgctaactctatacaatgatacacaggttcatggacctaaaaatccccatggcttccagatccctgcatagaagtgtacccacttgtttatttccatatccttgtcccacacaacaagccatagactgaagactctttaatatgcaagtgcctggcttcttgtgcccaccactaatggcaccctgggagccactgtgaatctatccctgtgctcacttgccccttgtcaccacattaccaggctgcccaggtgcattagtctctgtcctcctcactgtggcaaaagacttgagcagaagcagtgtcagggttggggaggatttattttgacttgaagttgaagatggacacagcccatcctagtgaggagggcatggtggcaggaccatgaggtggccaatcacactgccttcacagtcaagaaacagacagaagacaggaagtagagtggtgctgagggacctcaagacctacccccacgagcacacttcttttatttggggggggggggttcgagacagggtttctttgtatagccctggctgtcctggaactcactttgtagaccaggctggcctcgaactcagaaatccgcctgcctctacctcctgagtgctgggattaaaggcgtgcagcaccacgcccggctatgagctcacttcttaaagccgtgctttacctcagagcacaaggaccaagcatttaaatacaggagcctctgagaagcattttacactgaagccacaatgtctgaattttgcccttgggtatagctcccatgtacctgcttctctgtcatagccacagtcaccaccatcactcaggtaccaccatctgctcctgggccaatgaactttttatttctctgttactagagctgcctacacagggcagccagagtggccatcataaatatcatccggaccatttccctctctagtgtctgactctgccatgacctatctagtgtatgtctgagacccagccattagcttggtctcccagactccatgcaaccatcacgctatcatccagtaacagtccctctcatcatgtctacagtgtaccgtgcaattccctaccaaggcctggggcctttgagtgaagctgtaggatttctggatacccaagaagtgcagatttggacaggggtgtccttgcagggatgactgtctgtggcctttatctgcttttgcaaggagattggaattttcatgtttattccctctaccttcaaagaagaccttcactcctaaaatgtggttgcacaccagaaaacagagtgcaaaagtaatccttacagctggaagaatatttgtaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttttatctaatgcatgtgcatttatatcacacatgtagtgatccaatatacataagttgaagctgagtccttttagtttctgaacccccaaaatagcttaaattatgccacctcaactcagaaatccattatatgcaataattattccacaatgccagtactaccagagtacagccggactggtgacacccccatcccatgaggcacatgcagatcctatgtggctccttccaggcatctgtaggctgaaaatgacttatctctttctcttccccagcaaattaataaattaattaccttatcaaatattaattatgtactgattagcatccagactcatactgtagttgttttgagcagagctgtctgaaagaagttcttgggaaggttgtaaccgaccagtccctgtacagtccctagtgctcaccagtcacacaaaccctaccctgaagggaatttcctaggacctatactgacattttctgtcctaagccatcctttcagggtctcctattcatctttgtgtccacagtgcctgcaactgtgcttggctcctagcacatgccctgcgaatatttgttgacctaaattaaagagatggggagatgaacaagtccgtcatattgtcttttattatgggctgaatatttctgggatttctccattgaaactcctctgctaaagccttctcctcccctagtgtgatggtttttgatctgggtaatttgggttagatgaggtcatactgatagagctcccacggagggattttcgtccttagaagaaaaggcagtaggcaccagggggctactttctgtttttactcctgtgttcagggaagatgtgtaaacacaacctaaacatctacgaggcaggagaaggggccttgcaatacaacctgccttgctatactttgccctttaccaaagtccacagtcctgctgtgtgcctccagtctgaggtatttttccagagcagactgagacagctgtgttgtgtgtgctcagctccgaggagggaagggaagaatcatagccttggatgagaagagccagctggggccctggctctggcttcacctacgtgaccttggattcgtctctgcagctccagttcctcctgtgaactggagagaagacacacactgagagtcttcataaatctcaagggttcttaacatttttccctcccattatgccgaatgaccttcacaccacacaagggcatagggcaagatctgttctcctacctctgttgctaggaaactgaagcccagaggggtacattttcattcccagaacaacctcaatagaaaatgtagagggttatggtcagttgactcagaattccacgtgtgtttcagccatgttgcgtggataatagctgtgtaatctatcaggttatgaatattgggatgtgatggggtgactccggagactaggctgctagcagtggccttgtcaccttttccacaggccccaaattccaaacaacttaaaagaaaggactgcgtaatcttccctttgtcacgaaaatggcagaatcatcccggattctttgttcccagggaagaagtaggttccgtgttattatattctctctgctgctatgtttaaaacctgtaagtacgccaacggattcctatggaacgctacggcaaccattaggagactgtgggtgtcagtagctgttttatggcttggagattagacagctcttcatctttttaccttttttttttttaacgtgtgctattgtttacagcacaaagttatgatttaaaatgcccatggaagttcctgaataattcatgcatttaccttaggctgagagaaccatccctctctgtgctctatactagatatggaattcttgttagaccccctcttggagctcagaggttgtaattatggatagtattatgaactctaaataggaacttgtgaaataaatatttttaaaatgcccgtttctgcgagccaggcatctgcatttctgtgtttgcagccagacagagggctagctctttagcctaatggctcacttgcatcttgattattttcatttccacttattactgcatgttagactccctgtgtatgagtacagattgccctttcttgcactgtatttagaaatctctgcattacccctgggcatttgttcattaatagggggtggggagaggaaaggcttgtaataatgggctttacgcattaaaccgggcacatccacattcaggcccggaggaaaaatatctggtttgtgttactgccccctggtggttgttgactttcactgcagtgtcaaggaagctagtcttctgtgggggactttggcttgcaggggcagcttcccagagctgcacagaactgggcactgtcaggcaatcattcacacttgatcattgcttttcattcaggtgaaccacaaatgcctgaggatctcaggtgcaggccagattgttgttaaaatacagcaatctttctgggctgggagatgggtcattttgtgtatagacacaaaaacccccctagtaacatagggtgatgattaaatgaatgaatacagtttgtggggccacccccactcatctttcaagaacatggaaaagtcccagtagcacccattgtaatccatgagaagatttttggctacatccagatgaacgattctttttcttttaattgctatgtgtttacgtgtgttaggtaagctgcagggactgtttgaaacccatgatctctgaaccttgccgtttaagtgaagatcagaaaatgacagatacgcttgcagctgcgttctgtgctgggctgcgtcttctgtcagtctgtaggcagaaacacagggcagcatggctttgtccttggtgaatgaccttggactgtaaaccactctaaacatgggtttcctgatttaaaaaaaaaaaaaaaaaagacataaaaacagtgactgcctcttagggagttctgtgatccatccggtgtgctgtgtatataacatgtctgtcacagcacaggtgctctgtcaattccagattcttcctacttgtctcttcacaccccaggacacctctctcagagcctgcctctccacattcccataatgctttgcttgcaacactcacttcatcagacccattataagagtttctgtgctgtttctgcctcttggtgatgaatgagatcttcttggctttgctcacctccccctcttccctgtggcattccttggcacaaagcagccgctctgagcacgccggtcctgtgaattaaaccccagtgcaacataactatatgtagcatttccccatcctcccacacatgcaatgactgtcatgcatctgattaagatagcacctataccttcacccccttgtctccaagttcccatggtctgaggttggagtctcagagaggaaaataggccactgatgcctggcattttcctagtattcacataatatcttatcttaccaatgaatatggatttgtcatattaatgtgtatatatatatttacatatatatatatatatcagttctgtataggagaaatggaaagcagtggaaattttttaatgcagcagtcggaccaggatagatctattccagggacaaagagcctttgcgttcagacaggtagatttataagccttgccccagtttagtctgtataaaatggcctttggcgtgatatgatcagagaccccatggggaggaggaaggggacatagggactctttcatttcagcggcaagcgtatggagcctggagctgggtttgtcgttgcccacagaacccagtgtgtttgcctttcaatttccccttgattggtctctgctctgcatgattctaggttccttggactcacccgaatggagcctcccggccagtcccttaaagacaacagagggctgcctgctcaaggttgggccaccgaggcactgttcatttgaggcttggagagataacagctttcatgtccgcccagaaagctgcgagcctccagcacctcaggagcggagatgaaaggccattttgtgtttgtgcatgtacgtttagcgcacttaaaggacggggacaagaaagaaaatagattctactgctctgcactcccttccaaatgtgacttactccctctggtggggccatttaactccaaaggcgcagcccctcccctggtgcccccccccccaagctccccacccccaacacaagcacagcggcccatgtgacatctgttctgggcaccacagagccatcttcccgttgccatggcagctggcggagcaagcccgcccactggctgctagtggaggagggagaaaaggcccgcagtgtcaggtcctgcgccctgcagccctgccagtgagcagctgggccgtgagcacagtcacccatggtggccacgaggaccccacttgagctgtgtgcactgcactggcgggttggagctgaggtcaaggtcattcatttctgcctcaagtgggaggcaggccagtgaaggacaaaggtggttgtgctctgcagagtgggctgatgtctgctctgggctgtagtactttgtaaaactgggattcaaaatcagagatggcccctattgctctcagcaccatggctgtgaattcaggggcctgaattcagctcccagatcctattggtggtgcagtgccaggttagaagagggctgagttttactgcagtaagctcctggcaaagggatggtttgcaaagtcatcccccacactcacacactggagccatctccaaatgtacccaggcagttggaaccactgctggcttcagagctgtgattatcctgtcctgaccccgtgaccccaaaacctgatctggaatttggccacacagttcctctctggtcttccttatgatatcactaatgaaaaccaccacctgggtgtcttatacttgccattcctaactcaatacctattgtaaatgagccagtgactgagaaagaagacagtgttgggctgagccacacagacaagttagataagctccactctaagaggggggccctcaatggggttcagccacttactgccttgtgtagctttttgctctgattcccaaaattgtccctcatgtgataaattacaaggctatgtttagtctttcattaaatatgtaagttgtttctctctctctctctctctctctctctctctctctctctctctctctttctttctctctctctctccccatgttttcttaaaaactgatgaatttctagacagagcccagaaacttaaaggtatttctatgtttattgttttaggctcaaggtattccctgagcaaaatgggaagtaacatcttctccagacagacaaaaaacgtccatcctggcctgttgtgtccttcttctggtagaaggcctgaggcaggtcctggacactgttcacaggtagagccaagaaaatagggtgcagagcaccccaaacaaagctagactgaacatgctgtgctgtgggtacagattccactgttgagatcaatcacctatgtttgtaaaaaatgctcacacatcctttgtgacatccacatgccatcagagggtgagccaattctccagcagcccaggtcatgttcaagcaagaccttcccagtaagactattatcagacaacaaagaagagcatccagttcactatgtgttgatctacattcaagcaggttcctttggcttcttgaaagtggttaatttttctggcataatatcatatagcattatgattttcttggtgatatcatatgcttcatggcctttgcttccttaaaccgaggcttcttcagtcacactgggatgcagcaaaaactgctcatctctgctcatctctccccgcggagccacgtcaggaccatgtgattaaagcattattagtatgcagcaaggtgcccttctccggctacatcagtttgcaaagtggtcctcacaaatgcacacatcctttgttatgatggcagggctgtgggtttctggagcaagactaataagaccttgaggtagaagggaaattaggtgacccagccaagcaggggtcagggaggctgataatagataagaaagaacagactccagggtcagtcaaggagcagcaaaggtaaagagtgcgcttctgttggagaaaaggcaagtaggattgccgggatggggactgagaagaaaatccagccattgtgtgcaccttgagtgtagaaggcaggggcggggggctcagagaaggaaatagttccagaaagcaaaaggtgacccagagtaatcatagggaaacagtgttttaggactgagaaagaggccaggtaggcacactgtgtgtgtgtgttttaaagcctctttgagagagtcgcttcagtgactcatttaacaacttttaaaatgccattacctagtaacagaactagctgcactaacctgcctgctcacactctggactgttgtgaggctcaagggaggttacctgctgctaggatgcagcacaggaaacacaagccaaggcaaggtacacccgggcaaaccgggagtgcagggagcagatgatgggcaagccactgtctccggcaagctgcattctccacctaggagagggtctcacacttgatccttttctctgtcctcattctctgggattatccccgtgtctgcatggactgaggtgacttcatagagtcgatgttaagatggctgggaggagaaaatctgcttgatcctctgctaggttatgtctcgtgggtgtggctagaatgtcttacagaaacaacataaaggaggagggatttatttttggcttatgccagccacaacaggaaaaacatagagtagagtgtacggctaagatggtacacatcatgtcttactgagcagtagagaaaacaagaccagaacccagggctgactagactatcaacttctgagacactttttctgtccccccaaggaccgatatctatccctaggcctccaccttctaaaagttccatggctcacaaagtatcaccaccaactggagaatatgggttcaaagcatgcccttgtcaaggacatgtcacattcttacttgtcaggccctgtttccccagccctttagcatatgagcataaactaattcacatgcaggttaccaaaggttagtgtttgagatggggcttgtaaaattctcacagtatcgtccctttctctgactgtggagactagccccgtggaggaaacttcctgggtcagcaacctttctctccaggagggtacccaaccttgaactgagtctgtatcatgaattgctagaatttgtgattaggggacctataccagctgcacagggtttataatgtcatctgataggactgagaaacaagcctgcaggcatttctaaaagtagagacttttagatacagtaaattggaatgaggagacgtaccctaaatgtgggcggcatcatctatgagatgcagtttggactgtataaaaagatagggaaaactgagcagcaggctccctttgtgccttcctgactccaaaggcaatgtgacctgctgcctcaagtgtctgctgccctgcccttctctatggtgggctgtaccctccgcctgtgagctagaaagaattcactcttggctatattggtttcagcaagtattttgttgccacaacgagagaagtgaccaacataaggtctatgtggaagtcaacaaatgtatcaggagtcagattgtctgcatacctgccctgcccttgacttgagttcttgttggtatatttctggtaagcagtaagatttcccaccatattgtctcaccaagcaggccctctctcattccagcctcaaatttagatgaatcctcaaaacagccatgctgacttgaggtctgttctatgtagcatgggaaattgagtctttatgcatgctgaaatagagacccctaagttaggacaccgctcaccccccaccccccagttaccaaggagccacagtggcctgctccagctgagcctcagtctgagccaatgctgaacctagacactttcgggcccatagcatcagattgtcaaactgcatcctgtgttcatgtggtggtcatacctgccttcacccatacatgaggctactgagtcactgtacttactttaccacattcaattcagttctcaaagtatttcccaagtgtcagtatgttgcagaggtgggtgtcatagaaacctctgggcagaaccaagatctgtaaacatgtatggatgacccctggctatggagtctctgggtgacatactcatgggtcactttctctagttacctagtacctgcttgtcctcatacaaagaacaattcttacatgatactaaaaatcttatttcttcaagaaaaatatgacccaaagacagacagacaggtatgttggccgggccaagctctccacctccacaaatggcatttgtagctgaggccaagcagaagtgggtcctctaataagttctgaagcttccagagtcccacccatatccatggaattagaaccttcaggggtagagctgatgtgaactttaaaaaaacaaaaaaacaaaaacaaaaacctccctaaatgattttgatgctgaggtcaatctggtatttcagaagagtggacctgagatgcagtatctagattttggcatcagatagtggcgcacgcctttatcccagcactcgggaggcagaggcaggtggatttctgcgtttgaggccagcctgatctacaaagtgagttccagggcagccagggctatacagagaaaccctgtcttgaaaaaccacaaaaaaaaaaaaacccaaaaacaaacaaacaaaaaacttacttgtttaaacctgagtaagaaactcacactctgcctccattccctagtctctaaaatgggtctaatcctatgttccatggaggatgggcccctggcctagtgtcagctctattgcctgccttttatcccctaaatgttcttcctatcctaatacatcatagttcatacagaagcctcagagattccagccaggtgctgatgtaaggagagcaggggcagtgaagatggtgctaagaaggtgagagctatggctgcttcctaggcaatatgcttctccctctggcttgcctgtgaggggggggagaggaggtgagctacagttaatttaggaaagagttaactgccagccccctatgtcatgtggtggtggctgggcctgctcaatacatggtgtcaacaatgtctacttatgagtcagctgtgaaatagctaaatgagagccccggcctttctggccttgcctctgccatcctctgttgtagactctagctctagaccctggctcatagaccagcccatgggtttccattgtctttcagatttaaccttgaatagtgatcttcagagtttggcttctcaggacctctttaaatctttaagagttattcaggaattctcccccccccccccaaaaaagaatctctgtttgatatttctcacctagacataggaactgggcactttttagacccaagcacatgcctcaactgctggagtgaggctgtcatcgcatccgctgtagctcttgggaaactccacttacactcctgagatcctaagagtggaagaagaaatacactacattatcagtgaaagggggcctttgatcttgtagaccctgggagaaagcttggcggttcccacagtctctgaggcacatggactcacggagcttgagtactgggtggtagaatcgtacaacttagatacagtagaaatgggcctgagctggggtagagatagctcagtgcctaaacgaatgcacagcacagttcacactatttgtaactctcgttccaggtgccctcttctttcctccacaggcaccaggcacacatgtagtatacagacatacacgagcaggcaaggtacctgttcacataaaataaagatatttttatagctctctctgtgtgtgtatgtgtgtgtgtgtgtgtgtgtgtgtgtgtgtgtaagcccaagctacacgttaaaaacaaaataagcaaagctttactgggccttcagcagaagccacagggcaatgagagcaatgggttgttcacccatcaaaggatttagtggctttattgatttttctgcagtggactaaagttcggtaattgaccattggtcatgggcacagtttcaaaagatgtttttccatctcgtgtgcaagcagtcttccctagaggtttgcaggctaatgggtggttacctaacccaggaactgctgagtttctctctgctggcaccagcctgcataaacatcctggccttatggtttagcgtgggccttctggtaaggctgagagaactataggctctagagttggtgagaaaacaggagagcagagtggaagaacacaggtgccctctatctggagacagcccaaattgaccctatgttgtaatcctggggaaaacatgaatgcactagacagtgtggctgttcacggagctgagtagatttggcaaagtggaagaacctcaagtcaaaggagcttgtccctcatcccatcgtcatcctcaacagataactatgtatcttataaagtcctgtgcttagcaaagacggccctcaaatttcttaagaggaacctaggtagtcgttttcctgacccacacatcagcatgccctctctagtgaaaatatgttgagggttggttccaatgctttgtcatattttggctccccaaaagtcatgcttgtagatctgagggttcctgcccccagctagcttcaattgataataaagaattgccacccagccaatggatgggcagaaagatggaggcgggacttttagactatgcaggcgatgggccgggaaagagatggtcctagcagtcactaccctagttgggtctttgggtagcagagatgaaatgttgatttagcaaattgtctcagaaaaagagggaagaatgtaaactcaccgaggggaggattagaaatgcccaaccattgagctagtcaaggcacatcaaaattagctggcatatgtgtgtcattcgagaatacagagagctcttggtgggtgcgcgtgctacctaccaggagccaaagcagcttaactaatccaccaaaagtgatggaagctgaccatgtatttgttggttgaggggcctccaactaagagcaagtgccctgactttgctctgacagttggatgtcccagttgacattggggctactgcagagattgtatgacatgaagtctattctttgccaattcccccttgccttggcttgttgtgtttgtagccaactcaaagctcactagtttctgcttgttgagtcaaaagggcccgttagtctatagacattctggccttgaggcctaaactggtcacagtggtatatattgtgtattgtatggtatatgtaccatattgtatattgtatggtatattgtgtgttatatggttcatgttgggtaggagcactgactcatgcaggtgcatgtggaggccagaggttgatgctggatgtctgcctcagtcatttctctacctgattttattttatgaatattaatgatctgcctgcatttatgtctgtgtatcatgtttgtctgatgcctgtgaaggccagaagaggttgttgtagctcctagaactaaatttacagatgactatgagctgtgatgtggatagtgtgggtcctctggaagagcagccagtgctcttaactgctgagccatctctccagcccctccatcttatttttcgagacagggtctctctcaccatttctgcagctcagtgacatctcagtgcaagggcgttccagttgttggaatgcctctgtctgtctcccttcccaacagtatataagcagggctgacaagggatgtaattggttgcccgtcagatgttccaacccatgatgcgagtcctgcaggagcgagcatgttctcaaggcggcatgaagcctcataatgagctgcggattgtattattacagttgagcaaatggaagcctgatttatgatgattaaaatttgtttctagcatgtgtttttccccacactccccgcccagtggaaagtatgtatctgttgtaccacccatttgcaaattgctttccagagccattgtctcctgatctgttcaggcgagagcactgtgacaggaggcaaccccgatctgcttattccacaaatgtaaatgtggcattttgttctttggggggtagatcccttgtggcccttgagtacagccaacaggtttgtaccatatccttattgtttttaaaatgacatgtattcatttgaagacttcacaagcaaacaggaacataacaatcaagggcagagatttttaaggcaagtcctataaacacctccagttctacacatccagccaaagagatcatctgcacactacgggacccgctagctcagatcctgctctgacatatgtgtgtatcaataatgaatgaataagttgattcatcctctgtcttgctgagtatctctctgggaaacactgcttgtggctcttgtttacccaaagatcactttgaagccagaacactctgcagtcccaagtagcagcctcttacttaacactgccatgtgattcttagctctgagctgcaagaccagagcctctcatcttgtcgaagaggggcaggtgttgcccaaaagaagatgcaggaagaggcctgggttctactgttgccctgtggtccagagttatgtgaccaccaagggaaggcctttgtcaccctgtcttccaatcatctggctatcacctctctgcagctgtccacatgtgcttgtgtttgatagaggccagccatttccagtgtgttacacacagagaatcacgaatgagtgggtaagttagctgcagtgatttctcagtggttctagaatggagctctcgttcttctccttgctatgacaaaatacccagtgaaaacagctttgtttcagggtttaaggatgagtagcccattgcagggaaggcagtgaggctgaggcagctggccacactgcatccgtaggtggtaaacagagagaggacaggaagtgggcctgctgtaaaactcccaagtcccaccccgcatgacccacttcccccagagaggcttcacctccaaatgctcctcagctctctcagagcagcaccaagggtcaggatctgaacacccatgctagaggttcccagttcaccaagactgtctcttctcctcgaagttcaagtccactcttgggcctgtggatgactggcacagacatgtttgcttttccttactacactgtactaaggatatgcatacagatctgtaacagatgggccaaagcctagtggtttaggacagaaatggtttggttttgtggctctgcttcttgcgaggatgttctgctcatggtgtctggctcatccgtgtgactgcagttggacttgtgactctctgatcccctctctctacagtctttctccttcatgaattataactgtgggttttctacctgcaccccagtgcagtaaataatgacgctgagccttattatttgtgaataaattcctaggccataagctagtgcttattccctgactagctcacaacttaattaacccatttattctattctgtgggtaccatatggctggttacctcttctcagcttcatgcttctgtctcctcagagttcagggcaaatctcttcccatgcctgactctatttcagagttcctctctccctaccagaactcccacctcctatttcctgcctcagcttttattgacaggtgatgcttccatacagtacacagagattctctctataataaatgctatctgggctgagctggtcttgcttttggggtgatgacagcatactgaaccccaactgcagagcttggcatacctctgcttcctttactgaggttcccttggctatcaaaagtcataggcttaagttcagcattagtggaggaaggacttcggctttcagaccagcaggcaagattcattttggatatttgtgataacaccccatcctaacacgtagcatccacacatttcttgacagttaattgaggatagcttgcaaagaatgcttgggggcagcctgggagtcaaaagatgttgttttgtaggacagatatatctctaataagtgtgaccattgtgggatccttatcttaaggagtacaggcatatctgggagcaagtgacatgctgcaagggccatgcatcacccccataacacatactccctgatgagcatgcagatacacatattccctctgtgcttggacacagatacacatacatgtatggaataaatatattatacgctatttcatttcctacataatgtggaaattaaatataattagacatatcctcacagtagtgaagactcatataaattcagtatcttattaccagcagagtttgaatatccaccagatattaagcaaaccttttagaacacagcacaatggagttccattgtaagaaatgccaactccagcatgtcattctttgctgatgttttaagctcacaataacaaattttagccagaggtgtctttgtgtgtaagagaacttgctatacaaacacaagcgcatgaattcatttctccactgctcacataaaatgccagggtggcctcctgtccacatgggcctgcaatgtcagtgttagtatgtaggccaaaaatattggaatttgttcaaattcagggaaagattctcaggaggataacatgaggattattggaacaggacacctgatatcatcttctggcctccacatgaatacatgggaacacaaacatcacacatcatataccccccccacacacacatatatactggccaatccttatatacttgcatgaaattaagcttagtagagacttggaaatcaaatatgctatttctgagcagccttggttcaagctggagactggctagctcactggggatttatcacaatgtagttggatggagttcggctcctgacttctctcctcgtgttagtggttatatgcctgtttttgtgttgcttgtaactccatgcacatgtgaggatagtctaatgtgatctccttgtttgtgtctcatatctctagtaggagtcctgtaagaatccagagacatctgtgcaccttccttctgccatagtagtaaaagttgcatgattatggctcctctcttaaggaagcttgtagtattagtgccaagctcttcatctgcttattctctggacatgaagagacgaagctgagcacccagaatctcccacagttctgcctttacactcagtagagactctatctctcatggattattggtcagccattttttaaaaggattgtatatttagttatttctatgtaggtaggtgtgtgcacatgagtgcagtgcccacagaggccagaagagggtgtcagatcccctagagctggagtggttgtgagctacctgatgtgggtactgtgaaccaaacttgagccctctgtaagagaagtatgtacactctcttaaccgctaagctatctctccagcctcttaatttgtcattctttttgttgttttgtctcgctgtatagaacaggcaggccttgaactcacagagatccacctgtgtccctagtgaagggattaaaggcatgtgccaccatacctggctttattggtcattcttaatgtggctgcttgttcctgcccttctctaactacccctacatgcacaacgttaaggaaatgttgggtcatgctggttgctacagggaatattgtgtgacctcctgagatggtcactgaatggtagggtagctacctgggattgtcattgtgagttaaaagtcacatgttctcatggaaacaaggagagggtctcagttcagaggttgctatggtaagaacattaacactgtaatacagaaacccaagcagacagagaacaagggcttctgggtagagaaaaaggagggcctcatgtgactaccaaggaagctttagagttgacacacagcagggctgaatacgggatggattgggcacatgtttggctgtctttctttagacctaagttggaagtcggggtaaacgttaaggaaatgctgcgtcatgctggttgctgcagggaatattgtgtgacctcctgagatggtcactgaatggtaaggtggctacctgggattgtcactgtgggtgatggccactatgggcaggagggtggcctcttgaaatggtcaccatatgtttaggttcttaggttccctacccgataaaaataatagccagagaatcccagtgccatgcagaatgccagtctgggagagcagaagagactgagtgcctgcagaaatccaaaggattatatgcaatatattgcttcattttaaaacatgattaggtaatgcaaattatatacaataaccataaattaaagcaattacacacaaagcagaatacatctattatttagctgttgaagtttatatttagaagtggcttttggtgggtgacagcattcccagcaatagtaggttcgcctctcctgctgtgggcttgcaaagcagccgttctgggttccgttggtgacgggaagtggttgcagtataatgtgcagttccctccgctctttcagtgctggtgatgtcatcggtcactttcacaggtgctgtcttcttggccattggacattccccttcccctttcttgattccttagtttattcaaacaccaactctcattctcatggagtcacaagacccaagcagacagagaacaagggcttctgggtagagaagcatgatagtcactggattagtccatttaacactatagcaaaataccagaaacaaagtatttaataaagaaattaagtggactggaggggtgcctctgtctgtaaagcacttgccttacaagttcaaggatctaagtttagatctagagaactcctgtgaaagccagatgtggtggtacatgcctctgattccagtgaggacaagatgggaggtggattcacaggccagctagcctagtctatatggcaatgttccaggccagtgagagatgctatctcaaacaaaaggcagaaggtgtccaggtatcaaccccagaggctgtcctttgacctcttcatgcatgctatacatatgggtccccacacatgcgcctgcacacaacatgtttcatgtgcacacatgcaaatgtgtgcatgcacacacacacatacacacacacacacacacacacacacacacacacacacacacacatatatatgaaaagaggcattgcttttgtccatagcggcagaagtccaaacagcacagcacaggctctgacagggctccccaggtacatctcccacggcaggagtagatgtgtattgtgtgcatatctctctgtgtcccttttcctttccctataaagctacccagattcaatcatggtggtctcatgaatacagtactcttgattgtcaaccagaaagagtttaaaatcatctaggagaaaaacttcggagcgtgtctttttctagagaggatggatcaactgaggtgggaaagcccactctgagtgtggacagcaccatcccaggatctgggatccagaactgaagagaaggaagaagcaagctgaacaccagcattcctctctctccacttactgactgtggatgggaacatgaccagcttcgtcattctgccgccaggccttcccaccatgatggtggtatcccctctagaacttgagctaacatagccctccctttttcaatttgtctttgctgggcatctagtctcagaaacaagacaagtaactcaggcaggaacctctgtcctaataactcagcacagttggacatttctgctctcaggactatcaacagtagagtttatattcagatcataatacctgcttgtccttaatgtatgggacaggtcacctttgagttctctgtaagagactcttggatgctagaatggcagagtccccaggatcctcagatggcccacaagtgtcacagacaaagtccagagtgacaaggaaactcagtaaaggcaaggtctcccttgggctgctctaacttctgactttaaaggaagttgctgagcctgagtcaggaggccttgctcagtttcatttccccataacctgctaggacattcggggcactttctccttttatgcaaagtcatgagtcacaaaccagtaaccttaagtggtctcagggctttggtctttcttctccaaaggttgaattttaatgcttttcaaacaaacatccttctgcaattctctttcctcaccaacagatgcttctgtggaaaccattttgctttccactgtttctcaactagggttagcccacctcaagtcctcacaaggttacagggttgggtaggtcagtctgggcctgtattgctctcctctcagtgtccttgtggcttctgaaggtcagatgtgacatccttgggtgggtagacagagcaaagcccttcctgctctggtgtcctgtgaacctgctggtagggtgcatttctgagttacatgactccagacccagcatagctgcctctctgagttagatccacctcctacttccatctccagagtcaccagcttctcctttgccagtcacagggtcactcaggaccatcgaagtcacttgccagtcagccaggctacacgtggtcagtaatcagaagttatcttactgccctgccctgatgccaaccaagcaggtctttaaaaccactgcacaaaactattgtctcctgtaattctttggatctgccctagaattccttgacagaacagttcagctaaacattctaaagagaatcaaatgccccatatgctctgagaccctggaccttgtctggaagcctactcttcgtgtgaccaatcacccaagtccaaatgagatcctgcctgattcccctctctgagctcatctctcctaaaagatagtgtgtccgtaatagtaatagtgtttctgctaacagtaacttttttgttgtttgtagatgatcacagtaaaacacaaacaagggaagtagagagatgtctccatagtcaggagctcttgctgctcttgcagaggacctgggttcagttcccagcacccacatagagtggctcacagttgcctgtatctccagctccagggagtctaaagccactgtcctccaaagcagcaatactcaggtgcacattcacattcacatacacactcgcatatgcacacatatgattctttttcatctttttcttttaaactgtgaaagatatccacaaaaggctgatgcttccatcttcgttagaaacctgattaaactctcttccctgtagggcatttgcagcctataggaatacttggcgtgctggactccaagaccacttcccacagtaacatgaccgttaggggttacctcacacagccttattgcatacctgccctctggggatcttgaggtcttgggtggggccagggctggcatttctaaaatacttccaggaaaggcccctgagttgggggtggtgggtgactgtggacccagggtactgcaatcttggttagtgcgaatagcagccggtcggtcacatggttgctggctcagttcagagagcaccataagtagagctggctgactggagctgaggctacgatgttcatgagccaaattgccgtgatttctaaataaaacagcagaaaatgtgggagcttggaggagggggaaaaatgagctgtacaaaacagtttcccatttcctggtccatcaagaggtataaacggcttcgttggctggggcagacaacccggaagagtctaggcccaaagaagtcaaagctgagggcagaggatggaagtcccacaccgttcacttagtgagtcatctcagggtccaaaaactgttatgtgtaaaaacatgcaaataagaaaacattgcaaatatgcataagagctgtgcatgtgcttgcctgtgcaccaaagacactgtgaagagcaagtttctagtgtgcagatgaacagatctagcatctgaaatgagttcttttcggtactttggggaccacaactgcagcattcaggaagacactggagccagagagaggggcagggacaggccaaagtgaggtcaccgtgatgttcaacttagagcccacagctttaattttggtgtacgcatggtctgaggagtctgctcaatgcatagatcagagttgcaatttgctggatggtcccttgttttgaatgctttcctgaagtgccattttgtctcggtaaaatgctccctaaaaatactcaaatatttttagttgtagagtacaaatcagattgagctgcacatttccctggtgagcaaaagtgatgagtttgtgttcattaactcaaggccatctggtgcagacacactgcagtctgtgaaccaaacgtgcatcaaactcaagggatcagaaagcgcgccagaccccgcattttggagagttgatagcaaccagagggaggaagaggcctcagctatctttttcttttatttttaaaaatcagctctggtgcgcagtgcatcagagctttgcacactgctcagctggcaggcccacaatgtcttctcctcacggccatctgaactgtctttggggtgtgcttccgctggcgaagtcacttcgcccatttccatctccgtgcgggtgggaggaggaggaggagaacgcatggcagttccttcctctacatttctctgtcactgtggaccccagccagagcacgcttatgtgtgcgcacagtttcactgtgagacaaagacttcagagcaaagtcatgttcaagttagctgccacactccaggacaatcctgggagatggagctgccttctgcagagaatcaactttgtgactaaagtcagcctcttggggtcttgcccaagaaaaacccctcgggtagcagcaagctttctgttcagcactttccctagagattggctgaatcgctgctgctgactgctgccacgctccttcctggagggctcaggagaggcccaagtgatggagtgaatgggggtcttcttgttggtccttccttcctcagaggctgtggtgcgtagctttggaatggaggatctgtgttcttgtgtcgggagtcagccctggaaagagagcaggattcgagaatctcttgtgcttccgtgtgatttctgtggggagcccaggtcctacctttcaactgcagttctgcattagaaacctggacatgtttgtgggagacaatgactttgagaagatcagaatcatattgtctctctctcctctctccctctctccattgtttcccactcccactcactgcccttcaccttctgcgttctgtgatgctaagtacaagagccttccacttcaaaaaattcttttgaaccctacacagaacaattatgcaaagaaatagtttttcatctaatgtgtaggaaattttgtatctcaaaaccacaaagattaaacaacggaacaaaatgctgtcaagaagcaaacagccttattctgaaaggggaaacaggaccattggtgtagagaaaaatatcccaaagcacaaggaagagagccacggtgagttctcattgattttacactgtcttagcctgtcccagaatgcacttctcagtgcaagatgctgccatattgcaccttgttgcggccaccccctgtcccagctgctatctgtgggttagcgtttgtatatgcggtgaatgtgtagggacactccgccttgtttgatgtatctttctttagctagctccagtctttacatacatcgtattcttttgctttgaagccatgaagaacacgatcttgcatgcatgcatgaggtctcacctcccactctgcagagaagtcggctcaccgaagtcttgctgagtctcaagttgagtttccacgcagttggactttgagttagtggagcccacactgtttgtgaaatcccactgtgtagcacaaaataaacacccagactcagggcacatagagtggggtcagtgaattcttaagaaattttctgggagatcatgtcttaacccttgtttttcagtgaatgaatgtctattaaggaaaacacagataagcagcaagaagagaataaaaatgatatttttatgtttatttgtctatttatttgtgtgtgtgtgtgtgtgtgtgtgtgtgtgtgtgtgtgtgtgtgtgtgtctgtctgtctctggagtagggtgaggtagggggtatatctgccacaaaaagcatatctggatgtctggacaacttgtagaagtcagctctcttcttccaccatgtgggtcctgggtcactaggcaagccttgcagagacatgtttgaccactgcaccatctcacaaccctatttttattatttttgtatgtgtgctgctaacaaataccttaagcaacaaggccctactatagaatacattctgttttgtatcataacttttcatagatcaatatttattactatcagtactagttacttttctattgctgataaaacactgtgaccaaggaaacaagaaagagtttattatggtttatagtttcagggggttagatttcatcatggcagggcggaggcatgggagcaagtagcaggaactgagagttcccatctttagtaccaagcataaagcagagagtgaaaaccagaaatatcacaatatcaaaaccccacctccagtggcatgcttcctccagcaaggccacacagctcctaagcatctccaaagagtgccaccaactgaggaccaaatgctcaaatataggaacctatgagaaacatttctctttcaagcaactgcaatatctttcatactttaaatgttattttattgtgttgttatcattgccaagttataaagcatagtgtctgttaaatagatataccatggctttaaccagcccagtgtcgcatgttctttgggttgtctgcatttcctccctctgtgcactgctgtcatggttgcacaaatatctttacttctttcaggacaggattgtgtttgtctctttcaccatctgcattgctaggattcttcctccagcttctctttccaccaccaccgccaacctccgtcactcctttttgcctagcacatggtctgggcacgcagagcacatataggtgctgagtaatgatgtacgactgagaagagactggccctggaaggatggagagtgggtgagagaaagtcaactcagagacactgggagatagagtgtgcaccaaccacactgctaccccttcagttctcaatttctgagctagagcaaacaaagtcatggaaggatgttcccagctaaggcattgctgcatccagaagtcctgagtccctggttcttaactatgggtaagagacagaaaatgatggcatgctgtggcagagctagtgcagggaggagtagactagcctggcctatcaactctttaatacatgaaggactggaggcctgggcagtatgacatagttgctgtagagtcaagcaaccaggctgctcttggattcttggtggttggactccagttgcagaaagaagattctgatagaggaaggtcttaggagggcttccacagcagatatgggaaggagtccatcaaatctgagagtctacaccaggaaggcccagccatcatatgacagggggtcagagtaggacagtagagagtccttggagtttgatcatatccagtcatggtccctttccataggaactggatcctagactctcagcaaccgagaaacttgattctcatatttaaagaaaggatttgaagaaatggcctattcacattgaagctaacagaagtccagaccctttgcagtcccacagtcaagatgggcccagcattccagaatactgagcctttgccttgacctgaaaccccttcacgtagctgggaagcctggagcaagtagtccgtacccaaagagaaggatggtttcagagccaggcagtctggataaaccaaccttagtttgcagttcagtgtgttgatcatctctcagtccacacaactagaccctgacccaatctctttggcaaagaattcttaggctactggattggtcattactccccacccccacccccaggttttagaacatacatatatgaggtgcatgtaaggggaagtgtcaatactttgtgaattcaaactgatacttcagatcccaagccctacagttttcactcaactaattttaagtctcatccacatctcttctcttcaaaccaagaatccttgttttaaaaaaacaaacaaaccacagaatgggaacctcccacgattatcacaatcatttcagaataacagtaatagtattggcaccatctagggcaacactgacagcacctcaatgtatttgatgctgtcatcctccctcctcccatgtcccacagttgtattgtgttggcagtagcagaccatagagtccacacatactgtatctcccccttgtagttctccagtcttggttccatgggtggcaccatggttaacactcactttccatctttatgtgatgccccttcattgttccagctgtctgagagtaatttcctagtagattcccagtgaaggctcacctcatggaaatgatgttctctgaattcttgtatggtgattgcagtgtgtgcccttactggaaggcagttttgctgggtataaaaactgtccacacttccttttctatcagaagtgtgagtatattgaataaaaaaaaaagtaagaaaatcatccaagctctgctagcattaaagtattgctatccaaaagcgtatgatagcttaaactcctttgttacaaatcatgtgctcttttgtcctagatgcctagggatcttatcctcagatttcagtcctggagtttttctagatcacctactactggtactggtcactctgggatgatggtctgaagtgtgtcatgcatttttcaatatgtcattttaaacctccttgaatgtgagggaagctgccttatcaagcatgttgacgcttttctgtttcttgttttggctgtttcttctcgaataggaacagttcctattctatgtcacttggttcttctttgccggctttcaggattcggctttttctcaaggaacttctctatcattttcctcatttcttttttgtttttgaaaacgtataccctgaggcagtggctcagttggtcaagtgcttgtctggtacatgaagacccctgagattaaactccagcaccacatgaaacaggcatgatggtacccactgcatatctagcactcaacaaggggaggcaagaggatcagctacatagtgacttcatgaccagcctgggctgtgcaggatcctgtctcaatctcttccctgcccaaaattgtttttaaacttctgtctttcactttccattcttgtatgccactgttgtacatatcagcttttatactccttaaagttctaaaattatcccagaatgtaacttcaggccttacatcatgttcttaaagcatttgtgtccttagaaaacaatattctaaggttttgattgattgatttttggcatgcctttgtgatttttaaggatgccctcctgtaccctagttttccatttctttgagttggttttgtctgggatttcacctgcatatcaaccactacagagagtcccccttctgccacttcctcaggttctcccaagatagagggaggtctcagactcaggcccttttttggacctagggttttatggaaaggtcagtctccaacgttttggaagagtggcttcatctggcctttctggccttggggtccccttctgctacttcactgagtctgaaagccatgcagtggcttgcttttggtagcttccttcttagtcctttggccttcggcttggcctttgtagtctcttgactgctcaataggaattttgctttttgactgcatggctgtgtgaagaccattcctcgcagcctcagctgggtttgtccctctccatgcttgtcaacaaaaaccatggatgtgttgatgctggttccccattggcctatggcttccctctgctttctccggcatgactggctgtctcatgtctcatgacatgagccttattcattggcatacacgttgttggtatcctttcccctagtttggttgtagatttcgagtttaatttcttggtgtgcttttgctatggactatgggcaatgcctcagctagttaccatctgctcagaacccacccgttcctcggtgagatttttaagctgttggtggcagagcttgccatggttgtccagcaatacagtgtcctgtatgtaacacaaagccagcacaaactggcacaaagctttggcaatgtgtcttttcccccaggagaatagctgttcatttaagtggcagaacacaggctctgagcttcgtctaggaggagggccacctctaggatgttagccagggctctctgctacctgctctggggagatagatactgagttacaaaggttcagctctctttctaacttccgtgatgagggggaaaggggttgggccagcctgtggctcccctgcctctgtctattctagtactttcttcagcagtcacttatctgtgcctttgcttcactccctaattataaagcagttctcaacccaataaacagccttgcccagctaatagagccaagcaacaccctggtggcctctgcctttgtcctctgaggctcacagctcacggtcatatctcaccacccccacatttaatgagcagaaaagtattgtttcttgaagacataattcaaaagacatttgctaccttccctcggataacaggccttttgaaaggtacagtgctagggaagacagagcagagagcagcgccactttcctgtcgacatcatgagccactttaatagcttcctagcccctatctggccaacagcttgggagtccgtgtctaaagttcattacgttatgcctgtgaggcttgtgcctggaacctagagccctgtttcatttccaagtttgaatctctaactcgcctttacacactggtagctgagagcaagatgaagaaatggtcctatcgactctgactgtcccccgacagggagacagatatctttgggtacgaggacaggcatcagcctgtcctttcatctcacaagaatcttcaggactgaaaactcagactagaagtaaaaactgctcctgagagacgccactgatcacaccctacctgcttaggaaccctcagccttcctcacaactctcaatgaggcatctacattcggccatttgtttaaatgtttctgtggtgtctggctgcctaaagagaggaactcctcggggtcagtgggtaaagtgcttgctaagcaaacatggcatcagaactcaataccagattccactaagttgtcttctgacctccacacaccctgtagcatacatgcttgagcttgaaggtgcacgcacacacatacacacgtagtgcacatgcacacaatagtaatgaataatttttttaaaaatactactttgttgagtctgaattttgctgtgtgaagcatggtctctggcatacacttaacaccttaagcataagagtgttactcttctatgtgccccttttaccttcctgtcaatgccctcttctccatttcctggaggaagtaacttcctgcacatgagcactgtactttctttcaagcctctgtccgactagaatttaatattgctgaactcctttgttcccaggaagcagagtagaaatgtttgacttggaagatgaagagagatgaggtttccattctggctttggtatctttctgtgagactcagatgaatcaatcagttaagttttctgagcctcagttttcttacctgtaaagtgggtataaaaacatcccactgaaaccttgtatctacaagattactctgataataaatgtgtctgtagccatgcctgggacagtgaaaattagtaactgcctttaactggaagcattcccaccatagaatatgccacccactgccaaagtgaagccccatgacacttgcctcatagatgaacatcatcccctttccccatgttgtggaggacatgctggacaaccagttaaggaaataagaaatacccacaattactctgtgaacaaagaaacccaaaccccaaagtggttccagctcatgagcagtgagggtgggaagaggccccttccctgccctgggctagccttgcatcaagtgttttccattcctggctctttgcacagccctgaccctggccatgccatccatatagagtctagcactcaccaagcagctcttctccctttctccccaccattcccagaggtgagggaggcctcagatagggtccctcctgtaaagtgttccttgcctgtttctaaccacagttccctctcccacccaccccctctttctatgggttctggttcccaccatggcggccgacgctccccacacacttaaatgtcaccatgcaacaacagaaggccatgctgtttctgcagcatcttggggggatttttctctttgatccatttggtgttaagagcactcccaagacatccgggaatccttgccagagctcactgatgtggtttgcatggttggctggggacacaaccagcagagcagtctcgtctctcggaactgcctcctcctaccacttacagcctcctgcagactcccacggctccagaagctcccattcatcttctggtgggagatgtctggtccatagctagggaatatggccatggagtgttctgctctggaccagaagacagagaaggaagaccacagatgctgtgttcctcaccagagcaataggtcagaaggggaagggcccaacatcgcctgtctggtcacaacccctcccagaggagcgaggagctcagagcccctcagcctctggggtctcttttgtttagaccctactgggcaacatcttgatgagactgtatgcagccacattgcaggactttagggcaggaatcaaagcagagtcatctctttgtccctagggactctagctactaaaggtttgttgagaggaataactcttccctcagctgagggtgggagcctatgtgcggatggcatcccggccaagctgagctgaggagacagcacacagcctcgaccggtctaaagactcacagagcatttgctcatcactcagggtccagaggagcccgtgaatttaaattttgattagcttgtcttttctgccaagacaccagaaagggaaggggaaggggtccttggggaattcacctgcatagtgaatacagtgactctttaggatcatggcactctgaagtttgttaggttaggttaggttagttaggttagttaggttaggttaggttaggttaggagggagtcttactctggagttacatcatccaagccaggtcctctggcctcagctgtgctcgggaccttcagcagcctcatagagacattgcttcaggcattacccagggggccatcagcaaaagcagccatgtgtgttcccagcactgtaagactaagaaaaagagtttaaagagttcaaatcacatacacacacaacacatactacccacaatcacacacacagtctcacatacacactcaaacacacacaatcacacactcatacacacaattacacacactgaaatgcattacagtcaaacacatatacacaatcacacaaagtctcacatacacagccagccacatatcactcacatgatcactcacacaacacaaaaccacaatcacacacatacaatcacatacagtcacacacagtcactctcatacacaattacacaatcacacacaatcacatacagtcacacacacacacacatacacccaaacatacacaggcaacaaactcatacaatctctcacatacacaatcacacatacacacatataaacaatcacacacacacatacatgcatacacacacacacacacacacacacagcaatcacacaatcacacagaggagtttgcttgttgagtctttttgagattctaaggggagactgcgggtgagtgacctttttaaaaagcattcagcaatccccactggctctgaatggaccccctctgacctcttcctctccaggtcagcacccaactcctggtcactctctggccccacagtgaaggtgacagggaagattttgtagtgaggctcttcaggtgagaaactgcctttggcagtgctctgtgtcttcctcagactctggtccgtcctccctacaatgtctgcactaggtgcaggctccctgcttgatgccgccatttgcatgtctctgtggaaaaacacattcagatttcctttatctcctttgtccttgccttgtgctttctcaaggagcccaggccttacccatcagactgagctgaagcaaaatgagaagcattcaccagctcttgacctctaagggcctttccgaatctccacagagcagccaaagacaaagaaagagagtgagaagagcccagaagaagcaaactttcagctagttaccatctttttcccccctctgagctcccagtaccgtactcgatttcctgaccagcttgcgcccctcccccgctccctccgagcatctgtggcggtttcgaattgagccctgtacctgctgctctcaatcctcaacataccataccagttgcattgccaaacagcgaactgccagccatctgccatcccaaggcagaatttacattgttttatcttaaaataacgcctccggaatagcaagccacgctatgcatcaggttttaaaattgacaatcagccagaattaaaaacaaataccaaatgggcgtaaaaaaagaacagggtgtgtgtggcggatggggggtggggattggcatttgacagagagcttatttttcggctttttttttttacctgactttctaccaaaatagtcatgccatttaattttatctgcaaccgcaggagctacttatagactgagaatattaacgtcttccttgcctggctctgtggagaactgcaggtccataggcctagagcagtgcatcctaccctaaccccagactacctcagccttatcgcactgggtttcctttctgtgggtcacagaaaacttaggcaggacaagctggagttcctggaccaaggtacttgctgagtcatgggcaaagcacacttgaacccgggactcctggccctgctcccttcccactcttccttagcctgtcttgacctgccattgtgctagagaaggccctccaaccccactcagttcttgtttagttttgtttccttgagacagggttttgtagcgctggctgtcctagaacttgctttgtagaccaggctagcctcaaactcacagagatccacctgtctctgcccactgagtgctgggattaaaggcttgtacctctccacccagcaccccttctgttcttaacatcaacctgtagcagccttcaggtcagacaagaatgaacaggggctagagaaataactcagcagttaagaccacttgttttttgcagaggaccccaagttggatttcaagaacctatagaaaatctagaactccagttccagggagtccaattctgtcttcttacctcctcaggcaccaggcacacacatagtgcacagacatacatgaaggcaaaatgcccatacacataaaatgaaataaatacatcttcaaaaaatttaaaaaagaatggacatgcatatacctgcagagcttgggggacactggggacctgtgatattggcctgtggtcccagagaaagagccactgacatatctggatgggttttcagagcagatggttctagaggaatgttttcttctgaagagaaagaaaggaggcttcaaactcccttctgagaaactgtttcaaggaaaagcaggttgggggaaagtgtgaagtctgagtgggctgaggaagtacaggactcaaggtctatacccaagatgcctgcctgctgcttgagctgtggatgggccgagctgagaggttcagagaaagcccaggcaagatcctggatagcccgagaggccaggcctcttgaggctggaactctctctgagtcagtagcaggggacattggctcacctaactaaatcctccagccttctctagtccagaaagctccagcttagccaggctttggtgtgggtagcatctaagggcagctgttcttgtttcagattgcctagatgggggtacatccttgtaaaagctgactcctgtgcccagcaaggatcaggactctctcccctccctgcaagctatggtcttaagtgctggtctgtctgtccctcttgtgggccccttgaggtaaacagccaccttcctcctctgtgagtcccagacaacatccacatgtgaacatctgatgccttgctaacaggggctgaattgactcacagacctaaggtcctgagcttggagtcccacccctgagaacctatgtctggctagtcatcactcagactccctctatcaagagggagcatccccacactgggtatgttggatgcttttctttttgaagtaacataactcagtttattcttatcctgctaagcaatgagccagcgcaagcacagaacactgctttgccttagtcacagctgccagagtaactgaggaaacactgggacccaggggtcacaagagctttatggagatgcccccattgctctgcctccagtactggtggccctcaccagactagggcatagatccctggaaacaaacagtctgccggacacccactgccaacaaggaagagggtaatcaagctgagaagggaagttgaggaaacccatcaccaagaagaaaacaccaagattgactgatccaagccttagctaggctgtttttcagagacaggggctgcactctatcagtctaggggacaagacagacaggtgtgcttgcttattacaagggacagaaaaggggtgcttcctaatccacaacacagtgaagactttcgtgtgctagtgttggctctcaggatgtaagcagaattgcctaacaatagcacccacagaggaggagcaagggtctcaaagagcagagccaggaagccaagaagccataaagccatgggaaggagacacagagccttacagatccttcccaaccataaaagccatttgtccaaatccatactcaagccagcagtgaggactgaggagacagatggcttggtgggtagcattcctgtcctgtaagcatgagaaaccagagtgtgatcccatcaccaatgtaaaatcaaacatggtggcgtgagtctggaaccctagcactgagagatagagatatgccagtcctggagcttgctggccagccagcatagtcaaccaatgagcttgagggtcacaaagagaccctgtctcaaaaacttagcttgagagccatagagaaagataatcagtgttgacttctagattccatacacacataaatgcacttgtatccaagcatacaaacgcacaaatatacacatatgtacatgtacacacagacatatacagaaacttaatcacacctacacacacacacacacagagcaattattgggataatgcactttgaagctcaaaacagtctcaactccttttgctatatttcattcttaaaattttacttatgtgtgtgtgctcacatatgcaatgacattcatatggaggtcaaagggcaacttgtaagagttggtctctactcccaccacgtgtgtctggagacttagttcttagtctgacttggcagcatacaccataacccactgagccatcctactgacccatcaactgctttaaacagaataaatcacttcatgtctggtgcctctcacccatgaaactgtgaccagaagaatgcaagtcgtcaaaaaatgaggcacgttaaccctgagactaggatgaggtgtggcaccatcgattgatttgataaaaggccaggacagggaagagaatatgatccccactgggatgggtaagtgatgtcccgcaggaacccaggcggtaaagctacatgtgccctcagggccgaagctactgtggccctatcttaccctgattacttctagtgatgagacctgtgcggctctggctgactgtcaacaagatatgtgttctgcagtagagaaacacccactcccttataaaacaagcgcgagcagcacctgaccctgagtgtcatttctgaaggggcttcttcgacagtgctaccctattgaacaaagtctctatctcaagaacacccttaggaggaggaatctgtctacctcccctaataccagagtccagcatcacaattttctttagcttagcatcccctcttccctgttaatgtctcagtattcgttgctctcagatgcctgtggcatccttgcttccttcttacccaggagccagagcagtacattctgaagtggtctttgccagtcaaagtgctggatcttgtagtcccttgccacggagacgggtttgtggaaacatggaagtggggtccaggaactcagaagcaggtgtcaggactcaggctaagggattctcatagagtttaggatgaactgtgtatctgttaggaatggcagaaaatgcatgcgcataccagtgataaagtatttagtgttgagttattaaaggccataactacttcatatttgttcatcttaagtgttaaaaactaaaataactccttagatactcccaactgtgtgctttcatttttcaaagcatcccttgtgaaaagagaagaaatacaagttcttacccccccacacacacacacacctccagctagaatatcatttacatggctaatcatgatcatgaccctactgccacctaatggtagagagccttaattgcagataaagtgccctagagatcagacaccgtattttaaaaatataatcacagtgatcaaggggccatccacctaaagggagtgattttgtgctttgctgtcatacccaagtaagacactttatttttctgatcttgcttgtttttcgcctggtgaggctgcatcaaacaaaagtccatctgaaattaaggaaataatgtaaaagaatcatgaaaatctacagcatatcaaattttaaaaaataggatgtggattaaaataactattaaaatatgatagtttcatgttcacccggtatcatatgggcatacagggcaatagttaaaaaattttttggcttgattaaggtttattagttgcaaaagttttcaaactagtaataggataaattatatgtgtatatgtgaaaattgctgatcagttttctggggtttaaaacagagtaggcaatagaaatacatctataaattcattctctctgtggttacagaagcagaagtttgacactgaagtaaccacataggcagagtttgggcacctagtcctccgtagacccttcacatgtatgttctgttcttgaagaagaaacttaatgccgaaccctaggtctcctttataaacctgtgctttgtcatagctctacttaatgctttattgataaacagaatttgtgttatgctttgcagtcgtagaagggtttctcatgtccttttcattctcccaaccatgagatcattagtacctgtgatgttagctttaattgccaacttgacaaaaccttgaatcacctgaggaaagtgtctcagtgagggatggtctacatttgattggccagtgggcacatctgtaggggattgttttaattgatagttaacttgggaagacccagcccactgtgagtgggaccattccctaggcaggaaatcctgaccagtgtgaatggagagactgagctgagcacagacaagtgagcacgtgaacatgcatgcatctgtctttcggctctagactgtggatgtcctcaccttcttcaagctcccaccactctgactttcccacaatgatggacactaagctggacgcgtaagctgaaataagcccctttctttccaaagttcccctttgttgggtacattatcagagcaaaagaaatgaaactttgctttccaggtaggaaaactattcattcaaggaaagggaatgacctccctgttgtcacacacaagtgtcacaggaggtggggaatttgctttcctgactctatgccccatgcttctcccaccaggaggcattccaagacacaaatcaagaatggaagactcttttatgtatggtggcagagtgcccacgtaaccagtcaaggaatgtcgagttgggtagctggcagtagataacctcacatccaagggttgtgaggaaagctatttcatgcctgcaccgtgtggtgcacatgacttttaaactcagtgtcggctgttatccattctttttttttttttttaatctgacaatgtcatacaagaacagtgaccttatcccctcattatcctctcagaaggcaagaacctggtctgtgccattgggaattctcttctgccaacctctttatcagccacttcctgccccaattgtatcctgagaatctgaagctgccttaggaacaagaagcccccaacaccctccaggggagaagtcttgttggtggtccgggattgacatacatgtttgttattttgctaggtgacttaagtctgcgtgggcagttactggagcagataggtgtccatgttgctgtggagaatagattctggcaatttgtcccagaatgtgtgtcacacatctttgtaggctgggcacgagggactgtgtcttcggtaggatccaagactgctttccacagtcctccctgctgagggtgctcaccctgagcacatcactcccagggatgacatcagactgtatccacgcaatacctctaatacccaatgaagatgcagagttctctgccatgagagatggttgctaaaaaacttaatttgctgtctactttatcatatataacttgagataagatatgaaggaactaaattccagaaggcatttgaaagtcaaaaatgaagtggtttgactcttcagcctctggagatatgcaatctctacattaggggaaagtatgggttatggatggggagcagtgtgcttccagacctttctccctgatggccagagggagtgtcctcagacccacaacactgatcctggcctgnnnnnnnnnnnnnnnnnnnnaacaattaaggtacagtgtgacagtagtgtttgtctcttgtcctcagccatcagcctggcaaagtaaaggccagtgaaggcagctagtgacaaggaggaggcgagtcatctgtcctgatggcgtatgggtccttatcgaagcacgagaggctgggcgcactctgccaggtccccctccccacctcccttctgaggcatccttctctgctttgatgctactattgttctcctctacagtgtaaggtgatgcagggccctaccagtcatgtgtctatagctgttgactctgtcctgcctgagaggcagccttgtggcacctgcttccctgagctctcagactctataaacttgggagatagcaggcacagtctgctcaaaacctgactccacaattctgtgactgggaagtctctccagttctttaaacttccctcccattcttctctgtgtggacggaatgagtctgacaccaagaggtctaggcagagtcttgagagtttgaagcttcactgcccttgtgtttggtgatagatcaaatctgggacgatggtgcagcactggcagacttgtggcccttggaggagccttgtcatcccttcagccaggccatagcctccccacctttcaccttcagccctgcggggtgcagcccctgccgtatgaaccagaggggtccaattaggaattaagaaagaaccgattataatcacaggcctcattgaactgaaagtgctcagagtaattttccaagcgaactctggggagatggttttcactgtgcttgcagatacggtaaacagataaacagataaactctgtgtgtgtgtgtgcttgtgtgtgtgtgcgtgtggtggggtctgtagcatattgtcccgactaaattagggagggggttgctttctctattcttagataaataagccaagtctgagactctgacttagacaactaccgtgttcttagcaacagaaccgagccagtcagagtgtacgtaccctcccacttccctctggatgggaacaaaggaagccagccagcaagcaattaaatgaaactaagatcgaaaaaccataatgaacaaccctgagccattggagacagactgggggtgctgtagggatttgcaggagaagattcaagcagtcaggaagtaatgactgcaataggagcacccagttttgaagcatcgggtagagcttcgttcacaagcctttaaaagtggcggctcctgttttaattattattccctgatcttgaacctggactgagaatgtggctcagtggctgagtagttgtctagcccccacaaggtccaggatcaatatggagcaatacaaatcaagaagacagggaggaggaagggggacggggagagggagggggaagggaagggagaggaggaggaagatagaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaaagttgggagaacactgcccagacaaaaagccagcatgactagaggcacaaaagcagggtgtgacactttgtaaggaccccaggaccaagttgtaccattggagaaagccctctgtaggagcaggtgagaccactatctgacaggatcttgaaggaggtggtcagtgtggtgcccgggtttgggggtccatggaaagccggcgggcagatgtgcgctcattcactgcctttgcccggtgctctgctcagcctgctcctggcttcctccttccaagcacaggaaatgtgggggagacattcccctgctaccaggctgattgatcgagaagtcaggctgccttatgttcagcactgagagctggcgggcttttgttcttcaggccaaattgccaggatgcttttcatcccagaacgctttgcctgcagagctcatgagaagcccagaagtgaacgcacagactgcagatttgaggtttgtggacagagctgtccgtaaaggaggggacagtggtgttcctcagctcaaggcctggaggtgtccgaaatgtagggtgcctcactggagccactgactccccttgtgcaggcctcagcatcctgttagagagcagtgatgaagccaagtttcttgtatggcaggcttcgaaggccagccctgtgataaggaaggtattgcaggtctaactgcagatcagcagtcagtcatataaacattctgcaacttgctccatccagcatgacatccgtctttctgtgtgtcaccttttttgctggggttcagaaccttgcagaaggagctggccaggtcaaggtctttgctttgcagccctcagagtcctgctgttccatttgcatttccccaacttgatttgtctttgaattctcctgagcatctgcacagacaagagggtttggggcctgacctgcagagtcccacctgctccctccttttcttctggcccctctcccccagcttctctcctctccatctcccaaggcattcagaacaaagcagggctgtcatctgctctcaggaagcctgacctctggttagactaaagccatcaggagcaacctgtatccccctgcacacagaggcctctccaggggttgtcagctcagcaccatggacaacccaaaaggatgtttggcctttgagatagatgcaaccctgtcctatcagaggcagtcccattgttcttatttgcagaacagtatctacatggtgaattctttttgttccttgtttttattctatatatttattattgtggttgatgtctgtgtgtctggtatgtgtgtgagcacacacagccgcatgctatggcatgtgtgtgaaagacaaagaacaacgctcagaaatgattccctctttccatgtgggttccagggattgacctcagatcatctggtttgtgtaggaagggcctttacctaataagctatcttattggccttgcctgtgtatatgtttctatcgcattgcctgctggactgatttttgtgagctagtggttctgtgatgcctcagaaagagcaaggaccaaggcgatcctttgctaaacctgcacccagctcttcttgtcctttcagccatgggagaccacatcacaatcatagcaaacagggacagttagcagattagttaggtttcaaacctggggcaagtggctgaggtgcctatttacatgtcaaagtggaccaggcctccaggctctcccagcatccctcagtccctcccatatcctaccctctaccctgaagtctccagcccggggaggggggggggggctgggctgcccttcccccagaggctcttccctatataatccagacagacattttggttactcaccccttttatacctttggccctctggctgctattccttatgccactctctctcctctaacttcctcttcccctctccctacatggcccatctctctcagatgcccctgcttctggctctgctctctcacatatctataataaactttctcctccaccatacctaggaacagtaatgttctttctcctcctcctcctcctcctcctcctcctcttcttcttcttcttcttcttcttcttcttcttcttcttcttctccttctccttctccttctccttctccttctccttctccttctccttctccttctccttctccttctcctcctcctcctccttctccttcttcttctctctctctctctctctctctctctctctctctctctctctcttccttcagcaagcacacctgcagtgtcccacaacctgatgacagccaatgacttgctgggggattgtccaggttgtaaagtaaggacttgacagtcagcctccacagccactcccatcgtgtggtagcttccttgacttggcttctgaatgcagtaggtaattctgataattcaagtgaattacaaaacaccacagacattgaggcatacctatagacatgcctgtgagggtatttttagagaactttagctgaggagggaagaccctccccctgccccctgccaatttatgtggcatctttccatggactggacttccagactgaatgcaaagaggaaacagataaagagcgtgccaatggtcccattctctgcttcttggtctgctgagatgtgaagagtcctgcccatacctcccagcaccacgaacttccaccctgccatttctacatgatgggttgtaccctcagtctgtgatccaaaataagaccttcctccctaagtgttgtcacagcaatgcaaaaaacaaacaaacaaaaaccaaaaaccaaaataatctgatacaccgaggaagggagcctcccctcttgtggtttgcatctgaagtgcctgcaagtttgtttaaaggcttagctctcagactgccattttgaaggctcatggagcttttaggaggttggtctgactagtagaaatagatccctgggaaagtccctttgagggtgctgtggcctcttggtatggcctgcttcatctgcttcctggttcttagcagatgggtgtagctgctctagtcactgtgccttctctaccataataaaccataatcagccatactttcttccatgctacacttccctctccaatttattagagttttaaaactggctttagttgccttattcaacttgcttaaacaaaatttaaaatcatacttagttacttgtgtgtgcttgcctgcacacatgccatgccatctcattggcccattgtattcaactctgacaagtgtaaacattcagtggctgtgtaaacgagcttctatatgcagaggactaaatagagacaactgagtagaagccctaacctctcaaggagaccttagtctagtgaaagcagttagctcaggcagagccacagccagtccacagattctgtgcattaagaaaagatgtcccttaaacttaacaggttggggtcttaggccatctccattctctatgtgtactgggtaaaacttccagctccttgggtgtgactcaggtaggttcacagagctatgccttctctttccatgactgtttacaacccagtactgagagatgatggtggggccttttcatgaactggcttgcaattctatctggaacagttccccctctatacaggtgggcccagccagagggtcaaaaccaggccagtgtgcccacatgattctacattaattacacttgacactcttggctggcatcctccccaacgggaaggtggcctggatccctgtaaaggggatttctgccagcatctatacaggagccctgactggaagcacagcatgccttgttaggaaccagatcctttgacgtcactcacagtcattttttctgtctgccagagccatagttgatcttataaccatatcatgtggtccataggttggtggatgagaaaaggacatctagaattggtgagaccaaaggtggggatgtgtttggtttttgctttgttttgttttaatcagaaatgtactctggtttggcccagaggcccggaggaagctgtgagctagggataaggagggtctctcagaactgtggagctgcctggcttcagctcttccatcagatgggagcctcccctgggcctctaccttaatggtaggttttcaggctaactcccactggccaagggccagtttagaggggctaagggctatgactgtggagctggctgtgtcctcaagctggtcactagaacccactctgcactgtccctggcccaccaggaaattttctgacaattctgggatagggagatcccagtttgggtgtgggcagtgagagctgtgtgtgacccctccaccttgggagctctggccccagcacagaagtatctcatcattgacacctgctcaagatgtagaccctaggtggccaggctggcagacatttttattggtgactgaattctggcaacacagacagtaggagccatggctgaggtcatgcaccctgggtttgagtctcagctctgtcacagctagctggatgtctcttcccctccactccttgttatagaaaagatgaagatctggcttgcaagatgcgcagcaggtaatgatgcttgcctcagacctgatagttctgttcttgggatccacacggtggaaggagagaactgacttctgtacgttgtattcacaccacacacacacacacacacacacacacacacacacacacacacacacacacaaactgaatgaatgaacaaatgtaatttttaaaaaagtgaaaagctgcagggtgtattattagatcagcccaatgtgtccagtatcaacagcctctatgccttaagatcctactttgacaacagaggagaggtgttgcctattaagagttgttaagtgagcggctgtctcaaagcagcatcctgtggatagccctgtggtcagtcaccaccctcccgggaaagcaggagggctggcttacccctgacctgcctgcagtgacctaaacacccctgagagctgcaggcgcttccagtgagggtctcatgcccagcccccttgctgcattggtcaccttgaccatgagcaccttgaagaaggcttgacccttgaggtcacagagcctgctggctgcaaagcccctctccttcagcttacaggtgcggtcctgatggcctcagtgccctctgggaactttttaaacactcagatgctgcctgcccttgactcagaaaccctggagtgggtccggagcatgtgtgtagtgactctgcacaccctgcatgtgttctggggcttgctccaatgtgacagccactgcatcagctcactctgcccaccactccatgggtctggcttacacgctaacctcatcttagcattcagacaacgctgcagcggctgagacaccttttaaaccctcacaacccacgcctgtcacagcctcctcttcctgtctctgtccccttgtacacacaatgcttcctacccagagggcttcgcttcacaccgatgtccttgtgatgtccactctgcactaggttgcctcataaccttggcgttggtcactttccactcctgtcaactgtagagcactctctccaccatggcctgctttacatccttgaccgtcctgccctgccacatttggcaatgtgtcacttttcactattggacaggtcacctgcctgcccagagcaaggtcaacttctggagcattgcacatgacctcctgtcaaccccatgtccaaccttgcttgtaagctgtggaggccactggaaaagattacttaatgaggggggacgattaaaatagcaagccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtctcccagcaggaaggccccctccttcctcttctgctcctacatctaccatagcacctcccctccccaccccaagctcattgattaacctctacgccccctagtggtagcccctttgtttccacaagaccaagacttattctctcatcaaaagaacaaagctgttgttttctaaatgacttggttaggtcataggcctaggctcactgattttagggcgacctgtgggggtcatcttcatgcctttgtcacccctgtccgttgcagtgacctctgagctgttctgtattgcccaaaggacaaagtccaatcttcattacatgacaaactgggttctttgtaatctgactcatggatcacaaacccagctcagacacctgaaagatatatgggagatattggcttgcccagaaaacaagagaggctgggtatgctatgaacactaattagagaatgctaacctgcacatggtcacattcaatgtcaagctccagggaaagagaaacaaaacagtagctggggcttttgttagggatgaagcccaaggtcttgtacatgctagggtctgatgcagaattccactcccatacccagtaccacggagcttgactttgaccccatcttctactaactgccaaccattccccaaagcgtgccagcctgacttgagtgaccacgttcccactggcctacggtgatgttctttggcttctctgttctgtttcctatgattcctatgcctggaacatctctttcccatctggatgcttcttccccgtgcttttagactcagtcggaagggcttcttcttcctggaagactctcaaggctcacctaggaagatggctagcctggggcagggttgctgctcaggacagctccccattttgcctcctttttgggagcaccttgacaattctgtttggaaacatcccaaaaggatatcccagggggcttgcttatgagaaatgctaattgcatgaggctatcaggctatttacatttagttgccttctccttttaagactatgttggtgtgtatgtgtatgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagactagaagcagaagagatgatttcctttgagatctggggaccatggcaaggatccctagagtgctctgactgtcctgaagactcagttaccctgggtctatctgctccctacctatcgtaggcactggccttcttgggatcctagaggatcagaggtatgtcggcatggtttcagtcagcaagcatgaacagattactactgggaaagtaggatctagttagatagtagcctttcatcttgggcagtgtcttagttagggttttactgttgggagcagacaccatgaccaaggcaagacttataaggacagcatttatttggggctggctttcaggttcagaagctcagtccattatcatcaaggtgggaacatggcagaatccaggcagacatggtgcaggaggagctgagagttctacatctttgtctgaaggctactaggagaagactgacttctaggcagctaggatgagggtcttaaagcccacacctgcagtaacatacctattccaacaaggccacacctccaaatagtgccactccctgggccaagcatgtacaaaccatcacaggcagtgactttattgcgacccagtaaagttaagaggcttcccagatattgtactgccccagtggtcatgagcccaggagaggctgtggatttgaatagcttggttatggctggctaaggttttattttagctggagcagaagggccacccgtttctctttctgctcaagacctcaggtggtaccattagctcaggagtctcaaacttgaagacggctctgccctagtctcaccagctctgtgctcccctctgatttttggggagtccgtggctctggcctcccgtgtcttctcctgacacatggaatttgagaagataccagtagctagagttccccgatctgagtgcagtggacagagctgctggtggcagctggtcctatggaccttcagggagggataccttgagtgccctgtttgcacaatgaccagacactgtcattctacacctgcctctcatttggagttctggtctagagtcataaaggtggtgccaggagagaatgctgccaacatttctcatggaaatctatccaatgggcctttggggtctactagctagagcttcaggcggcatgcgcagtagctttactttcagattcacaggtggcagagagtggcaatagcctacagagatcattgcagggcaagagtgctctctggactcttcctcgtaatggaaacctgggctgagcttggaagagggcctgctcagtcaacaactggctactggtagagactcagatagccagtgccagcccctcactttgtcatttcttaacccacctcccatctactcctctacccacccctccctactccttctgctccctagtgtgtcttgctcttcagaaaacttctatgggatgtattgtgtggtagtggggtcaggtaagtggctctgtgagtacagtgcttgctggacaagtgtggagatctgactatgatccatggaagccacatagaaagtcagatgtggtggcccatgcttctcatcccagtgctggggaggcagaacaggaaggtgtctgttggacagtctgtccagtctagatggcaagcacagggacctcggtaagagattcctcagaaagccacagtagatgatgcctgaggaacgcacagacacacacagacacacatacagacatacacacaggcacatacacagacacacacacagacatacacacagacatacacacagacacatacacagacacacacagagacatacacacagacacatacacagacacacacacacacatagacatacacacaggcacatacacagacacacacatagacagacacacagacacatacatacagacacacacacacacacacacacacacacacacacacacacacacacaggaaataatatgaaaagaagcttccatttctcttgcagtgctgggtttgaaaatagaatctccagaccttcttctttagaaaggacaaggagtaggggtttctctggcattccagaagcatccatgagagtaattctattgccaacatgactttagaggcagcattggaagcccagtgacagcagaagcccagtgatcacagagcccattgatggcagaagtgggccaatgacagaagttgctgggctgccatctgtaggtgaggcagaggtgggtgtgcaggcccagtggcacacctatggagtctgcaagagtggcttagagaacccatcaagcctttatgcattctgtacgtgagcagccattaccccccaactccctgtgtcagtgtgtatgtatgtgtgtgtgcacatgtgtgagggaggctgacatatgtagtctattctaactcaggctactttaagccccactgaaagccacttagtttggttcatgtggctgaaaaggtcctgaaacatttcagtgaaattatagcttcctaatttaactacctgtcacttagcttctttccaggtggtttcgggttgacagtgagtttgacatttgcacaaatgtttaggaaaccatttatgacacttcgaaataggaaggagtctaaggtgcatttactccagggagcacgggaggctttgttcttctggacattcttctggccactccaaattgaatctctcttggcctcactccatatacacagagcccagcgataagttgagaagctggggatacttctaagccacctctgtgaccccctcctgccccaatgcccttcaacgcagcgagttcagcttcatgtgggcacagctaaggcaaaaacattcatgttcttcagggttctgtcagataaaccttaggggccatcttcatctgttcaccccactctttccccagagggtcagaaggagggaggcaaactcgttcacatcctttgatgtttactcctctctgtgacctgaggtcacctctgctccagacagccacacactaaaatgttatgacattcacctgcctgttatataatagctctgagcccagaccttgtagtttaaattagagacgcctggcatatagggctgtgccatcctgaacaacacgtgacaattcctctgcgccctgaagggaagggggcggcggctctccctttgaaatagaagcgtgtccttatcctcaagccacttgctctgccgccttcactacggatcattggtggccctgtgctgtgctggcagtacagaaaaaccaccccctgccctggaacaaagtctaagggaacgctgagaaagacctggtggtggtctggcacatgataacctttccagggggccttaccacagaaatcagggcatatgttgctttctctaccctctttgggaggagagaagggtgtctggagagaagctctcagcctaggctgtgcatggtatcacccgtgcagtgtttagaagtccccagccacagtcagatatttaacttgagtgttgttcaggggtgtccaggctgagaaccatgtcagtgggttcatgagtcatgtcagtcttatctgggaacagtaaatgaaaaataagcaattctataccttgctagaaggggtgaaaccgcctttgctaatgggggtactattagaatggagtcttggggttgggaacggtggtcatgctcaactctgaagagggcagagaagaaggtagtcagagcccaggagtggggtgtggtggtacatgagagttgcggaggattctgcctctgtccaccgaagggtgggttgggatccccatcagatatggagggaatcttacggtgagcacagggatatctggttaaatcagcttggtgagattcttgttaaatctgagtgacataaggagaaacataaaagccccaagttagagccttgttcggaagggtgggttgaaggtgaaaccccatagtctggccttcctgagacaagcagcctggcatcgtaaaagatctgtctgtcatcgggacattaggaggtgatccagccttccgggttagtcttggcactggaggggcttgctaggcagtccacatggaaactcccagcaggcagtgaggaggtagggatagagagttacacacatgggaggtgctgacattgaagtggtatcagcaggcacaggtgaatcatgactagcctgagtcaccaggggaaggcttgaggtcaagggtaaaggcatagcagcaagcactctgcagagagcaaaagaggagttggaaaaggtgacaagagggagcagtgacaatgtggcattgtagacacccactatggcttgcataggggtgaccttgtgtgtgccttgtagtgtatcctgcagttgtctggttggtgtatgtgtgtggttctaatgacccctggtaggtagtctggccagctatcctccagggtctggctatgctgtaggctgtccagccagccacagtccccatcctcacccaccatagaagcccacgggctccccaagcatctgtgacaggatggaaggcaaagtgagtatgtatagagaaggctggtcacagtggcgtgtgcctttcatcccagcgtcctctgggcaggcatccagagctccactctctgccttcgtctttcccttgtgccctctcctgggacctggtttgtgatgttctagttgctgtgggtaaaaaccctcagtggccaagcatgtcctgtaattacaacaccccttggctaagtgtgtcactgtgagtatacatcacgctagaatcagcgatgtggcccgtggccatcactgttcctgttgctccttgtttttgtcacgggtgatattggaaaaagtcaaactagttgacttcaaagtgctgtccccgccctatgaaaatgacccatatgcctgggacacgcacttcacaacaagggcaaggcctctctcactacccataactgtcccacgtgccaaaagaattcaggaacatcagaaagcagcctccctacccccaaagcatttctatttagtgtgagaaggcaggaggcccttctgcttgggctctgctcctgactctggccgcactcattggatggtaccaggctgatggtttccttcacaagggtggccatgtttttgctcccttgtttcctttggtgcagttttcaggtggggcccaagtgctaatgtctgttatacagatgacaaggatccattaggtttgggtgaaatgggcttgcactctaggcacacaaaaatgcctccctcgaagggaatggcacagtaattctgtgcatgatgtgtggttactacataaggctctggacacaaggtgccctgatgacatcggagatagtgactgtgatgtaaacagaatgcacggttcatggctgtcctggaagaggtctgcacactcaatcacagtgcagaaatgtaagtgctcagggatggcctagttacagatgcctggtgttgcgtctaacctgcacagaggcagctgctctgttatgtcaccagcccatggatatggtcagacagctctatgaccagtaagtaaaccagtactgacttgaatcaggatgacactggtgcgatgtgaccaggcacctggtcactgtgcaggtcctatgtctgtatgtgagtaggtctgacatgagaacgccacatgtgagctgcaggctacccagcaaatggataaccagacagctgttgtgactggatggctcataggacttatgtagcataaatctgctacaaaccctaggttagaccctaagaccagaaccacacccatgttcacactgggtttctagggatttgatagcaattggctagctctgcaccctggtatgtttagactgacatgtaagtactatatcacttcatcttcctctgagagctgttctcatgagtctttccaggagaaagaggctgcttggtatttctttgttagagaagccagagctagcattaggcacctgcactgttggcagccagagcctatggtcccaaagataatagcttgtgttttcaaacaaactatctccatacaccagagctctaccagagacagagactccaagcccccccccccacctcccccttccctttgtgcagcccagcaaagggggtgggggagactagaatggtggcaacaaactctaccatcccagggctaaatgatcagcaaagcacttgcactgacaagcccatttcttagaccactgggcaaaggccaaacactctaaatctctagttgtatttaggggcagaagattgctatagatcagagtccagagcacatctcccgagagctccagatcttgttgtgtcccagatggataattggactagtaatacaaggataatgacagaaataacatttctattactttagcctatcagtttattaagaaaggaaaaggacactcctgagtggaagtgggctagtgagctgggcctcaagaagttctgatcctttgtgggtcatctgcatagcaccagccttcactagaaggccttgtagactgttcttatacatagtatgtttagctacacatagcccagggccataagtttctgatctttctaccaattagcttccttctataaaaaatattttaaaattattttctgagaattgtatgtgtgtatacaatatgttttgatcaagtccaccctgagtctttccccactactcctatcattttccctcaaatcttcatgtacactatctttagtctacagagtccaattagctgccagtatgtcataggtgtagggccatacattggggaatgacaacttacttgggggacacatcctaaaagaaaatcaactctcccttccccagaagccatgacttctcaatggctcctcagctagtacgagggctaaaacatgaagatgagaccctattgccaaagacatcacgcacttgcatcgtatgattcaaagaaatcacacgaacacaaagaggccacatgaatggagcaggggaggcagaggccacgggtccaggccagattgcatgttattgcagaagtctgggtagcatcttgcacgatccacctcaactcagagccaggcatactttaagactgacgtgctgcccactgagctaagaagactacaagccaggcatgttgtaatcactgcttcttcattcatggtgaaatgttgggaaagtctacatttcctgatggtgcgcaccttgtctacaaaagttctttcagtacaggtcagttgaaaggctccctggagcccagggaaaacacccatctcccatctattccacattcttcacagcttctttttgctctacctgcttgaagaatgccaaaggccatgagactctgtacagttaattttattttatttataaagcatcttattgcttcagaggcaaaaagaacaaggtggtctgaagcatatagcccccggctgaagtttaacggggcacttcatagagattcctgcttctgtcagtcttcacatggctgtccaggtgggccacactcaagcaagtgctggcttgtccacgctgctcatcagggtctcatggaagtcacccatctctgtgtgtctctccatctttggcaaaagcacagcctgccagaaggaaggcctcacatcgctccaatgcatgctcttcagagacacccctttctcccttcccgagccctcccctgccctgtagtctacttaccatcaagtggcagcagctgtggaaggagacaccacttctcaaagacagagatgtgtcagttcaacaagttctcatttccccacaggtagagcttagtgcagaagaggctgtatcattgaagggaaataccactgggagggaaactagagacacagagcagggaaatggaattgagatagctttttacgaccaatatgagaattaactcacatcgtggtcccctgagcacggcctgctgctgctgctctctaggatgagtgcagatgttgttagactctgcaggggaaggacttcaggtgaagcctggaacatgatgccagttcatgtgtttgttgaatgcccttgggcatttactctttactcaggggcactgcccttagaaatgtttgttagctcagcatggtggcacagatctttaatctcaacacttgggaggtagaggcaggcatgagttcaaagccaacctgctctacatgttgagatctaggccagctcaggctcaatagtgagacattgtctaaaaaagaaaagaaagaagtgtttctagtaccttctttttgttttgtttacttctgttttgttttgtttcttcacacggcacctttatttagaggctcaatttgttgagtgaatgaagttcttcaagtccactgagggtgagggtatggggtgtggccccaacctgagatggcagcagactattaccatggtggctcttggcctgctcccatagagcctcccagatcttggtgagagtcactgggcaaagccttcctggggccactggtctgatatttgtgccccaaggcatgccctcttggagactgctgtaaatggccttcatccaagcagcaacatctcaagtgcctactgtgtgccagattccacctttcataccctggaattctatgtaaggtttttcatccccagacagcttggagactagggttatactgtgagttgtataccacagctgtgtttctgctttagcagcagagaaaggccgagtgacccatgggtgtttgttttaccttgatccccagatctcttacaccatgtactccctctggccctgctgtgtttttctgagccccctctgatgtttatgaaataaattgttaagtataaacaaaccaagggtccaaatgactagaaccttctcttctaaacatggattctggtactttatagaagctccatgagtgtctattgggccgagcccatttgcaaggaaaggcagaagaccacagggtttggggggccaggattctggtgggtgagttcagtacagcatgccataggggagcaggagagaggctgccaggggctggatgccctgtcctagcaccattggctgatccaggctttatcatgggctgtccagaggtccccttgacagagagccctttcttccccgtggtttcatctaggattggagctaaaaacaggctggcacacacctctaagtttgagcagaggccactctgccagtgagcattactgagtcttctccctactccatactcttgctttagattttcattttaaaatatgccacattgaacaggaagatgtttttgaaatattgggtatctggatgcaatattaatgcaaaaaaaaaaaaactaaactccctcttgaataagacttttttttttctcagtctttaggactttttattcctgttgttctaaattaccagaaaagggaaaaaagagaaacaaggctgttgtcacgttgctctgacagacgaagtggacagacacctctgctccttcttgagctaaccttgaccctgggctgtcatatcatcatcctgataggcagaacagacagagctcaaagcaaactggtaataatgctatgcttctgataaaagaaaacggatcttttaagtcctatataggaatctacattttggaggctattaaaaaaaaaagtaagtgtcagactaagaatgaagctcagttggtggagtgtttgcctagcatgcatggaaccctgggctcaatcctcagcatatataaaccaggtatgatagcagatgaggtggtaatctcagcacgtaggaggtggagctggaagatcagaagttcaaagttatcctcagctacatagcaactttatggctagccccagatacaggagaccaggtttcaaggaagaaaaaaaaaagtggtctttactggccatagagataacttcatagactcctccccaatttttttcagtgtgtgcacacacacatacccacatacacacacacacacacacacacacacacatacatacacacacacacacatacttacacacacacacacacacacacacacacatacacacacacacacacacatacacacacacatacaccccaaatctaagaagctggattcctctcagtcaacccaaagatgattcttcttcccacactcctggggataggcaatccacacttatgtgaaaggtctgctcaccctctccttgtgatgcacctaggaccattcccttcctagcaagagacctggactctggctttgtgccatttcgtccacctgcccccatgttgctctagtgtaactgccctttctgcagaggactgtcctcgagggcagaagggaggattcctggagccactctttcagtaagcatccctttctccccagggagcctcaaaccctgtggacccaccgaggtcacccactgggagtcctttgctctgaatccttccaacttgtcagtgctgtcaacaggagaatgcggtacccaggcccaaagaggttcttccggccatgcagtgccatgcccctgcctcagtgctgaggagatgctgcctgctgccagcaactcctcaccagctgcacagccaaaaataagtcctcagctgcacagggctgatctttccgctccccttctcctcagaagcgagagtccagcagcctgccagctggaactggagattggggtttttttccacccagctgaaaggaaatgcggtgcaggttttttttctttctttctttctttttctttctttcttttttttcagtttcttttttaaccttattatgtcaaagaagttgtcttgttcttaagggcaaaaaatatcaccattgcttctgaattgctttgaaaatagcattgggaaggggaggcatcaagcttttcccagctcctggcagaagcacctatcaagggaggcagatgcagccccgtttgagtggagggaccgctctgggaagaagcctgaggcttgagttaggctcagcagatctgctgccagccttggattgataaagtgcctatttgcacagaggacaggagcagctgcctaaactgtggaattttccaagggctgcagaactttaaaagcggagtttgaagtcatgcattcctttatttagcaaatatttatcggcacctgctgtgtgccaggttccggctggggctgcaaaggtggaaagaggacagtgtctgtcctcaagtgcctcatatccaaggaaagaaactggcacaaccaagatgagaagcatgggagatctcctgggctgagtgttttgtagggtcaccacccactacagcataagaatcatgacaggggactgggctggttccaaggccgggtatcagtactggtcagagcaatagatggcagggatgcacagcatgtaggaaggaggtgcacagccctggggacaatccagggccattaccaaggaggtgacaactgagctgctctggagatgttcctgacaagggacttgatgggagaaggcatgaggattcaaataactgggaccagaagcgctttgggatgtggagaatgatatctctctctctctctctctctctctctctctctctctctctctctctctctctctgtgtgtgtgtgtgtgtgtgtgtgtgtgtatgtgagtatgtgtgtatgtggcagggctgagactcgatgagaaatgagaatactctctggaaggaagccagtgaacaaatcagagccagggccttgagatctacatgacatggagccaattcaactgtgtgcttgcaatgttcttgtatgtaggtggtgtgcatgtgcttgcatgtatgtgtgtgtgtgtatgtgtgtaagaggtgagtgatcaaggctgaagctgagaatatcaaggatcctcacagtgtggctgatgaaagggaaacccaaagagtgggaacagatgtgtgagaagaaatacatctgtggatccaggctgactctgaactctgtacctgctgtagaggccttcaccctgcaggccatgacagtctagttgagagatgtcagaatgaccttcttgtgagagtcacattgctgaggtggcagtggtgtgaggagaaggcaaagggggcacgtttagcagggcaggactcacatgaatgatcagttgatttccacaagagtgttattatgttcctgtggcaaaatgcctggggtggggggttgggggggagctggtattttggttcccaatttcagaggatacagtacaccatagtagctgagatgaatttattattagtagtggggatatgagacatcagctcatgggagatcacaaagcagataacaagactggaagcagggctgagccatcacctcaaaagcgtggcctgcctcatccagccaaggctcaccacatcccaaaagttcctcagcctcccaaacagcgccaccagcaggggctgaaggttcaaacacacgcacccttaagggacagttcatattcacaccataacaggtagtcatggggaaaagtcggtattttcaacaatggtgctgggacagtgggacacccagatctcagattggaggtgagtccttgccttacactgtgcaacagcaagctcaaaataaaccacaagcctagaccacaagcttcaacagtgagccttttgggaaagacacacaggagaatcttaattggattttcagaagatttgagggagttatactttggtttccgggctgcaatagccacagcccagacaattcaagacaaggaaataaattggacatcatcaaattaaagacttatgtgcatctacaagttgtcaggagagtgaaaagatagcccatcaaactgaggaaagggttttcaaatcttgcatctgataaggaattagttcccatgttgtagaaaatacttcccctttataagaaaagtacaaataacacatttcgaaaatggacatcagctggactgtgggtcagcaacagaagcccccgccttatttatctggatacctgggttcaggtctcatcagtgagaaaaaaagaaaaaaagtattacagacatttcaccaatgaaggtatcaattacctaataagctcataaaggagtgcttattaagaaaatgaaaaagccaaattaaaatgacagtgagatacttataacctcaaggataaatgctattttaaaatatagaggatagagaatgagaaatgttggagaaggtgatacctgtgccctatgatgacgatgtaagaaggcactcccctttagggtggttcctcaaagagtaaaaagttcctgcatctcatggtccataatggttgccatcttgaatcagagcatctgtgatcaccagcaggaggttccttgggttgttgggcctattcaccttccctcctcaagaaactagggagactaggaaaccttcatgatatctcaataggtccctcaactccccatgtatatgattattctgtttttttttttctgttgctatagtaaaaataccctgaccaaagcaacttaagatagagaggatttacttagctcacaattccaaggtatagtccatcaatgtggggaaatcaaggcaacaggaacttgaagcagctactcccatcatatgcatggtcaaaaggaaatgagcaaagaattaaggttcatcagcattgagctaggtttctccttttgaatctagtccaaaacctgaagcctagggaatgatacagcctacagtgggtaggtcctcccaaaccaattaacataattaagataattcctcagaaacattctcagaggcccatctcctaggtgattctagactctgccaacttgacaacagaaccagcatgagaagggaaaacaattgagtggagtttcttccatagtgtagctacctgtaagctgcccatgagattctctggcagtgtagctgcctataatcactcatgatcgataaacacattggttcacaaagatggacctggatggaatcctttctttgttctgttgttggcctctttatctgtaatgaatagacatttcttaagtaaggccacccaggaaaagtcacagggcacatagcaatgctattcttaagtatatactcaaaggaattgaaagtgggaactcttggtacactaagattcacaggacataggtgataggtacactatgacaggcatacaggtagattaagacccatatattgtcattcacaatagtcaaaagagcaacaacacagttgttcatttattatggacatatggacaaaaataattatgacctacacttatactagaataacatttagcctgaaaagaagtgaaatttaaatacaagctgtaatctgagtggcccatgtaggcatggtacaatatgaaataagccagacacgagcagacgagactgcataatccagctaccaggcaattggaataggcagattcactgagatgacaaatggaactgaggttccaggagctgtggagccattgtttaaagagtagagtttctgtttgggatgatgggaaggttctatgggtgacagtgatggctgcacaacactgcaaacatacttaatgtattagactccacacataaatgcttcaaaggtcaatttcatgtaaagtaaagaaaaaggcagggcagaccttgggcatgggaggcccttcctcagattcgctggctctcccatttggagctcatctcaagcctgtctgtagatgatggctactgtcccatcccttcacaactcccatgacttccactgtactaggcttcattccttcctattcccaagcatttggctgatatggagtttacctaacctgggaagaagctctgatggcatggtcctcaactttcctaatgctgtgaccctataatacaggtccctaagcatagaatcatttcattgctacttcataactataattttgcttctcttatgaataatgatgtagatatctgatatgcaactccaaagggatcatgacccacaggttgagaattgcttccttatagactgcatctgtccctgccaggttctcaggacatggtggagagccctgataggccctgttactgcagccagctgcagtgttggtgggtttcttgcaaccagtagggctttcatggtagaaagtcctccccactcacagagcatcctcttgccatgtcttccctgaggtgggaaaccctgaacccacgttttgcacaatatcatacccacgagcaaccatatgatactcaccgtgtgccatccatagcccaggttgctcagtggaagcaactggaaccctagtgttcatttccaaatatggaggctatcttgggagagaggcacaaaagcagtaagactatgtcaacatggttgacatagaaaccccatccaaacatgggcaagggcatgccaaggaaatgccctttgcacaaaatgcttagctgcaagtgacctgcaagctcccaggaggatgtgtttacatggtatcagtgaggagttcctttgcagtgtagaacccataaggaattttccacactcaatgtttaagatgcacatttgtttttccttcctatggccccggtcatatgcctggttcctcctgctatttaggagagtttgtttctgaggactgaaaagggcatcatgtctactcaactctatgctcacagaccccacaaccaaagcgccccctgggtagcaaagtaagggcaagtacccagaaggaaggtggcagcgtcaaggcaactagagaataactcctctgtgcatcaaagccaccacacttagttccaggaagctgcagattcttgctcaccagccatatcaatgagaagccatggatgcgactgttctggggctgttcagggaaggttctgggaacttggcacctaggacaaaatgaacagtggacacaacccagaaagaaagcagacacaaggaatttagaatccagatgcctcacactgtaacatctctaagtgacaggcccagtcacagggacaaatcttatggccctctgtgagagggagagtaccacgtcttcacacagcccaacagacctgagctgaaccagctgggcacagggatgctggggtccctgctcctgcagaaggaccctataaaccctgtggctgctgaggtgacccagactgataggaagctaagagaacccaggctggtagcacctctaatgggattgtaactgttcctatctgagatgtgagttttcagctgggctgttaccttcaaaaggcaggccagctatcagatggccctgaaaaactagagatcacagcatatatcccacattctggtaggcccagcctatgccagggaacccagtgtgttcccccaaccacaggcacttgctgaggcccaacaaattcagggtgtgttgacaaacaggaatgggtgacagcaaatggctgaccctgagctctctgaccccttgagtctctgaacccttgagagcccagtcctatgatctaggggagaggtacaaaagccacacatactactgagaatggtttgtagttctggaagcagcgtaggcaaggccgtgagcatgggtatttagcatgaggaacacatgaagacttggtggccaggggaagcatgacagatggtggtgtacaaaaacccatttggaaagatttctcactgcaaattgttacaggattaaagttttttattttatgttgatgaactgaacttcatttatctaaaaagaaaagtccagatactttgaaagattaaaccccatcagggtggaccatataagaaagggcccaacctattacttcagtgccacacacatggggacactctttccaacagagccaggaacatacccagttgccattcccccctccctccacagagatgcctggggtattcactacaggaggtcttaggctctctcctggattgttctggcatttctctttcaccacagggaactctgctgtctcttctgtccatgagagagacaacaggtggaatctatgtccagggaggcaggaagtttcggtgattgccctgcctatgtggaagtgaggagtgggattctctcaccgcctctctccacaccaggtccacggttggcattcctgtgggccggcagcgtgcccagctccaggccaccacaaagcacccacacacacactccgatctgccgtcagcagctgtttctgacaggtgtcccactctctgctgcagatggtgaccgaaatgggcccgttggcaggcagcacacggtgccacccccctgcacatgatgatgcggtccctgacatactgatcaaccctcactctattctgaggcaccttgcctctggctgcaggtgaagccagcatcctcttagaacccccccccccacaaggttctaggggcccccacctcagcctgggacccttcagcatttgacagtctgtgaatctagatgctccttgttccagacaggcccagctcactatccatcatggtagcaggactgtgtatgtctttgctggttcatttggtgcagtgcaggatgggattttcatagctccctaggtatgactttggccttggcccagtgaggctacaaaggttaagctgcagtggccccaggcctccagatgcagggcctgggccactccccggctccttccatctgttatcctgagtggagtcctgtgtacggaagacacacaagacttccgggagctgttcccctagagaggtgagtgggagtctggtctcttggtaaaataacaagatagggccacatccacagctgagatagggatccaggaggagaaggggtcagaagggaaagtggctgcccttctgatgtcccctttcctgctgcctgcctgcaccttaaacagagagttgtgggcattgctagggctcagcttttctgcccacatccctgcaggggccccgcctgccccatgtttgggctgttcattccaaacactgagctagccaaggccgccagatgagagtgacatctggctgagaccacggccaagtctctgctgctctgtccctggcaggcaagagctatgttcccagtgccaggttctcaaagagggagacagagggatgggggcagaataaagctctgtgctccttacccagccattttccttcttcccttcgtgatacttagttggaatctggatagtcaaggagtaaagggcatcctccggagtgctggggatcgtgggagtggtggaaagaatcagaggtcaacaccaagtgtgtgcacatgtgcatgcacacatactgtggaccacaaagtacaaaggatggtggggagtcaatcaggtacccggagtgacctgaatgggatctgaatgacacagcagaagcctgcactgtctcctgttttcccaacacaaggtcggactctccttccacccttccgcgtaactctctgtggagtgacagcctggtgcctgtcagccaggctggagctagaaaaggagtcatctcatgtccaggaggagaggcaagatagtgtttccatctagaggcactggcagaaagtctaatactgatggcccagtctggtctcctttggtccatggccgcttgtcagctgtgtgacctcgggcaagcaactggacctctctaagtttctgttatccatccggaaaataaaagtaaggcccacttgctgtattttgtgagcttaagaaacacctcaaaggagaatattgtcattttagaagtgagccaagtcaagtgtggaaaggttgaaggactcggttggccaaagtcgtgaaagtagataaggtatcggggaaaagggttatggggttcccagagaagcagctttcagctctctgagggttggggcagcatggctcaagacttgtgggtgtcttctgtcctcagcactatcagccctgtacctctcacacccctctgtcacttcagaacaccctcaagcataaacagcagtgttgtcccccatttgtctgcttctgatttttgacttctgcaaggtatgtaggaattttcttctctctgtaaaatccgtggttcaggctacttctctgccacgctagtgcaccatgaggttcacggactggagaaacttctgggacttctctcagggctgggagagtttatgagttgtgtgtgtgtgtgctcttgaacagaggacaaaaaaagagagccacatttcacagagcagagaataatgacaaaccctgaaccttcacagttaagcttcctcagtcccctgtgtccatggtcggtgttgggggacccattttaaagcagtaacatgaacaagcaagactggcttaagggcgacagatagacaaaggcaggtagtggctagagcttggaggtgttggtgggactatggtaaggcttgcatgggaccataatcacaatgcaagcagggcagtgcacagcacagagtcaggccagtgcagaacagcaccccaaccccagctccggcttgctcattgtagttcttgactctaggaagcccaggatgtggggttttattagggcatgaacggagatagtcattccagaccttgcccgtccaggttctccctccagctggatgctctggggcatccaggatgcatgtgggtgggatggagctcttggtcagatgtccccaaagctagcataggacatccagcctattggctgtttgtccccagagcaccactaatctggatgatgcatgagaatggggccactcaactgggtgggatgcggcttaaactagccaggctcttaacttccacctgctcagggcataatctgctcctcatgattcccctgccctggctttctgtgagctcagaaagaccgtagcatcacagggcagcctgaaaactgctgccgagactgaatccatgtgatttcatttctttctgggcacagccctgaaaaaagagggcttctcatcctccccacccctacccctcacaggagaggaagtggggctcaaggtcagtcacccaaggttatgtgagttggccaagctcgggccagttccaaagcaacctctgtccatttgaggactgctgagggtgtgacgggggatgtttaacacctacagatacacggtgctgcaactgaaatacatcatgccttagcaagaagtctaacgaacacggattttattgtcttagccggaaggcataccaattatatgcaaatgcaaatgatgtaattagctcctgttctagctctcttctctgaagggatttccagtttttctgagcgctgaagaaaataacaattgtgttttggcaaatagggactcattgcctattttgagtcttcacccctaatacatgctttcttcccttcctccctccctctacccctctctccttcctccctctttcttcctctagaaaacatttaaattaaggttaaaaaaattttaaatgtctaggggctaggcagataacttagtcagtaaagggaggacccgagttctatccccagagccacaaaagcagcagggaaggtagagagaggcggttcaactggccaacctgcccagcctgctaggggacctctgggtttagttggaaaccctgtctcaaaacacgaggtaggaaatgacagagaaagatggctgacatcaaccccaggtctccacagaacgacacacgagacacacacaaaagcttaagtcaagcaaatcccccaggcttcagtactaagaagccaaagcagcttgtgtggaggcctgtaagtctgacctacactcgcgagaacacacacacacacacacacacacacacacacacacatgctttcagaatcttctcatgatgcctgtatggagtggggggtggagaggggtgctattgtctaaaacaaagcagtcatatgtggatcagccacagcctcacatccagtcttgcagtcaaacagccacgttctgtgcattctcaggagggacagacataagcagagacaccacactcccacactgctggcttcctcagctctccaacaggccgaccaagctgcctttctcttgcttttctggtcatctatattctcagccatgcatggctggaggctcagccagagcagctatacgtcttcagtgcattttctcttatcgctcatgtattaattgacagtcctatttttagtttccttgggtaatgatttaaaggcccagcatttcattctgggacctggccagtgcagtgtgaagttattcagatcacagctcatgggggaatcgctgtgtgcaagctggccagtctgttgcgatgggcagatggaccctcgcccagggcagaggaagtctcaagggagattttaattccttaatactgaaacaagcacaatttttattgtcttaatcagtgaataaaaaaaaaaacaattaaatggccagtttcaattttattttcgcttggcagagagaacttaaagaagtcacaactgcttctcaggcgcattgctatcggatgctggttctgtgtgttccagaagagtgtgccagtcgtcctgcagatagggagctgtagcactgctaactgaagcatttatcaccagatctgggtggtgtcctctggacttggccttcattgtgttccatatctgctacacagaactgcccacttgaaattgctgcataaacctccaaatggaggctgcgttctttcagaatccaggacactttaagcactgggtgtgctgagtaacattttgattcttaatgaaggagagatttgctgataacaacgagcagcctctataaacatagaatggcacattttgatagcttatgggagcgtatgattggttttccactcagaaatccttgtgtgtttcttaatttaatctctaagccacatctattaaaataccaagtttctacgtttctgggggctataaactagtcaagtccagttccccagcaccgtgagtaatatctgaaaaaggcacaaaaaaatttcctgattaaacaaaagctctctgtctgtctgtctgtctgtctgtctgtctctctctctctctctctctctctctctctgtgtgtgtgtgcaaatagttgcatatatagataaagatattattcacagtagacatattgtgttgtagatagagaatcagggagcacaatggaacaacactagagtcttagagagcagatgttatgtatggctatcaaaatacagctttagaatatacctggagaaaaaaaaaaaaaagaatatacctggagttatcagaggaccaacaatgagaaccaaccagtagttaagaaatggatgaaagctagatatggtggtacatgcctttaaccctggcagaggcaagtggactcctgagttcaaagcctagtccaagacaaccaaggctacacagagaaaacctgttttgagaaaaagaaagaggtgggggaaactggagagataccttaagacagagcctgagtttgatccccagaacccacattaaaacagctagacatggtgttgacatgtgtaatatcagcaatggggaagcaggcaggcagatgcctaggtctccctgcctagccagcctagcctgcttggtcagttccagaccaataagaaaaccctgtctcttaaattgaagaaaaaaaaaattggagagagcctgaagaatggcccccaaggctatcctctgacttctagatgaatgtgcatacacatgtacatatgcacctgtacacacacatgcacccatgcagacatattggaatatatacctaacctaaggagggatacagagggcaaatagtaaaaattaaaatgtatccaaatcattattaagaaaacgaaagctaaagctaacttggtgttccatgtcttccagttaggatgaaaaagttacaaattctgacaaatcccagggcaaggatagagagagccaggagcctctcaaacatcttaggtgagatgtccaaactggtaccaccgattgggaaaaacactgtgaaattgttttactagctgaacacaccttaacatcttgagactcagcagacccacacctatgtctttacccaagagtgacaggacttgtgctctcaactacacctggcaaacattttttataagaactccccaaactagagagaacagaaatgagcatgcaacccaaaagcacagacttctaaagaggcactgctcgagttcaggaaagagcacccagaagcacagttctttggcgtgctgtgtgcttttgcactgaagacattggaaggtgtggatgctgcctcagaatcaaggactcactaaccttctttcgtccccaccccaggcacccagggaggggctgtctctgaagttccctcaccagagggaggaaagttcttgcaaaagaaatgtcattctcttaagcccccgttcctaggaatctcatcaaagaacaggaaagattagccactggcaaagagactcaaagtccccagcccagacagactttgatctgttcttctgagggagtctctgggaggtcacccaaagactttatctcagtcagaagttaactttgttccaggtacaattctgtccctcaccatgctctaacctgccttccccaggagaggaactttgtcccaggccattgtgtgctctttgggttgtatcgtttctcctaaaaattgtttactagccctccaagatactcaacacctgactcttgcagctccatttcccttgaggaagagaatctacacttgctcttttgtgccttcctgttgggtttttgccttgcatcacctccatgtgcatgccgatggaacccattcacctccctctcctgatgcaatgcttactgtcagtggagggcgctttccccttgacactacgactcaggaccccaagccaaggaacaagcagaagagatggtagagttggaaactactctaacatggacagcacctgtgctccaacacacaaagagaaagtccacagaggtaaaggctcatggcttctaagagcataagcagagaccagccatgagtgccaactcaatagtgtcattaacataaaccatatggagtcactacacagtgacctgattttggagttcttggattgtatgtttgttagttgcttttgttgttgtggccatgtgaccaaatacctgaccagaagcaagttcaagaaggaagggtttattctggctacagttccagaggatagtacccacagtccatcatgatgtggaaggaagttgtgacaataggagcaggaagcagctgatcgtattacatccaaaatcagatataaaaacagtgaacaggaagtgggcctcggtgggctaaattcaagacctgccctcagtgactcacttcctcctgtcaagctccactgtctgaaggattcataaccatctcaaattatccctcctgctgaagaccaagtgttcaaacacttcacattcagagcatagcacatggctccaaatgtccacttctcagaagacatttctaggaccaaaaagaaaaaaaaaaagaaagaaagaaaagaaaatgaagtagaacttactacatatgactttaacttgactattataagcatactgaaacaaaacagcagaagccaagtctgaagttaaaggaaaatatggaaacaatatctcatgaaaaagacatttcagtaaggagacaaagtttaaagcaactggtggtgcacccctttgatcccaacactgaagagtcagaggcaggcagatctctgtaagttcaaggccaacctggtctacatagcgaattctaagacagcaagggtaatacattgagaccctgtctcaaaagtaaagagaaaaaaattataaatcagaagaccaagtcgacttttttggaagtaagcagaaacaggttaatcatcaaaacttcaaccttaaatgaaaaacatctctagggggagaggctgagtcggcaaaagaaatagaatgaacttgaagataagtcaacagacattttctagtccgggaggcattaagaagcaagaatggacaaaagatgcttatacaactctaagaatagccagcttcctattgccgtgacacaataccagagagtcaagttaaaacactgtaggtttattctggtaaatggttttagagttgtcagttgtatttgatgggtctgttgctttgggccttttgcacacaatgtccaggaagcaaaaatataaaggaagaagttggggtcataactgtcctttctagggtactctgccaatgacctgagttcctcacaatagatcccacctttccaatggcttcacctagttcacagccccctcggctggagactaggtcttcagcagaagatctttcagagactattcaagatgcaaacatagcaagactaattgctggactgtaagctttagggctctggaagacacgagtcaaagaaagaaggttgaagagagtttctccaggttttgctgtctcatttcacacttgaggacaacaaagactcaggcgggtagcagcaaccaaccaatgcttgtataacaactggacacaaagtttataactattctgtgacccgaggctcttctcactttacggcagatgttctgaatcccaaggaggcccccgaggcctgggaacaaccaacatagttggccactctgtactgtacaagttggaaccagtcttggagttgccaagattctaacgtgagtgggacgcagcacccagaaaagctccaggctttgtggaacgcgatgctctgagctccagcagctgccatgttgctttgagtccttttctattcagtctcttgggatgacggatctttccttttaatgaaatctgcatttcatccccaaggtgaaaaccagtgtccttggctctttctgagaaaatgagaagtggtttcttttgtgtaatgaatgctaggaacacgcaaaaactgaggttgttcttaattgactgcatatatggaaaagcagatcataacccctaaagatacataaagcaggaggtgnnnnnnnnnnnnnnnnnnnntctcatacaactgaaagccgcaaaaggaaacttcactcaaagacaaggtcatttgaatttcttgtaaccaccagcagatgtcaatgacaagatcgaatccagaggggtcctccatccttgatccagtgattgatgcaaggagttagaagtgggatgcacagcctgtaacatcagccatgtgactatgagccttgacctctggcacccagcagaaggtcactagtcagtcagtgcctggacagtagggaagggacttggaccgcctgggtcccccaggaagatttggcacttagaaggtgtgaggagatatagccctggaaaacatgaaagggccacccccttcctctgggcccccactttagttcagtcacttataaaccttgctgcagataaacaagggagcctcagaggcgcttgccacctttgcccccctttgcccccatggccactgtgctgtagagaggtgggcaaactgagcacagagctgggcactcagatgggcatgtagaagtaaaccatcagatatcccacctctgcttctccatctgcatctcctcctgcttctaccctcctgggccttctctcccgggttcctggatcaacccctttcctgttcatccctgagagcccaggacttgccttcctctctctccagaccttccagaacaagacaaacacacgattcccccctcttccttgcttttggccgtaacattctccttatctggggaggccttcatgccatcagggcagctctatgaacacccaagcccagtcctacctgtatgacacatcctccaacccggatgaccctttcccacctccacacccacaaagggagttctttgtacctcaacaatttgggatttttcactctccctcaaggtagatatctgtggtcacaggactcttgcctggtgcacagatgaccccagggatggggtggagccctagaaaatgctgtgggagccatcctgggaagagttatgaactagccccagcaagctctcagatctctaccactcctgttttgcctcactctagctaataaaaggtactcttctcagattgtcactgccaagtgggccccattgggttatttctctgcatatctgtatgcatgtgtatgctgttgtaaatgtggaaactacaggaaatgggtaccatttcttgggtgccgtccactttgggttttgagacagtctcccactggcctggagctcaccaagtagacttggctggccagccaatgaactccagggctccatctgtctccacctcctcagtccctgcattgaaagtacaggcacgactctggcctttttcatgtgagttcaggggtcacactcgggcccacatgcttatgtgacgggcactttaccaactgagcccatcttgcccgccccacccccaccccaccccggtgatcttttttgaatgcaggttccaattcagtagatctggctgagacacagatgtaggttttgactgagctgtggccatagtccaccagtgcttcagatcctcactggccaagccaacagctgtggtcctcccaccctcccctctgcagggacagagctcagccaccctcccctctgcagggacagagctcagcctgtagtaccttccgctttgctttgcaagccaggggttgggaagaccttgagaatcacatcataggtgcagaggccagaggaatagtgatggaagccatttaactgtgtggtagaactgaagaagggggaagggcaccaccccagaacacagcatgttctctcagaagcccagttctctgatggggaactatcgtttgcataggcgggccttaggtttaagacagaattagaggtaagcgtgccacctccctttctgctttccctgagggtctcaggcagagataggctggtgcactataactcagccttgtgagggtatcagctgtctcctgtcatgaaccatgatcttgggaacctgtccttcttgtatgtgccatggcaatgcttgactcacgggtacagcaccatccatccttccggtgtcctccctgttcttcccaggcagtcacccctcctctgcctgggccacactggtagacaaacctactctctagctggttggccttcctgctctgtgccgcacagtaccacgcacatgcagacccctctgctcagctcagaatggaaaatggctgcttgtcttgtttctagtagttttttatgaaaagacagacattccaatcacttcagaacctgcagacattttttttctcctctgtgtgtggcatatgcatgagttcccacatatgcagtgttatgtgtgcatctgtgtggaggctgaagttaacatggaatcacttcttcaatcactctccattgagtctatttcagtcactagtcattgaaacagagtcttccagttgaacctagaacttggcactcagctactctggtcagccgctttgctcctgccccctcccccgccccccttgtctcttcctcccttgtgctagcattacagctggctctgtggtcctcatgcttatgtgacatcctttatccactgctccatctccccatcctgctccccagacagtttgatgtgtggtattctggaagctgcccagaaactaataccattgacaggggcacagactaagcttaagcctatacgtgttcatacctgtgtgtgtatgtgaatctcattctctctctctctctctctctctctctctctctctctctctctctcattgtgtgtgtgtatttgtgtgtgtgtgcctgtgtatttctgtgtctctgtctctttgtgtgagagtatgtatatgtctctgtgtgactgtgtgtgtctgtgtctgtctgtgtgtgtgtttatgtgtgtgcttgtgtatttctgtgtctccatctctgtctccatctccctttctctctcctttcttcccttcctcccccactacggcgtgtgggggttatgtgtatatatcccccatgtgtgactgtgtgtttctgtgtctctgtatctgtgtgtgtgtttcagtgtgtgtgtgtgtgtgtgtgtgtgtgtgtgtgtgtgtgtgtgtgtaagacacactatagcacagaattcgttagaactagatccaaaagaaaactaagcagtctctagattcagaagcagtcaagcatcgtccctggtacaagctccctgtgccactagagggcagtctgaagaatcgacctccactcctccctggtcctgctggacctttccccctaaggcaagagaagccagcctcctagaagtcagaccccagttttctgtggctcctgtggatcccaagtttaacttctgttatagaaaactgattccatgccattaacatgtttaagtgaacattgattaaatacacagatacattttacaaataaggacataaataaagatctaacacttaagcctaaattcttttggtgggtagagatggggtttggaataaaattaatgttactttcaataacagaagggtgaggaaatttgaattataggtaccccccctttcatggtgagtttccttattgctaatgtgtccgcttctcttcataagcttctcagattgtgatcaggaccagggtcagagttggctctggggccagacatgtttctcgctggccctgctgccgctccacctggcctgagctgaggggtccctggcccactttcccagggatggaggagcatgcggtttccatgccgtgcaccaggtctgctgggcacttgggggatgtcggtgactaacgacgaacttattagagcatttgcagtaagcggaatggcatatttatttgttaattttattaaaagaatggatttccccaggcaggccttgaaggtcagatgggcccactgtgcccctgctggacacttccttacatctgtggtgttcacaggtgcggctgggctgaggccatctgtctgggcctgaggtcactgggctctggaggaaggccgctctctaccccacagttgcttgctcataggatctcttcagacacaaaagaggggcatatatggagggtcagcagggactccttcaggagggtgaggggtgggggcagacttggcagggtgcacacttcctgtgcctgctaatgccttcccaggagagcagtgagcctggcgcagtgcccactggacagaaagaagcttcctcagtgggatctgcaaaagaaggaaggcctgcgaggcgccctgggtcacgtcagggaaaggaaagagagggttggaacaaaagtagggctgattccttcttttaggggacctagaaatctccagagccaagtgtcaccccaacctgggttcttaaagtgatatccttccccatacatttatgcatacgttaaaaaaaaaaaccaatactggaaaaggaggagaggagggaaggggagggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggagggagaggagaggacaggagaggagaggagaggagaggagaggagaggagagggaaagagatacagagatgggggagaggagaaagtagaggtagagggagagaggaaagtagaagagaaagcatgggaagagggaggaggggagaaagagagagaggagagagagagaaaaaaaaacaaagacacaaacccttgaactcttgagattctgagacactgttttgaagtcagcaagatgggaggtgggaagggaatggtccagccagccggcactctcctccggaaggactggtcctggcagaggcctgtggccaaggaagaggcacctggtgaaccaggctggggctgcctgcctgcgagtcagaaacaggggtctgtccagcacaggaaccttatgcctggcagatctgagccaacctcatcagtcttccttcccagaacccatttcagtgccaaggggtggctagtagggcctgaaagaagagccagtctcctaggctgggtggggttcaagaaaagaaaaaaggaaaaagtctatctcatgagtttcctatggcttccaaagaggttttatgagtgaagtttctgccatcttgtggccaagactggtactgcatgaatcccagctctgctgcctcccctgctccctagcactgcccagttgttccctgggtggaaagggcagcctctgaggaaaggagggttcagagaggcctctacccacattccagcctcgaggagcttctggaaggtcccaagtctggggttgcctctcacccatacaaggactatcatttgtgaaagagaggatatgggtgggccacataggaggaggagccaggccctgtccaccttcccaaaggatagacacctgggtgacctgggaagggaaaaaggaagcagaggacttacttaccccctcggccctcgggtggcagtatagctgaggttaaaacaggagtccccttcccagagcgtgaggcccacatagacaggttcaagggagggcggcaccctttaagcagatgcccctagaacaagagtgctgtctgagggcaaaggtgtgtgcacctctgggcagagaccaggaaggtgtgaatgccactcacttcggcctttgtctcgagtgcgtagacccagccacaggaggcagagccattgtgatcacagagctctcatctcctttccttgtcctggatcaagaatgtcaaatgctgacctgactttttctttctgcaagctccctgccacctgaagcagatagtacgtactttcatggcatggagctgctctttagcgcagcattccatccataccaccaccccgtgtcccagagctgcaccttcaggtgctggtgatgattggatggccccggttactgcggcactcccaggacatgcccaccctttgtgtagtgaggttgctccgactgatggagccatgccagcagattctggcccaagtcctcatcctcctgaggttccctttccctgaaaactctgctaccagatggtgagctagccggggttccaccatggagcagagagctttcaaggtgtttcagagatgaagtttgcagagagaaccgggtgttcacagactcctttgaagggcagttagggcaaaggcctagaaaagcaatagaccatgacaatatagggtcatccctgaaccacaaaaacatattgccacaaggccccaattgcccgcagcccaggaacaaaagaccccagaggtgactggggggactgtggcagagtcttacagatgcctgtatccatcctcgtgactgagcctctcaaatctcagccctcctttgtgtcagccactaaattccactttggtgtctccaatgagtggggcagaaaatgggtgagtgctggtactagaatctgggcagtgtggtatccaggcatcaggccacacacgtacatcagacacatgatctcacatacagtttttatatggttggggacagtaaaacttttcactggtggctgctatgagacagatattaacacttgaaagtctttgcctagagtctggcatatagtaaaccctcaacaattgcttgcctaccaaaaaaaaatctgtggctcctctgtgttgtgtggtccgactggacattgatcctcagtcttcccaggcagtctcggccttaatgcagcaaatctccctcctagttaagagggctgagtagggagagcttgaagcagtgagcggcactgagcatagaggtgagatctgctgactggcagatttgagggtccggctcatctcaactgtagcctggccagtgccctcatcaatgcgcaggctcgctgctccgaactcagctctcagagtgagcttctaatgccgtatgtttgaacacttcagggcaactggcaataaaatagactgagaacacagctgaaatccaaaagggaaaaaggcaaggctgcactccacagggagccatgtctgtttcctaatctgtctcctgccccaaatagctccgctctccttccccgatttgtgttgacgtgtttcttgtctgtggaagcagatgccaccaagacataaactaggtcacagaggactatgatggccccacacaggcccataggccatgtcctcctctgacttgaatgtccaggttcctggcccagagctcagagcacagactccaggatccacagaatgcagcccttcatgtgaagtgggagtgggcggggcttgtcccccagcttagcacagagcccctggcttgcatggctttctggtcctcttttctcgtggacaaccagagaaccacagggctctgctgctgccctggaagaggtttggagctgcctgtcagctctgtgatgctggacgaaacatgaattatacaaacacttgactcctaggctctaaagcaggaggtcagggcactcactgctgtgcctgacagcctgagctcagtcgtcagaatctccaaggtaggaagagaactcgcgcgcatgcgcacatgcacacacatgcgcacacacgtatacaaataaataaatgaacgtaataaaaataaaatggtttaaagtctgatgtacatccaatttcaagccccagcccaaccaggcagattgataagtacccatctagaatgatccagcattaaggggtcgagccagcacatgacctaagccatgtgtcccctgctggccacgctccctccttctcaaggagtcctgtgtccagcattgggtcctgaggtttctcttcctctctccacaggttctttcaaagcataactttggccccatcaccaccgacatccgagagggacaagtgttctactatgccgaagactaccaccagcaatacctgagcaagaacccagacggctactgtggcctcgggggtactggagtttcctgcccgatggccattaaaaaataatttctctccacgaagctgtccctgaaggttccatcaacaccatgattgctggatggagtggcactgctgtgattcacatctgtcactttatgcaaagcacacacaccacacggacctttacatgaatctggttgttattggggtttgatttccagagagtagcatgacaaggtgatacactgtaatctgccttctgatcagtccgggtggggacaaatcatgacattttagtggattgtttggatctgctcagactggaaggatgctgagggttctgaagcagggggatggccaggagagcacagggtactgggaccccttggtctgtgctgacatacctcacccacttccctgccctcgggtgcccaattcattagtgtctacagatcccatgaatcatttgccaaatcgctttgctctgctggctctagatgtgtactaggggtttctctccccctccatcctctctgcagagaaaagacaggagtgaccttaatgaattctaacattctgcttacagctatgataaagcttgttctaataaaaatctgcagtttggtaatagcaaccgcctgctgtgagtctgtcttcccttgttcgggaaggatatttagaagtatcgcaaagccaagttaagagctcaagaagaaacaactacaacaagccctcctgtttatttttccctaaatggaaaatatgattaaaatttttggcaagtgggcacacccctggctctctatggctttagtaatgaatagttgttttcagggcgcctgtaacatgtcacatcgaggacattggtacttagagcagataccttcagtctttgcccttgagaagaagaacattctctttcagacaagaaaccatagccatataaacaaatgaataggtaaaataacttcaggtcctgatgcaggacagagagatgcataaggaagatgctggctctgggaccacgggaactgtgcgcagggtcatctcagctggtgagttcaccacagtccccataaggtggcaaatagcaaggtggaatggcttaccaaataaagcaatctgccagtgagtgcacacacacacacacacacacacacacacacacacacacacacacacacagctcagaagcaatcaccctgtatgcttcagcaaaaagaagaaaagggtttctagaccagaaatacaagtggtcatggcagaattggagaaactgaaaggccctccagacttgagtttgcagaacaggtctctgtgaggaactgtccaaggagggcagagatggctcagggaggatcattaaggaacctgagacctggctttaactgaatagcagcactaggccgttcagactcctcttttcacttgggaacaagtgagcagagggttattaccatgtgagggcacaaatctatgcaagggtcggatgcaagttcctggctccattgtagagatgtaaagggaggcagtttagggacagatctgcatgcagatgccatgggaccatacaaggtcatgtgggagaggatgaaggtgctgacgtctaaggagtggggcctccactggtgcccagggatgtctggttacaggagaagcagatgagctcggaaagtgacacttgaggttgtctgtgaaagaaaggtgtccctcggggagaaggaacagggctctcaaatcatttcagggagcactccttgggccttgccctaagccttccacagaacggaacctaggatttccctcggcgactctgtgctgggtacacaagcctagtccaggcacttctagagtcgcagactgctgataatgctcagaagtcccaggaggaccattggatagagtcacaaagacaagcagggccttaatttagctctgttgcatgggacctgggatatctgacttaaatctgaggtgtttccccactccatggagacaccactacattgaccatgtctctaggtctataagcatgacactttaacatctaccttacatacacatgttggcatgacctgctccccgccacccaactcagtctcattgccttgaccttctatctataccctcaccactcttggccttctcctgagagtgtgcttatccatacatagataaatatagagttaacatgctccaatcaccgtctttattggactctaacattctaggccaccacccacctcccctctataccacagggcccacaacaattgttctcatccttcccatagctgttaggcctgttcatcccgactggctcatttctccttacagaaactgcagataaactcacctgttgtccacccttcctgtgcctcatgatagcctggtgcttcctgaggcagctctccatgcctaatctagaatctataagcaacaggtatcttttaaaatttaataatttaatttttggaacaggatctcactgtgtagccctggctggcctggaactcgtgtcaactagctggcctcaaactcacagacatctgcctacctcttctggaattaaaggcagtgttccaccaatacccagctgaaaagctgtcattttttttttaatttggttaagattttatgtgtatgtaggtgcaccatgcgcgtatcttgaaggtattcacatgtgccaagacttcttttgtggacctgaatatcatcagctattgtgcctcgtgttcaccagaaagggatgcatactttgtttttgctggtggaataatctatggattacagcagagtccgtgagtatagtccgggccttctttaccagccagtggtctacctgcctgcttcctctggtaagagagatgttcaactctcccgctttccctatgggctggtttgtctctccgtacagtttcaatgggtttgctttgtgaatgtggaggcttgtctctaggtgcagaaacatttgaggttttcagtctctcgatgtgaaccctcactccctagcagtaatatcctcttcttagaagtcccctttgtcgcatattaacatagtcaccctgcttttgtagtgtcccctggggcagcagtggccttggttatcagcttgacctggtgtagaggccatgaagacgtaagctcccaagcacctgtgaggattttccttggttaacttctgtgtcaatccctctgcttacacgatctgatcctctctgaaggataccgatagatccattctgcttctgtacgtctgggaaagtcattttatcaaataaagtttttctgatatgaattttttttttctgtcaggaacttcgagatgtttttcatggtcttcccctctctgacatgcgcagttttcgggggagatctgccgtcaccctctgctcttctatatgcgatgtgcatcattttctctcctgtctgttgcttttataattttctcaatcaagtaaattcatcatactgtgtaaaagtgtgctgctaccagataatacattattttaaatagggctgttgcagaatatgcgtttgaagtttctctgtgttggtaaggagatgtttgtttgtttgtttgttgttgttgttgttgttaacttggtctaggaagagagaacctccattgagaaaacatctccatcaaattgatctgtaagcaagttcataggacgttttaaatttttgattattgatgtgggaaggcacagcccattgtgagcgtggtcaccctggacaaggtggtcttggactgtataagaaagcgaatatctttaatcccagcacttgcgaggcagaggcaggcagatttctgagttcaaggctagcctggtctacagagtgagttccaagacagccaaggctatacagagaaaccctttctcaaaaaacaaaaacaaaaacaaatacaaaaacaaaaacaaacaaaaaacaaaaaacaaaccaaaccaaaacccaaaaacaaaaacaaaaaaagcagactgagcaagcctctaggagcgtgccagtaagcagcatctctccataagctcccgcacccacactcttgccctgacttcccttcatgagagtgtaaactataggctgaaataaaccctttactcacccaagttgcttctggatacagtgtttatcataacaatagaaaacaaactaggacacacaagtcctcaaaatcttctcattgggaggacagttttcacaagttaggctcacgtcgcctctcatcgctctcctcggtagctaactggctaagctgctctggcctgtctgggccttggttagggacacttgctccacttgctcatgttattaggtattagggcttcagtgtccttttgtcccaaatcagagggtggatagagactcacatttccatgtgaatgcttaaaaacgtgtgttgtgggaacaggctggtgtggaaaggagctgtaactttctcagaaagctacaattctctgctctgtttaaacagtcagcaagtgtgccgtcattcctgtttgaaggcacacacccaggacctgcccttagccctttgtcccagatgaaattaatgacattggaattgagtctctgtcatcttgtgctcaaataccctagcagactcgtaacaagaaagaattagggcacggctcaaacgcagaagtggaaaaagaaatgggctgcaatccacagggaaagctcctgctccttcatctgtctcatggcccagatagctcagtcccctcccccagctcgtgtttatgtgttaccttcctctctcctgtggcagctgtcaacagacctgtggtcctaaactaggtcagggagaacagccatgggttaatacaggcctccggctctgtcattctgtgtcttcatacccacctcccgttgtccagcaggttttctgtggcatatcgggggatccatggtccccagaaccaatggcctcctggactcatctctcagatctctcactggaaggaaacagggagtccttactgtccccagccctttggctcacatgttctcaggtccttctcatcccaccacaacactaaaaaaaacaacatcagaggacttacacacctgtcacagcagccagccagacacaccggtcttccagaaggcctgttacatgagggacctttttcaaacctacaagctcaggcttgggggtcaggtcttaacagagacaaaatttggagctgtgacgaaaggatggaccatctagtgattgccatatgcagggatccatcccataatcagcttccaaatgctgacaccattgcatacactagcaagattttgctgaaaggacccagatatatctctctcttgtgagactatgccggggcctagcaaacacagaagtggatgatcacagtcagctattggatgggtcacacggcccccaatggaggagctagagaaattatccaaggagctaaagggaactgcaaccctataggtggaacaacaatatgaactaaccagtacccgggagctcttgtctttagctgcatatgtatcaaaagatggcctagtcgaccatcactgcaaagagaggcccattggacttgcaaactttatatgccccagtacaggggaacgccagggccaaaaagggggagtgggtgggtaggggattgggggtggtgggtatgggggacctttgggatagcattgaaaatgtaaacgaggaaaatacctaattaaaaaaaaaaagacagatcagcggcagaatgctggtctaccacacatgaagtcagatttgatcctcaataccaaatacaagtctcaaatggtggtccgtgcctgtcatccccataccccagaggctgaggcaggacgattttcacaagtttgagactaagctgggctatttgtaggttccgggcaagctacaccacagcatgaagccatcttttaaaaaaataaaagaagctaaaacaacaaattaaagccagacaagatccaggtcagggctcctgggcaattgagactgcagacatgtactgtacagggaacaggttttcaggccaaacaaactttatcccaaggaacagacatgatggaaagtcagtggatgccccagtgtgcaacagtggatagaggagtcccggcccagaccattctgttcctctccagagcttagtgttgtcttttcagtcccaggcaatgctttcaatacccacaatccctctccttccttccacactgttaacaattcaggcgcgagcgacccatttcctcaagatgttcaggagaagagataaggcaacctgtgtctagtgtttgggaggggatgttattatataagactctctaagagcactgaggcagaagtcctggtaagcacaattggcttgagagcagagcatctgcctttcccacttggaggtttaaaaacagcctgaggggtggagaggcagctcaatggtcccagcctgattctcaacctgtggattgtgaccctttggggggggcacatcagttatttatgttatgattcataacagtagcaaaattacagtaatgaagtagtagtgaaataactttatggtgggggagcaccacaatacgaggaactgtattcaaaggttgcaagcactagggaggttgagagcccttgatctagatcaatggttaagagtatttcttccagagaacctggttggattcctagcactcacatgagctcacagtcatgcgttactccagttccaaggcattcaacatcctcttctggtctttaaaggcacagacatgctcatggtgttcagatatgcatgcaggcaacatacccacgcacccataagtgttaggggaaaaaaagcaaaccatgatgatacacacctgtatagccagaacatctggcctcagtaatttgccagtcctgaatcttagcatgctaactgtgacctccagaagccgatgcagcccttcctgggactcagaaccaaacggcagctatggaaacaaagatggtactaatcagtattctctagagaaacagaactgagagagagcgggggggggggggagagagagagagaggcagagaggcagagacagaaagagagacagagagagagacagagacagagagacagagagagacagagacagagagagacagagagacagagagacagagacagagagagacagaaagacagagagagacagaaagacagagagagacagagagaggcagaaagacagagagagacagagacagagaaagacagagacagagagagacagaaagacagagaaagacagagagacagagagacagagacagagagacagagagagacagagacagagagacagagagagacagagacagagagagacagggacagagagagagacagagacagacagagacagagagacagagacagagacagagagagacagagacagagagagacacagagagtcagagacagagagacagacagagacagagagagagacagagagagtgagaaacagagcgagagagcatgtatgtgtatgtgcacacacaggggaactgatactctcctggcacccaagggcaccaagtgccatatagtaaacatgcaggcaaaacacccccacacacaagctgtggtccaactattccaacaatgactgtctccagtggaaagttcaagaatctgaacagttgtttggttcatgaggctggatctctcaggtgctctttggtatacactggaatcccaaagaagtagggtctaataccagccaaggaatgaacttgccatcctgagggagggcaagcaggtagagagcaaaagcttcctccttccgtgtccttcagataggctgccactgtgtggcccagatttagagtggatcttcctactcagatgatctgcttgtaggatggtcttcctacctcaaatgattcaattgagaaaaatctctcacagttgtgcccaggcacttgggatttaattaataccagatgtcgtcaagttgacaaccgagaataaccatcacagatggggaaagaatttctagggaactttctagaaacaatgttggctgaagctatgaaaaggaaaagaagagttggaaattttgatctcaatatctgcctctaagttacaacggacatccaatgagtgacacacccaaactccttttggcaggtgagatgaatttattaggggtgacttatgaagcagaggatggccaggaacagctagaatacaaatcaccccccaacacacacacacacacacacacacacacacacacacactcataggaaggtcctgccttcgtatgagcaacagacaaagtttgtttataccatctctgttacacttggttcagtgtgctccctggtgtcttaaagagtcaggaggtagaggtttggaaaacgtgaggcacagacacaccagatgttgggaaagttctgtgtttatgagtactccattcttgttctctttagggattctgctgtttttgataaacaacgtcatgctgtggagaaaaccatttgtttcttctgcagtctgggtcaaaggacggctagataggcacttgctgcaagttagaggattagtttcactctgtgactactccacagaataaaggcaaaagaggaggaatgggctcctgcgtcagggttcgctggactgcccctccttctgctggattgaaggtgaatctcaaggattcttgagctcaccggagaaagaatttgaagatgaacatagttaaagcacttaagaatgaacagctcccaagagtctttttggtcagtttcaatgatggattcacctttgtgtttgcaggattgttttatgtgttttctctaattatatggaattctccctgagtccagtccatgtatcagagattattcccatgtggtaagtcaggggtccatacaggactgtcacaatatgtagggtaagtggtattggctttcttcaaggtgggcgggttggttagcgggaaggttggtgggtgggtagattggtgggtgggtaggctgggtggtttgcttggtatgttggttggtgggtaggttagcgggaaggttggtgggtgggtaggttgggtggtttgcttggtatgttggttggtgggtaggttgataggtgggtgggttggttggtgggttggcaagtgggttggttgtttgtttggtgggtgagttgtttggtggggggtgggttgtttggtgggtgggttggtgggttggttggttgcattaatttccaagctacttttcttggccaattatttactcactgcctgactaaccccaccattactccctttataaagagactctgaactcttggagaaaagacacactgctttccagtcccacttgaaactctgccagtgatcctcaggcttgtctggcaccctcctatagctgcatagtgagctcaggtgagacaaattacccaatcattgctcaaacctcgaagctcagtcgcctcattgtttcatacactgagaagggcacttggcagtctcacgtttaatcatcaggttagaagaaacattacaaaatataggaacaagatagcccggcaagagagcaccaaagggcacgcagagttctgctcatacatataaggcctccccgccttcgctgtctgcttgctgatccacctcacatagtgtgacaccttggtgtatactcctggcagattcttcttgccacagcccatgccccagctgacaatgcccacctggtaccaaatggctgtgtttctctttttgttgcaaacgagagctcctccactgtcgccctaggaaagaaaagttgtggggaagttgagggcaatagggaaactgctcccataatctgctcaagtgtgggtgtctgatcaaaagtactgaagggttcctaccatggcagtttctggctattgttcagtttttcagccacaggggtgtgactgttgcatacgtagcaaaccatgtaggcaaaagcaattgggtaagtgatgacatgaaagactgatgtctaccatcaccaccaccatcatcaccaccgagatcgttattgatttaatgtatcattcattttgatatatcttgtatcaaaggcttgtgcttttcccacaaatttgttttctatcagttcagcgctctctattttactcaaaaatgcaaaaagtgaacagagtaagcaaaaatccaccatgcctcataggaagccattggttggatctaccaggtacacagatggatatatggcaaatgcaaaaagaacggtatcatgttaaaaatggtaacatgttaatacttaaatcttcacattttaaatggtgtagggaaataaataaatcagaagccacactcataagagagaaggtcctccacagactgagacagaggttagagcaaggccacactgggatctagagaggtggctatggctcccctcttagacctaggaaggaacaggccttgcccccatcttgatttagggcttgtatgatcctaagtcatggtaggatcatgtacattgattaaagcccacccaccttgtggttatttgtcacagtggccctaagaaattgctgtggtatctcatccactggacagaaaagccagccacccttcccaggtgagcccaaccccttacctggcagg

SEQ ID NO: 530 - DNA, 1137 bp, Mus musculus
agccaaacaccatgtcagtggcaacagaacggttgaacctttcccagagggaacacagatggctgtatttggaatgggctgcttctggggagctgagcgcaagttctgggtcttgaaaggagtgtactcaacccaagtgggctttgcaggaggccacacacgcaatcccacctacaaagaggtctgctcagaaaaaactggccacgccgaagtcgtccgggttgtgtaccggccagagcacatcagctttgaggaactgctcaaggtcttctgggagaatcacgacccgacccaaggcatgcgccaaggcaatgactttggtacacagtaccggtcagcagtctatcccacatccgctgtgcagttggaagcagccctgagatccaaggaagaataccagaaggttctttcaaagcataactttggccccatcaccaccgacatccgagagggacaagtgttctactatgccgaagactaccaccagcaatacctgagcaagaacccagacggctactgtggcctcgggggtactggagtttcctgcccgatggccattaaaaaataatttctctccacgaagctgtccctgaaggttccatcaacaccatgattgctggatggagtggcactgctgtgattcacatctgtcactttatgcaaagcacacacaccacacggacctttacatgaatctggttgttattggggtttgatttccagagagtagcatgacaaggtgatacactgtaatctgccttctgatcagtccgggtggggacaaatcatgacattttagtggattgtttggatctgctcagactggaaggatgctgagggttctgaagcagggggatggccaggagagcacagggtactgggaccccttggtctgtgctgacatacctcacccacttccctgccctcgggtgcccaattcattagtgtctacagatcccatgaatcatttgccaaatcgctttgctctgctggctctagatgtgtactaggggtttctctccccctccatcctctctgcagagaaaagacaggagtgaccttaatgaattctaacattctgcttacagctatgataaagcttgttctaataaaaatctgcagtttggtaatagcaac

SEQ ID NO: 531 - protein, 188 aa, Mus musculus
AKHHVSGNRTVEPFPEGTQMAVFGMGCFWGAERKFWVLKGVYSTQVGFAGGHTRNPTYKEVCSEKTGHAEVVRVVYRPEHISFEELLKVFWENHDPTQGMRQGNDFGTQYRSAVYPTSAVQLEAALRSKEEYQKVLSKHNFGPITTDIREGQVFYYAEDYHQQYLSKNPDGYCGLGGTGVSCPMAIKK

SEQ ID NO: 532 - DNA, 321491 bp, Homo sapiens
  misc_feature (1)...(321491): n = A,T,C or G
ctgacattttgggttttttttttttttttttttttagagacaagggtttcgctttgttgcctaggctggcatgcagtggcacaatcatggctcactgtagcctcaaacttctggctcaagcaaccatcccacctcagcctcctgagtagctgggactacaggtgtgcaccaccatgcctggccaactttattttttgtagaggtggaatcttgctatgttgccctggttgatcttgaactcctggcctcaagcaatcctcccatctcagcttcccaaatcattgcattacaggcatgagtcaccacgcttagctggattatttgctttaattttgttgcccatcaatctgaatatgatatttatataactaggttgagggaaatttcacctgtttccctaaagttggcaaaaaggacccaaagcttagggcagagagacatcagctaccccaagtcaaaagagatcttcaaacaactggggtctaactgctcagagtctatcaagaagtcaaatctctccagtgtgtataaggaaaaggctgatggctggggagcaggagatgcattggaatctcaaatggtctgcccactcctccaaagctaaagggcctagaattgcccacagatggggtaggtctgcaagaatgaggaatcagcattattccccacggaaatttctactgaaaccccgtaccctgtaggtctgctctgtgcttttcttagcagggaaaaggagaatggagacgaaggaggagtggtcccactgcttggcaaggtgagcaggtataagctcccctggaactaaaggactggaagctacagtagcttagctcaatttaccttgcctctgtaatgctcatgagctcaggattcctggggcaaggggttctgagcagccagacactgtggactgtgcctctggagcagaagctgcagaacctttggaggaggtttcctggtggtggaggtcccatgtcaaggtgccatgcatggggaggctcgcttgagggttcacacaccccatatgcagggctcccatgccagtggctgtgaacctgagaagccagcagagcaacgcacaaggaagcacgctggcaggccggttaaggaaaggcctgttccatttcttccatcccccttcccaggctgcaatcctaaaagagcttaatcccagggagaagaaagaaggaaaagtagatctcctcccaatttgtgtctttcaggagggaagcgggatccatgctgggctgggagtggggaacggagtgagtattaaagtagacccgagtgaagtctctaagtatagaccaaactggaccgtgcttttcatccctggaaatgagcaggaagctaggggtaccctccatacatctggaaggggtgggacgggagatctgatctactgcaatagaaggtcgttgatgttttcctctttatacttagtgttctcaaagaatgatactatttttaaaattagaaagcaaaaaatttaattagctggcttatatgtcctgagtccaggctatttcataagtgaattatgaaactattatttttttctgaattgaaaaataaatgattataaaagaaaaaattaagaaaaaagtgaaagttatctatatttctaccatcagagacaactgctgttaacagcctggatatattctttcaggctttttctattctcttttacacacacacacacacaccgtgtgtgcatgcacacttaataagacctaaaataactgcattttgttaaagttacatgttgaaggaaaaaagtctactgtccatgtactctggaggcaaacatgtccccaagaaagataagattaagggactgagttattttcgtacaggtagttaacagaattatcattgataaatatcagtgaaataagttatctgataattaagttttaaacgaatcaacataaagcagttttaaatgagataatcccatacgattcactgcttcattcattcaacccacaacttactgagagtctactatgtgcctaggggtatcgttttctgcattaagaatcagtctaatttatcaaagctggatgactttgcaatacacctttagactctgggtgaagttgatgaacaacctattaactgacagatctaccaaatgccctctcagcttaaaaagttggtgattcacgccaggcacggtagcccatatctgaaatgtcagcactttgggaggccaaggccgtagggtttcttgaggcctggagtttgagaccagcctgggcaatgtagtgagactctttctctaagataaaataaaataaaataaaataaaataaaataaaataaaataaaatagctggtgaaccaaggaatttagagaatttctgattttttccgcgctgccccctgaatttcacagaagagaaaaataaagagacacaaaataacttgtcaaaggtcacagaactggttaatctaaaactagattacaatccaggccacctcttggatactcattcacctccccatttgttcatttactcaacaaatgttttttatgtcctacaatggaagtccagtgctcttggcttgtcatgtctttataataaagacaatcatcatcaccataactgttattaggcagtatgttaagtgtattcacttggattaccatgtttcacggtcataaatgtttagtaagtagttagaaaagataaggttgacaaataacagtatttacaaaactaaattctacctgtgtcctttgtgggggtgtacaggggggaggtctctgtgatgtaagtctgaaaggtgtgtatgtatgaaggagtttagttcatatactaaccagagaacacttagataacagaataagagactaggaacccaatttgcatagaggccactagacatcctggagaatggatgaggaagacttagggcctttagtgattcatgcacccactcagccagcagtgaatgaaagcttactattgggatataataataagcaaaatatggacacaattccttctggcatggagcttattgtccagaggaggagatcgatttcaatcacacaaataattgtgtattataatcctagctaacatgcactgagggcttcctatgtgtccagcactattctaggcacttaccccatgttatttaatcctcgccaataaaaaaacaaaaagaaaaaacctgtgaggttggtgctgatattattacccccagtgatgtttcttttttctttttcctttttttttgagaccgagtcttactctgttgccaggctggagtgcagtggcacaatcttggctcactgcaacctccgcctcctgggttcaagcgattctcctgcctcagccttccaagtagctgggaccacaggtgcacaccaccacacccagctagtttttgtatttttagtagagacgggatttcaccatgttggccagcatggtctctatctcttgaccttgtgatccacctgcctcggcctcccaaagtgttgggattacaggtgtgagccaccgcgcctggccccccagtgatgtttctgatgagagctctgaaggaaaaatgcatggtgataggaagtcatttattgggggagtctaatccggcctgcggtggaggaagacagagaaagagacaccctctctaacaagggtgaggaaggttgtcaagggctgccccatcttctgaggtgggcagggtactcaccaaacagcagggaagtgctgaaagagtattgattggggtactggggagtcattagtagtaggcaagggagtgaaaaaggaattaagtacttactactacctctatgccagtctgtgcagtgctgaaccctgtccctaaattattttctcacccagtctgggggttgtgatcctgaattccttggggcggggggagacgctcagagagaaaatgcaccaggctacctgtgggggagtctgattaaagcagggggaccctgaaccccagggaatggccacagcatggagtcagcagtgccaggtgctctgatgggggcagtgcagggacactggtgacagctgaggcaagctcaccaggcacacaagaaacaagtgcagagctgtctctcactggacacttccaaaggacttgggctttttttttctaattttcaaaatatattttatttctttcttatatgtattttgcaacatttccaaggtaaacatcagcttcatatacagaaataaaagagttctttaagaactggcattgaattaatcacaagaatgatcaaattataatgggaaacaaacttgcctattaccaaagctaatgagctgaagtgaagagctgtctttacaaagctctcattgagccccctgccctgcagctgactcaagccgtcatcacatatgtacatgtataagaaaggacattggcacagtacagcagctttgcaacctccaaaagtattttggttttagttcccaggagtacatccacaggtatttggtgctttgccctattgactttgatgggtcagttttgaagtttgattaagaacacgttctcttggaatgtgctaaattttcaattaatggtactaaatatgcaaagacatgtcatatagcctctacatttctgcatcattttcaacttatacacttgaaagttttcctgtacattctcctacagcatctttgatattttttggtttccaaatagtctgcttgtcacctcctgtgtgtactgactgcggagcactgctacccctcaaaatgttaagattcccctgtgagggtttttgttttgtgctttaccctctccacagcttttgatctgattcagtaacatggttggtctatgaagagcaatgactaaaaaaaaaataataataatcagagcttaatgtgatgtagatttcaaaaaaaaaatgttaaaggttttagttgtaatttctgaaaatcatagactatcgcaaagagaagtttttattcaggttctagaatttagattttgagggtccaacagattctatcaggtgctgttgaatatcctgtatttcctagctcttcccatggtttctggttatgttccaaacttctttatattcagcaatgatagcttcaacactgagctaagttttagttttggattcagtgtgcaatccggaatgggtgaaggcagctgagaacaatcacagattctggggctctagaggcatgtttattgagggccaggatattgggtgtgggttccaccagaacaataaatctcaaagtttgctgcctggaccagcagtgtcagcatcacctaggaatttgtcagaaatgcaaagtttcagggctaactcaaactacttgatcagaaactctaggatgggaccaggcaatctgttttaataaaccctccatgtgattctggtgtatgccgatgtctaagaaccattgagccactcaaaaccctagtggcttacacacaataaaagctccatttctcactgtctcagtctatcaggctgctataaaagagtcccacagactgggcagtttagaaacaacagaagagttttgaagtttagaagccactgaactgcctttgcaccttggttgaaaataaactgaccatgtgtgtgcaaggtgtttttttttttttttttttttaactgttttgttccattaacctatgtctcttgtggtcaacaccacactttcctggatatcatagctttatagcaaatcttgaactcaggtagcctcctgctgtcctatggaggtggagggagggaggatgggaagacctatgagtactgactcaaagtggagaaatgtcttaacaactctcctgcaccctgtcccccaatacagaggcctccaaatgaaggtttctgggctcaaaatgcagatataatgataagcatggctggcctggggtaaggcctgagtccttgactgcaacttccttcagagactgcagttcactgcctgtgctctacatctggtgtgagtagggcagctttcccctctaaggtctgctaggcaaagcctttacaattgccatggtcagccgtgattttggactggaactggacttctcagtttttggctgtagtaggtcctctgcatttgcatctgagttttagaataagcttgccaatttctactaaaaaacctgctggaattttcattgagacagtgttgaatctataggtcattttggagagcactggcatttaacaatactgaggcttcggatccacctacatggtatagctccacatttatttaggtcttttacatttctcttagcaatgttttgcggttttgatgtgcaggtctaacatatcttcagtcagatacaaattttaaatatttttgatgttaataaataagtagtatttttaaaattttgatttccattattttgtcttatagaaatacgatttttgcatatagattttgtagctgcaatgttgctaaaccagtattagctccagattttctgtagagaccatgacattaacctaaattatgtggtattaattaactgacaggcagcacaggtattacaggtgaaaagctggtgaccaagcccctccttttttttttcccccgccacaagacatttgataaaattgtcaactcagtaccttagcaggcagactacctgctctttgaatctgtagtagcagggaaaatggttgggagtgaatctctgggtcagtgagacagtactgccttcttcctgtctctttagcaaagtactttgagaaagatgaactcaggtaaaaactagtcattttgttaacagagctggaaggaaataaagtcatactaagatggagttctctgcctgtagtctgcaatacaaattgactgagtggtgatttcaagccttctagttctgataaagccaaaagctattacacttctgacagtgtaagataaaactgtgacccaaggcacttctcaaaggccatcagcaaagtgttctctgctggacagtggaacccagacaagcaatagaggtcatattaagggcactgccttcctaaccatgactgctgtttttgctgggtgcaagcatatagccactaagttagtaggtacaggagatatgagagagtctcgtaaataaaaatgaagagtagttaggcataagaaatatgactaattgagatctctatctgtggttatttgtaaaaggaactatacaaggaacaaacagataagaaatccattcggtatcttttaaaaattgaattgacaaagaagctattaagcctagcttgccaatgcctgtgtctatctgaccctactaaagtaacccacagtccctcaaaagcgcaccagtaagaaactggatataaaaagatgtgtagcctctcatggagcacactctttagcatgcccttcagatggaatcatagatcatgggtaagaacctcccaatgggtaaagacagtacctttggatgcaacaaaccagagttcctcctggaaaacagaactggggtctaaccaagaatttacttcattacctttgtagtctaatctgctcttcacattcgcttagacaaagaactactattttgtcctcactcttcttccaaattagttttcgtgccctacttcaccactgcatactggctgtgtggggaagagaaaggggaataaataacataatttactctgtaggtcattggaccatgaggagttatatcagacttgtaagggactgttacatctttagatcatggacgctgagctggatgcagtaactgcttagaatgctgggttttctctcttcaaacagggtgtgttctatgtgtcacaagggtatccatggatatttgaggggccagaggagtagattgtgtcacagttgtccaaagaacattcctgttttattattagaactgccaaatatccaagtattagttgtatctatagtcactccgcaagagaacctcatctcccaccttcccaagttagatgtggctgtcagatcaacagcgacattagattctcatcagaggacaaaccctatcgtgaactgtgcatgtgagggatctaggctgcacacacctcatgagaagctaactaatgcctgatgatctgaggtggaacagtttcaccccgaaaccatcccccatctccccttccccatctgtggaaaaaaactgtcttccacgaaactcgtccacggtgccaaaaaggtgggggaccgctggattagggggaatgtctgaagaaaaggaagtcctagtggtgaaaaaggcaccactgaaggcaaaaatgttcaattctttcctcaaaacaccaaagaaactaatataacttttcttgcagctattctggtaaacgaaaaacccttgtttttgaaataagatatatctgttctttaaaaatgcttattcttttataattataaaagtaacagccattggaatactcgagaacgttgtaacaatacagaacacttaaaacagtttaaagacaatgaaaagcagtagaatcccactattctgaacaaaaaaaattgcatttttttcgaattgttcagtggctgtgcaactgggagtacatgcattttcatatatactacatgtatacacgcacactgcatttgttttactttttcatttaacatcaaaattaattttttttttttgagacaaggtcttgctctgttgcccgggctggagcacagcagtgtgatcatagctcactgcagcctctacctctctggctccagcgttcctcctggtgcagcctcccaagtagttgggaccacaggtgtgcgctaccacaccaccatgcccaactacttaaataccttttttttttttttttttttggtaaagatggcgtctcaaactcctggcctccagcaatcctcctgcctcagcctctcaaagtgttgggattacaggagtgagccatcatgccaagtaagttatttcttcacactaaacattcttcagctcttagttgcagagtatttctagcatgtgaaacttcatacaatcaaccacaaaacacagacaaatcagtatgtatcaaaaagaagtaactgaaaaacacaaaatattgtctttgacagaatgactattttttcagacccttaatagtgaccaggccttcgcaagcctagaagggactcctgggggtgttttcatgaaaggcctgtggaaccgacttggtatagcctcatagcaataacaaacagtttaggtatcattttgtccaggggaaatacaaattacaaaatcaaagctagagcctttttagtgttgtatgcctggcaacacacctcattctacactatagcactgctaagcctcctgccctccttacagtccagaccacatgaaaacaaagtggtaactaaatccatgcaagaagctgggtgaaagcctcctttctgtgggtgctaatctgaagttccctccctcatctgagacgacctgcccattttggcagaacatgtgttaagccaaaatctcacacagatgaactcccaagtcactcacctcgctccaaccactttacatttagtttgagaatgtcacaggaacaaatgtcatctcctatgatttgagaaacaagaataatacaacaccaccattaagtccacctacactgccttaatggtgctgttggtgccttgctcccgtattttggccgctgcaaaatgggcttaaatatgtttgtaaatacataacttaatattgaattcatcttccctattccgcgcattttgagaactgtgcttagttttcactttggacgaatagcaacccttctgatggccgtcatgacaatgtctccaataaaaactgacagtctagctggctgcaaggcaggtcctcttctatcttactgggcactgctaaactgcgaagtcggggcgacacggcagcaactttaaaatcaaaccgcatccccaagggctcggcgtgttttttggcctctgcagcttcacgtacttcgtacgacaggagcgcacttgttctctgtccgagaacttcgtcccgagagaacctcaggaactcgccgggccacaccccctgtccagggaaggaacacgcccccggtgacagccggtacggccccgggtttgggcaacctcgattacgggcggcctccagccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcgggtaagcactggccacacggaaggcgcgggcggcgacgctgcgcatgcgcgcctttgcccggcggcagcgcgcccgctgcccggaaggaagccgtgggctggcctcgggcgggtcgcggggtgggggtctgcgcaggcgcgaaggggcgccggcagtggccggggagacgctggggtccactgacgtccctttgtctttgtttggctcgtcatcttctggagccaaactgggcattctgaaggaatctagtgcatcggtctcacttacccggagtgcataccgtcgcggccccaagttttgggcaggaaatgtgccgctggggtctggccttgctcgcgggcgcccgcggcgctgtgcctgcgccctcctttcttgtctcctctgcgccggccgccgggacccagggcacctgcagcggggctggtgcgagtgttgtcccgggaaatgccggaatgagacgagacgatgaaaaccttaagtgtggaactgcgtctcaggccagtgttctggctgaaagagtcacccctagtcacccctcgtgccctaggtcggccccgctgtccccaggggcaggggctgccgtatgctgggtcagcttaaagcgatgctccacaaacttggacaactttctagtcgttctcacatcagtactttgggaaaatacaataagggtgaaatactagaaaaatgttcacgtgcttcgatgccatgtaatggtaaactgctataaaagttttcaaaatcttggcaatttctgctgcagacagcacgcgtttcccagaacgagggccacacgttaatattaccttagtgcagcgcttctcagagtgcccccacctgccgcagcagcagcagcatcaccacctgggtgggcgttcccccattactgaatcggagactctgggggtggagcccaacaatctctaaaacaagtcctccaggtgattgtaatgtacgctgtagcttgtaaaccactgccttagagctgttggaggattaagtgatgtttaatctacacatggctcaatgccagagaaattcagcatttaaaaaatttccttagaagtttctttttcttttccttcaagaattgttgaggataggaggaggtcatattgagagtttgtcatctcgtagaataatcagtatgagattagaaaaggtagaggttttttggattagaggcagtttagaaattgtgtgactggcttattattaatcgaattagcagtttctgtttcctggtttccccatcatttcacctgctactcagccgtaaaagtttatttttgattcaaatgcagagattgagttttgaaacaaatctagattagtaaacatctatacttatatatagatttataaaatataaccagattatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacaccaaaaaaaaaaaaaaaaaaaaaaaaccccaaataatccaaaaactcttgttcagatttccaaactggttcaaggtcaagatggaccaaaatttactttggctttatcttaaccaaagtcttcccaatcagtttcctaatatgtaaatgacatttttggtaaaagatgagcaaacatttcagaaatgagccaacaatttttttcttatccccatcataacttttaactgcaaaacctcaggacctggttcttttccaggctctgctgtctccatatagctgtgagtgtttttggtacaccaacacatctctgtatctgggccagtaaacttttttttttttttttggtgtagggccaagcctacaatgcatatgtccttattgttcatctgttgtaactttttccacaaaaagtgtgtgaaatttagattgtggacgttccagtctccacttctgagccttgagaggttgctgaaagccctgactggctccagaaatgggcagtgttacctcttcagtgggtttcagtagctgtaaacttgaaacttaaggatttagtattgttctgaatgtggaattcacctccactgcaacttggatcctgtttaacaactcctcccttctctatattacctccatccatgtctgttcttatttgtaccctgaccctcaaaagttgcgtgacaaaagcatcaccttttgactgcagaaggcctgtttctttagtgcgtttagataagcctagtatcaggtgtgtaccattaccaaatacttgaggtgttaaggattaccatcttagcgttcatcctaccatttttatattcttaaggacaattccacccttttacacactgtgaccaagatttccaccttgcaagaaggaaagagtcaaaccttcaaagtttttcagtgtttaatttatcccaggctacctaaaatggatcaaaacatgaacaggcctacttgggtgagtggtgaaaactgaacctgccctggactgcctcatttgcagcctgctgtgttcaggttagggggcatctgggcagtgctggctggctggtagggcacacggcaatgtgtcttgccctgtatgtggagatggtctcattgtgcttcagtgcctgaccaccaagcaatactctgagaacttgggaatgagggacaaggggaattcatacttgttgaagtgtattggtattgtattgttcaaaataggctgcaggtagaaggctcataattaaaacctcagagtgccttccattttgttaagatgtgggttccttacagtcagaactgatcttatttccggtgaattattgtaattattgtaaaagtccaatatggtttggttttgtgtcctcacctaaatctcatttcgaattgtaattcccacctgttggaggaggggcctggtgagaggtgattgaaacatgcggggggtggactttccccttgctgttctcgtgagagtgaatgaattctcacgagatctgattatttaaaagtgtgtagcttgcccctttgcgctctctcgttctctcctgctcctttgtgtggagatgtgccagcttcctcttctgccatgattgtaagtttcctgaggcctccctggccatgctttctgtacaggctgtgaaactgtgagctaattaaacctctcttctttataagttaccttgtctcaggtagttctttatagcagtgtgaaaacagactaacacaaaggccgtctttcatgtggaacttgtttttgcgtattggaaacattgctaatctgtgtttgggaatgaatcttacctttttatagagtatcagtgggatcaggtgtttgggatttggagctgtcctttaaaataactttgacaagtttgattctatcttggctttcttgcgtttacattcttagtgttcattgtatttttttgttacagtgctttttttgggcactaacatgttaaaaacagatgtagagcaccatcagaaggtattctcttttaagaactttaaatagaaaaaaacagtagaacaatgtattaatccaaaaggtggctctttgaaaaaaaattgaactacactaatgacatttgtaaacaatgaggtagtctcaagaaaaagatgaaagtacaaatatacaaaataagtcctgagaagaggagatcataaaaacagataatttgaagaatgttaggagactactgaactcttttaaaataaactttaaaactttgatgaaaatgataatttttaggaaaatataagtaatccagattgaccccagaagaggtagaaaatttaagcaggttgatttttatagaagaaataaagctatgaaagagttacctcctctcaaagcattgtctagtttcaccaagattatctaccaaatatttaaagagcagataattccagagcaggaataaatggctatttccttgacatagcatatctatttgaacccaaaagcccattttaggcttaatgaagaaacgttgagatttccactgatgttcagaccaagacgaggagtgagaacagcctagtaccttttacagtgtgcactgttagcaaaattttggtgttatcttagttttaatcccacctttaaaaataaattctaccttttttgtattaaggaaacttccacctttttattaagtgtgatctagtcgttgatttatactttgtaagaaggtaagattcaaacctttaaacttcttaatgtttaatttctcccaggccacctaaattggattataacatgaattggcctactttgaatgatagattattattttacattgtaggtacagccagtgtgatcagacaaagcaattcgagaactacaaaagaggaaaaaagatcagaagttcttaaatacataagggaatgcagcatttgataaaggtggtatctcaagtcagtggggaaaaggtgaaatattcaataaatggtattgggacaactgggtagccatatggaaaaaaaggttggatctctacaccgtaagccaggataaatttcagtgtttgatggaataaattccagatatatgatgataatagctcacacttgttaagtgtcttgtatgccaggcactgtagtaatttactaatgcatttaatccttacggtaacccaaagaagtagtaactgttatcaccacttatagatgtggaaactgaggcccgtagatgttaggcagtttaaacaacatacattgctaataagtagtggagctgggatatgaacgtagtcagtttggctatagagttgctggccttaactcctatactctttttccatttaggttattgttaaaaatgaaacagtatgagaacagaatgtttttataatctgggtgtgaggaaagccatgacttaaccatgacttgaaaatcggaaaacgtaagactgataaattagattatatcacagtaaaaagactgataaattagatcatatcacagtaaaattcttctgcatggcaaaaatcatcataagcaaagccaaaagacaaacgatggtaaatagttgcaattcatatcataggtgaaggaccaatctttttaattatataagaagcttctagaaataaaaacaccaacatccattggcaagatagacgttaggttatgaacagaccgtttacagaaaagtacaattggcttttaagcatataaaaagatgctcaacttcacttataatgagaatgcaaataccatttttcatgtttcagactggcagaaatccagaactttgacgatacactgtgttggtaaattcttaaggaaaaatacactcttgtacatggctggcaagagtataaattggctcaactcctatggaaggcaatttggttgtatctatcaaaaattcaaatgcatataccttttgacccaggaattcaatttatgggaatttatcgtctggacataactgctatgcatgccaaatgatgactgcaccaggttattcactacagctttgtttgcaatagcacaagactggaaacaacccaggtgcctatcagtagtggctagttacataaattacagttcattgtcacaatggatatgcagctgtaaaaaagaatgtggaacatctgtgtgaatgggtatggagggattgccaagatgtagcattaagtgaaaaaagcaaagtctcaacagtgtatatatacagtatgctaacttttctgtgaacagaagggaaaataatatgtatagagtaactttgaaaggatagctaagaaattaatggctgaggagggggctgtgtaatgaggatggatggaagacatagacttttgatgcttttttgtaacttgcttcttgtaatgtgactgcatttgtgaattacataactccactttgaagatgatctgtctcgctgtttttagtctaattgaccacctttctgtcatcttttgtcatacttacttgaagtttttttttttttcaattttgctctttcttgtcaagtacatcttttttctgcaacttgcttttgtaatcaaaatctacattttggcgtgattgaaaaatcaaaatttagagagtgaaatcggaataagttaatccaagtcattttacatttcataaatattcatttttattgaagcatcaattgtgatggcatcatttatacaaagaacagatctttgaggacaaattccttccgctattatgtagaaggcattatgtgtatttcttgtattgtgagtgatgtacgttgatttttaaaagaaaatgatagaaaacagttttccttttagaaaagttttccccaatgtgtgattaatttctaaattgtaggatacagaattgttatttcccctctttgcatcctgcccagagctctttgattttacaacctgttccagaacgtttagtgtttccctgaagtccctgggatgagggtattctgtacctcccacaatgtgatccttacctgctttcccagtctttttctccactgtgtccctgtagaaccccatcttctgcctaatgtgtttcacttttctgcctctgtattgctcacacgaccatacccatagcgtggattgcacacttggatctttttacttagtcattcattaaatgtctattaaaggcctgcttaggaaagacctgtattgtccatatatccttatcttcaaggaagcatccttgaaatttgccctgctctaattccccttctcccggaaacccatcctttttctctccaacctaagtgatctccttcttctctactggacaaatagctatgtactactttatgaatcctttctatggcatcttgcgttgctaattagatgtcttattgcacggaactcgcacaatctgtctcatctccccacgtagtgagctcacagcacttcaccaagagtgctgcccaccaagaactcacagcacttcaccaagagtgcagtcaatagtgttttatgaacgttgggaagaatatggttaatgcctgagaacaaagaccagaaatgtcatcttttcgtgtgaccatcatgatacagagaagttaacagagctgccccattgtccatggggcatgttccgagtttttccagtagtggtgatagattttggctgatttctctgaacttttccctgagttatttttgtgactttggccaggatgaagggtggggaacccctcatctttaaatctctgagcagagacttgctaggcatctgcagcagtggtggggaagaggtcattaagctcagtgcagtccacgtggggccttggcctgcgatcttcaggctcaggagttattgtgagcccctgcgttgggtgggggaagggaggaaaggaggacagctgaggcaaggagtgggagcctggctgggggaggagacatcagcctggggcatgggtcttatgagggtgagtggccgccaggccctcagcaaggaccagagtggaagcctctttgctaagcttggtctggctcctgcatgggtcccagcagcgtgccatcaatcatccgttcctccttggcagatggccaggctccttcccatgcagcagcagcagcagctggctggccctgccctcctgtttcagctgacatcggcaaccctctggggatgtatggaagactgaattctacaagagatgctttcaggatgtcagtgcatgatgaatgaaagttgtggatcttctacatgctgctcttatcttcctcacatcataaactccaagtttgagagcatcacaatattcatcgatatgtagcactacacaatgaactgagggcaggaattgacttactctttgtacccggaacacagtaagctgatgataaatacttgttgaaagactgtagcatataacctgttgagttgtttgagaggccagggttcctctgagcagtatcatgccaacagacacacgcatgttatgtattatggcacataatcggtaagtccataactgttggagtaatggggacgagcacagtgcactgaagggtacaggaagcatcggggtttgggggctccggcctacatttgtggttatgttactggtttttcctatcgcatcagaaaactttattaactagatggaatttctgcagccagatgaaaatgtatgtgataggagtggatcgtgtgataggagtggatcgtgttagctgcgtgagattgctagtgaggcactgagttgtcatcaggtagcaattccaccatttccactggaattccttagcacattttaagctaaaagaggtaagaagtcagaagggtaagagtctggccatggctttgctttcttctctcacgcttccaaccaccctcgtctgaaagctacatttcaccttgtgaaagttctgcccttctgtttccaaatacaagatgctgtaagcctgaactcagatctaaaaccaaacttagcattttgtttccaaaagattgactacatattttaatttcccaacctctctcagtggcactgctctcctctcaaatcccagaagccgcagtcagggtcatctttgagccttacctctacatttgagttgtccttcctcccatgagtcccgatgacttcttttcttcattggtctctgatctgtcttcactctcccctgcctgagctgttcagagcattatcaacatctacctaaaatttgaatttcattctctcactgtttagggaacagcagcgacttggacctgtccaatgacactcttcaatgctggacacttgctgtaatttgctgctggcctcagtgtttcagatctccacttccaccccgaggctggctcctgctctgagctccttccttgcaggttgctatggtctgaatgcctatgtgcccctactgaattcatgttgaaatcctcacccccccaggtgatgggggattatgaggtgggggctttgggaggtgattagtcatgagggtggaacacgcatgagtgggattagtgcccttgtaaaagagaccccagataactagctagtcttttcggccatgtgaggacatggtgagaaggcgctgtccgtgaaccagaatttgggctctcaccagacactgaacctgctagcgctttgatcttggacttccagtctccagtattgtgagaaagaagctcctattattgataagctgccaggttatggtaaattgttatagcagtctggcggactgagacacaggatgttttttccttgcagccctgtctaaaacatcttggggctttcaaggctaaacttggcttcttccacttctctgccgccccttggggctgtttcagcttagattgctcttagagttggagctggaactagggctttggggctctgttttgtgctttcattccagtgtctctccttggggagatgaaggtagaatccctttcctgtatttggtgcttggtggtagtcatttcccccgctgtgttttcggaactcctagcctggttatagaagctgctggcatgatcagagttctcagattccagctgctttctcctggatatcctatcaaaatgccctctccgttcagtgagatactcgatgactttgactcatgatgccaaatgattgatttttccttcaccagagacctgcgtgtcctctgggtcagctggtacctcttctgtaagctcgggctcttatgaaaggggacataggcttttgcccaatttttttttttttaaaggcatggtttcttgtatttctgtaggaattttgtatcctttcatggaagtgcatctgtagtgtttctcagcagggtatattcctaatccactaacttgttgaacaagtatattaaattggcatcatgatacagcgaaggctagtaataatgaaacaggaagaaatgtggtgacagtatatttagatgattataaatacattaaaatacaaaatttaggaacatcggatgtcttcccagagcatgtttataaaatgaattctttcaaagatgttaccataggaaagtaatactagtgttgaattttcctttaaaaagttttcgtattttacctttgatttaaaaaaattagtttaccattaggtattttatactttgcataggtcaaaagtcatgtgcaaaattaaaaagcatggttcagatgaggccacaaattattctttggcctgctgaaaagatctgatattttaacagattgtacccagaagggaagagtcatgaaaatgaaatactttgagggaattcatagctttccacgtggggaaaatgagacctgaagtaaaaaattttgaatgcactgttgttagcagttgaaaaccgcgtaagagtttgcagaatggaatggtaggctgtcacagagcccccgagaaggcattgcattgctgaaaactccattgccttacctcttcctgagaggcagtttacaaagagccacctcatctaccagtgagccctctgcagggacttctgctggtccctggggtgtctggcttaccattcagcattcctcacaccccgagatgtgtgcatcagcatgaaggagtgcttctcagagccccagggtgtccaggtggtcctgataacagagggcactcaggcagtctgtccctgctagccccatgcaggttgctgggaaagcacctgacaccaggagtagaaacttcacctggtggcccatcctcagaatgtaagaggggtttcaggagcccactctagataacttaaaaaatgttttttttcttcaggcttatgctcatactaacaagctctgtcgaattatttcaatgtgcggaataaaaggcaagaattattttctggtgcagtttagaccttggatgagtagggttatgcagctgtttgctgcagtagttttggggagacacacacctgacttaagctatgtgaatttggatatgaagttccaagtgtaagatatgaaccaaaggatttctcttaacgtaacgatggaactcaagcctgaactatttttgttcattaacaacctggcagttattttttcagaataaggagatttatgaaagagctgaagtctgggcttcattttgcgtgtacatttgcttccgctgttgccggatggttggtaaaggaaattgatagagtttttaaagtgaggactgtattgtttactttatgtgttgttttaaagtaggaaggaacacagtcgccctgctatcagcctctggtttcttgtcccagtggcgctaagagtcaactcttctgcctgacagtgcctgctcctaccgtgcctgtgctgagatagctcctcctggcttcagggcctttatggctgaaacttcaattatatatataaaatatataaaataattattaatataacttaatataataatatataataacttttttgagacggagtcttgctctgtcggccaggctggagtgcagtggcatgatctcggctcactgcaccctccgtctcccggattcaagcgattctccatacctcagcctcttgagtagctgggattacaggcgcccagcagggtttccccatgttggccaggctggtcttgaactcctgacctcaggagatccacctgccttggcctcccagagtgctgggattacaggcgtgagcccctctgcccggccaactttgtatttttgctcaaagtttgatctgtacattttgaatcatttttatcctttttccaatttcccaactaaccaatgttcagacccgagaaagcattctccaaaacctttctctgtattcataaaatcatacacacacacgcacaattgttggttttttataaaaatggaccagattgtattttctgtatcttgcttttcttgcttaatagtacatcataatatctccagttcagctgatatatctgtttttctttttttgagacggagtttcactgttgttacccatgctggagtgcaatggcgcgatctctgctcactgcaacctctgcctcccagcttcaagtgattgttctgcctcagccttccgagtagatgggattacaggcatccgtcaccagacctagctatttttttgtatttttagtagagactggtttctaccatgttggccgggctggtctcgaactcctgacctcaggtgatccgcctacctcaccctcccaaagtgctgggattacaggtgtgagctgctgcacctggctcagctggtatatctttagtatgttcttttatcttaaatgacttttttttttttttcgagcagttttaggtttacagaaaaattgagtggaaagtacagagttcccatacacactcctccctgagtttcccctgttaacgtcttgctttagttacaattgatgagccaatatagatacattattattaactaaagtctgtagtttacattagagttcatttttgctatcatccagtctgtgggttttgacagatgcatgatgatatgtacctaccattgcagtatcagaacagaatgccttcactgccttaaaagtcctctgtgctttacctatttgtccatctcccccttcccaagaaccccttgcaaccactgaactttttttattgtctccatagtctttgctttttccagaatgtcgtatatttggaattatatagtatatagccttttcggttggcttctttcacttaacaatatgatttgaggaaccttcatgtcttttcctggttggatagccaaatttctttttattatcaataatattccattgtatggatgtaccacagttgatccattcacctactgaataaatatgtgcatcacttacatggggatctataattgttttggcagttatgaataaagcctctattaaaatttttattcaagtttttgtgtggtcataagttttcaactcatttgggtaaatgcccaaaagtgtgatttctgggttgtatggtatatgtagttccataacaaactgccaaattgtcttctgtaccattttgcattgccaccagcaataaatgagggttcctcttgctccacatccttcccggcagttgttgttatcagtgctttggattttagctattccacagacatttagtgggatctcattgttttaatttgcaattcccaaatgatatatgctgatgaagatctttcctgagcttatttgccatattatgttttctttggtgatgtgtctgttcaaatcttttgcccatatttcagttgggttgttttcttactgagttttttttttttttttttttttttttggagacagtcttacactattgcccaggctggagtgcagtggtgcgatcttggctcaccacaacctctgcctcccaggcccgagtgatactcatgcgtcagcttcctgggtagctgggactacaggcatgtgccaccatgcctgactgatttttggatttttagtagacatggggtttcgctgtgtttgccaggctgatgtcgaacttttgacctcaagcagactgcccgccttggtctctcaaagtgctgagattacaggtgtgagccaccatgagtggcctattgttgagttttaagagctctttgtatattttggatatcctttatcagatgtgtcttttccaattttttcccagcctgtggcttgtcttcttatcttcttgacagtatctttgggaaaggagaagtttttaatttaaatgacatccagcttgtggaccatttctttcatggattgtgcctttcgtgtatctaaaaagttattgccaaaccgaaggtcacctagattttctcctgtgttatcttctaggatttgtatagctttgcatttagctatgtgatccattccaagttgatttttgtgaaggttgtaaggtctgtgtctagatttatttttgcctgtgggtgtccagttggtcaagcccattagttgaaatgactgtcttttctccatcgtattgcctttgctcatttgtcaaagatgagttgaccatatttatgtgggtctatttctgggctccttattatgatccatttgtcagaatagacaaatgtcttttcttttgctgattgttgaagttgagtagcatcggttctctgactttgttcttctcctttaatattgagttagctattctttttttccccctttccatataaagtttagaatcagtttgttaatattcacaaataacttgctgggattttgattgcaatgatagggttgcactgaatctccagatcaagttgggaagaactgacatcttgaaaatattgaatctacctatttgtgcacatggactatctctccatttatttagatatatttctttcatcagatttttagtcttgttcttagggatcttgcacatattttattaataccaaaatatttcgtgtttttttgatgttgatgtaaatggtcttgtttgtgatttcaaattccagttgttcgttgctggtataggaaggcaataattgactttcgtatattaatcttgtaacctgcacccttgctgtaatttcttattagttccaggatgttttctggattttctacatagacagtcatgtcatctgtgaatgaacagttttatttcttccttcccaatctgtacaccttttatttctttttcttgtcttaccacattagctaggacttctagtatgatgctgaataggagtagtaatagtggacatctttgcattgttccagaacttagtgggaaagcatctagtttctacttttaggtatgatattagctctggatttttaaaaatagatgtttgtcctcgtccattcgtgttgtgataacagaataccacagaactgggtaatttataaagaaacgtattttctcacagctccggaggctggcaagtccatgatcaccgtcaacatgtcagcaagttcagttgtctgctgaaggctgttctctgcttcaaagatggttcctctggattggagaaacagtgtgtcctcacatggcagaagaacagaaaagtgagctagctgaatgctctgtgaagcctcctttataagggctttattctcatccatgagggatgagccctcatgacctaatcacctcttaagggtacctcctcttagtaccatcacactgggaattcaatttcaacacctgaattttggaggggacacattcaaaccaaagtgatgttctttatcaggttaaagaagttctctactcttagtctgctgagagttaatatgttctttttaatggctgcatgaagttccatggtatatatgcacatagtttattaaaatgaaacatgacaaaaccacaccctctttaacgttgaaatattgatatgtttgttaatcacagcacgtggtatgtatatggtaagtgcttacgggtacctccctgttaaatcttgccaaggatataaaattggtgccaggttatgtaatgcttttgaagccaacttgagtcttggatcagactggaaaatggaaagaatgtagattctgtgatgatgaatactttggggaaaataagaggattaggtagctgatgcccacctttctatcaagggagcaaaaatgtcctatgggtctttgatctttgccagtgcatttggattggtttctaagtacagcgtggcagccgggttatggtattgttagttctggaaacttagtcaatttgcatctggagtcacctagtcacatttgatgaaatgggttacaaagttttagcacctttctgtaaaccaggggttggcaaataatagcccacaggccaagtgtgacctgctattttttcaattaagttttaaattttgagataatgttagatttacatgcagtagttagaagtaatacaaactgttgtactctgtggatctgttgtactctttgcctggtttcctcagtggtacatcttgcaaaactatagtacgtcattacaacgaggatattgacaatgacagagtcaatatacagaacagttctgccaccagagattccttgtgctgcatttttatagccacattgaccttcttcctcaccccctgcccatgtgcaacctctggcgaccactcctgttctccattgctgttatttcatcatttcaaggattttacataaacgatgtcatatagtatgtaacctcttgggattggcttttttcagtcagcacaattccctgagattcaccccagttggttaatgtaccagtgctttgttctttttcattacagagtattattacttggtgtggatgtaccacagtttaaccattcacacattgaaggatatctagattgtttccagtctttggctgttacgagtgaagctgctatgaacattcatgtccaggtttttgtgtgaacataagttttcatttatctggagtaagtgcccaggagtgcaattgctgggcacttacatgtgataattgcatgtttagtttcataagaaactgccaaactgtttcccagagttcttcagtttgatattcccaccagcaacatatgaaggatctgatttctctgcatcctctctagcatttggtggtagtgtcactgttttattttagccattctgatagctatgtagtgatatctcatcatggttttactttttatttcgttggtggataaggatgttgaagatcttttaatgtgcttgtttgtcatttgtatatcctctttcgttaaatgtctttggtagacgttaaacatttctaattgaattattgctttactcttcagcggagtcttttatatattctcattactagttttctgttagatatgtggtttgtaaatattttcttctaggctgtagcttgccttttaattttcttttttttttttttttcttaagacttgtacagagtaaaagtttttaattctgatgagttccagcttcctaatttttcctttcatggatcatgttttcatgtcaagtctaagaactctttgccttgcgttgatcctggagattttttcctatgctttttgttttccttaaagttctgtagttttacattttatatttaagtctgtgatccattttgagataatttttgtttcaggttgaggttgatgtttagtttgaggttcatttgtgtcaaacagaactctgtgtactggtgttcagttccaagggaaggctggcactccatggaggttagcaaaaaccatcattatgccaaccatcaggaatacgatccagacacttgtgcccgctgtatctcagtacgagagtctccaaggaaaacacaacacagtcaggtagtcgagggagcaatagttacacagagaagagacagagcaagatcagtttcagtagtgcgtatgggtcccctgtgtccaggggtccctcgtggctgcccgtacggggtggtctgcctacgagcacccctcttgtactgcaactaagggaccctgtttcctgggtggggaacagatagagcaatgaggttggccaggtgccatgtgacacacacccttaagcagaacaaaggcgcacacatgagcttgcagcagtgagagatacgtattccacacaaggcataagcctgccacaggtgatgagggctcttcatctgttggtgagatgtgtttcaggcccagggcccattcttaggccactgagtgggggctgaaaggctgtgcacacaagactccctttcgcaacattttttttttttttgtctatggatgaatattcagttactacagaataatttgttgaaatcctttctccattgatttgcttctgcatttttgtccaaaattagttggccatatttgtgtgggtctgtttctgggtccttactccctcccgttgatctatgggtctccctctgtgacattgtcatgctgtcttggttatgatggttatatcgcaggccttaatattagagtcatccctcccaccttattcttccctttcaagattgttttagctgttctaaggtctgtcccactccatataaacatccaaataaacatcagaataaactctctgtcaacagaaaaaccttgctaggattttgataggaattgcatttagggacaattgatgtctttattatgctgagtctttcaatccatgagcacagcatgtctttccatttatttaagttgccttcaacttctttcatcagcgttttgtaattctcagtgtatagatcttgtgcatgtttgctatgttcatacctaacctaagcttttcattttctttggagtgattgtaaatgatatggtatctttaattttggtttccacctgttcattgatagtatttaaaaatgcagttgattttgggatgttgatcttacatctttcaaccttgctgaactcactttagtagaagttttctcatagactttttcagatattctacatagataaccctatcacctggaagtagagttttaatctgtgtgccttttgtttttcttgccttatttcagtggctagaacttccagtattatgttaaataaaagtagtgatctgtggatatttccctagccttaaaaaaaaagtattgagagcagacatgcttactttgtatctatcttaggggaaaagcattcagcctttcactaaactatcacatatgatgtcagctgtaggcttttttgcagatgctgtttattgagttacggtagttcctctttattcctaacttcctcagtgtttttatcaggaaaagggtcttctaccacctgtttaaataaagttttattggaacacaggcatgcttattgctttagctgttttctgtgtctgcgttctcagtgtaacaccagaatcgagtagttgtgatagtgaccatatgaccctcaaaacctaaaatatttattatctggaattttacagaaaaggtttgctgaatcttactatagtttcaccaactttttcttttgaattgtccttttttctttctttttttccaagttcttcctatctcttgatattctaccatggttgcaaactcttactccacacactcttactctaattggctaagacctagagcttgagccattggctgcggccagcctcagaagaaagcagggaggatggatagatgtagatctagttgccttctaaaggcactttctactctttgtctgtatttctatcaacggtagcatttggggtagttctaacatgttcttttgataacttctattaattctgtagcttgacagttaccctgaacaaattactttcatttcacttcttcttgacctcaaccttctttcctgccttgattctctgactcttcctatagtttgtattgctgtgtttccttatgatggaaagatacatgacttcactgatctctaagggatttaggggagtgttgctttctatacgtgacagttcttcactttttagttacatagttccattttgttttgtctaagggaggtgcttttttttttttttttttttttttttttttttttttattaaatggagtctcgctctgtcccccaggctggagtgcagtggtgcgatctgggctcactgcaagctctgcctccagggttcataccattttcctgccttatcctcccgagtacctgggactacatgcacccgccaccatgcccagctaattttttgtatttttagtagagatggggtttcaccgtgttagccaggatggtcttgatctcctgacctcgtgatctgcctgcctcggcctcccaaagtgctgggattacaggtgtgagctgccgcacccagcctgtctaagggagttttaaaatgtttagctttgaaaagtttgttgctttcgctgaaaagagtgggatgaagtatgacctgagtctctgagttaggaaataagtgaataagtttttttgatcactgaaaggtaaaccactgtggtattgtgtttattgattattaattgatagagatattatgtcctgcatctctacattcacatttgattattttccagcttgcttgatctctccccagaacatggctttattgataatacaccccttcttcttcttttcttttcttttcttttttttgacacagtcttgctctgttgctgaggctggagtgcagtagtacgacgcctcctcacagcaacctctgcctcctgggttcaagtgattcttctgcctcagcctcccaagtagctgaggttacaggcacctaccaccatgcctggctaatttttagagattacccagagacgggggttcaccgtgttggccaggctggtcttgaactcctgacctcaagtgatctgcctgtctcggcctcccgaagtgctgggattacaggtgtgagccaccacgcccggccccctgtacttcttttttctctttgccatgcttctgtttacccattactgccaacccatttgaccctccttgcttaggaattgctagcatttattttctttactactcatttggtatgcattcatattatttgaagacttcatatattgtctttttatttaagtttataatagtgattattgtatttctgttttctctataatggcattgcaaatttaatgagagcttatttacttatgtggatccctcccacacctaggcatgtctgttacatgatgaccattagttaaatgaactaaagaatgattgagcttatattctgtagtatcgtatttggaagttgtgtgttcaataaaactcttttagtataattcaggccaataggtattaatattaatgaatgtcagtaaatggaagctatgtttttaccttctagcacaaacatctttagaaattttattacgactgtgtatgtgtgtccagtggctgactttccaagcagttattagaggagatctgagtttttagcttctgcattatgattcatgttgaatatttatggaagagaagtgtttctacaaatatgtaaaaatattggtgagtgaaagaaatggctcccagtatgacagaagaaaatatcctaaagagatccacagttatctgcagtttccccaaggttgtgtttacataaaaaagacattgttttatgttctagcatcaagagatgattttacgatataacaagttccacaaagaactctcgtaagatggttctcagtcccggcataactgctacggagatcacagagcaatattattctctggatttattgggtttgctgcattctgttagcatcattcatatttttctcccatgggtaccactttcctctcttttcctaataccaagatatggagactcatttatgccgtggagtgtgatgctgggaaatgaatgcttgcttattacctctctccacaggacctttcatgaccatacgtcgatgtctgccgcctcagtataaataggcacattcagaaatgtgttctctagtgaagggcatgttggcttggtggaaagcacagggacttcacgtctggactgcgagtcagagctgtgcgtcatgtgcttaactggctgtgtgaccttggataaatttgcctcagttttctcatttgtaaaacagacagtcgctatttctgggaatagatgagataataaggaaagaacctagaatggtacctggctcctgccagttgcacagaatgtttgttttgcagtgtgatgcgtccagtagggacacttaggggacagtgtactgtcatgctgttgccctgttttgtaagagtgactgatggctacgtgacatcaccacactccctgcaagagctgcggtgtatggcacgtggctaagctgtaggtgcacatggccttcaactccacctgagctccagccttctttttgggagaactggcctctgggtccacctatgaagcaggaaggttgattattacttaaacccatagtcttataacctcttgggaaaagattctctcaaaatgactcttgatggtcaacatgggtgtgcatttacgcagcttccattcccatcgcttcttgcaggcagtgttgttcctgattgccccagtctagtttatcgcaagggaatttctttgcggggcagtgagctcccttttggcagaagaaagagtcaagcagaggctgggaggttcccttacccacagtggtggctggctctgtagtgcctcccggctctgggttctactttcctagtctcctgcctttccgcaagtgtctccacccagctccgatagagtgggtagcatcaggagaagggagggcagggatgagtgttgtagcatctcaacatttaagagcagaggatggggggctggggaagagcatacactggggccgggtgtgaggagggagaacattagaaaaaaaaagctaatgcctgctgggcttaatacgtaggtaatgggttgataggtaaatgtgtgccatggtggtttgctgcacctatgtaataaacctgcacatcctgcacatgtacctcagaacttaaaaaaaaaaaaaaaaaagagcagaggacaaggagcctccaagtttatgtggaaaaagtagttagaaaagcaaaaagagtactcaggaaaccaagagaaatgagaacatcaggaagaaatggatggtcggccacagccattgcatttgacaaccaaaagcttttgccaacaatgatgggcaaagagagggagggcgagagccaggcaccatggccaggtgggaaagtgtggagacctgcagatcctggcttctctttcaacagcttggctggaaataaggcaacaggttcaaaaggggtagggtttttaaagatgggagagactcaaaaatgtgtgtattctaaagggggaagatatgggaagatgttgaagaaaatctaaattttgtactactgtttgtcattttatacatggattctttttcactaccttctccttttttttttttttttttttttaaatgagacagagtctcactatgttgcccaggctggtcttcaactcatgagctcaagtgaccctccctcctgagtctctctgagtgttggaattacagccatgagtccccaggactggaccccttttgttttttattcctagttacttttctgctctttttcctctcagcctccctcactcttccctccctcgctcgctttctgaggcttctgacaactcatctattaataagtttcttacagtcctgtccttctggaagccctcagtgccacatggaatctggacctggcaatttcttgctatccatttaggaggagactgttggtgtccattggtcccatttactcatccccggccatgtgttagctgtctgtaattctgtacgttgttgctacagtatttatatatgtcaagatgtatctcacagcatcttattcaccctaatattagtgaaaatattcactaatattttcagttttgtgcttaattccttgaaggttttgggatttaagcccaaccaatttctgcgaagagcagtagcataggaaattaaacacaaaaaataaaagtttaatttagaactgccctaaagccaaattgggaaaatttagtcactgttttccggtaagtacacagtaacaggtgttttggatggggagaggtgagcactataaagatgtctctgcagttctgaaatttccttttctgctttttctttccctcttcttcctcctctttaccctcctcctccttccctactcagccagtttgctatcgagtgtaatacccatggtagagaccaggatggaagctgaaacgtgagagaggtgtgtatgaatggttggtttgggtgtatgttcacattcatgcgtggagctcagtgtgatggaggtgggtcctgtaggctcactggggacccttggcgcagccccgttcacatggttgctgtggtgctggactggccactgggactctgccctcaggcaccagtgacccctgggggtgggtcatctgaccctttctggacagcgtctgcttcctgcagcttgtgtgcctgttttccagagatgggagctgtaaactgtgaaagtctagggctggcagctgccacggtgctgcaccctgcagaagatctgctttcagcaggagaggctgaggcccacgggaggaggcagaaatggtagctggtcccaagctccttagctataaccatttttctgcccttcccatggcttcagtcttcagcgtttccttggattctttgaccaaaaacaaccagtctatctccctgtttctctttgcctctctttccttaaggcagtccaagttggaatattttcacctgcagctgaattaacatggatgccttccttatccttaacaaggtttgtcttgaatggaaaataaatggggatcacatttggagccagtggtccctcgctagcttttcatgtgagccacacttagaagccgtgctagggccgcaggcgtgctggacattcgtgttgttccagtattcaccgctgtgtgctggcaggatcctacctggaggttctggggactgcttccccatcccgcagagtttagcgttgcccgcaggctcataggtgtcaagaaccaggtgagagatagcacctggctcagcatatgatgtggtacttttttctttttttttaggcagggtctcactttgtgggccaggctggagtgcagtggcaggatcttggcttactgcagcctcgacatcctgggcttaggtgatcctcccatctcagcctcccacatagctgggactaacaggcatgtgccaccatgcctggctaagtattttttgtagagacagggtttcgccatgttgcccaggcttgtctcgaactcgtgggctcaagcaatctgccttcctaggcctcccaaagtgctggacttacaggtgtgagccaccacacccgaccatgtttgttctagaaaaataaagctcattaattacaggaacatcgcagcttactgcctttctcactagcagccatgacgtgagctcctggtagaaatgaatagctcccttattaaaactgactggtcttaagtgtcacatcatgaagctttggatctctttccttccccgcagtgtccctccccgcacaacataaggaaaacctttcttagtccttcatatttggtgcttgggtgctaagcattacagcgctcttggctatccagtcatgcccataagccacaaagtgtttccctgtcaactgggcttcttctcttatcagagccaaggtgagaagccactgtggcccctgagagtgggctcaggaattctcggttttggcttgctattaatttgctgtgcagctttgagctatttacctaacttctctgttcataaatttgctacttatgaaaagtgcttgaaagcgaagttcctagaggctcttttttcctcctgacctgcggtaattttaagtgctttcttgtgttacgcttagcactttctctcttcccgtcaaaattaatctcctttcctcagaagctgatgaattagaactctaagccacgcttctttcttgcatggtctcacttgcttttctcccccatctttttctctgttctttttccccttgaggcaaaggcagagaaagaagatggaggcctagcagacgggttgctaatacagttacgacattctctttctcagtctaggggaagttactctggcaattatgaatccatatccctgcctaggaactaactttatcccccttattagtatttcatttctatgggatggcttcttgcagattttttttaaatcttttttttttttttcctgaaatttcttacagagaccaaccctgttttcactatctgaatatttgaaagtatagttgaaactcaggcagtttggaaggagaaccgtgctgtggtttcctccaggagccgaggttctttccacaggactgcacatgggccttgtgctttgtggactgtcagttctgtgtcagcctgcagctgtctctttttaattttgttgtgttttttagagaaggtctcactctggagtggaggctagagtgcagtagcacagtcccagcttactgcagccttgaacttctgggctcacgcaatcctcccaactcagcctccttagtggctgggactgcaggcatgcgttaccatgcctggctaattttttttttttttttttaatttctagtagagatgaggtctcgctatgttgccgaggctagtcttgagttcctgggctcaagcgatcctcctgcctcggcctcccaaagtgctgggattataggtgtgagccaccgtgcctggccttggcagcctcatcttgagtgtgaaatttgtttacagcttttcttgctaaagactagtgtttcttaattaccatgtgcaaggtcttccataccgcagaaggctgttgggcaaggcatagtccagataaactgtcttgacagagaagtagcaaacgggaaacaggctgaggttggatgctagggagatgcctgggcaggatgtcacaacatggattaaaatggaggcagggcagggcagggccacaggccaagccaacacagcaggcctgtctgggctgcacacgtggtccagttggagggccatccacagcaacagcaggaaggggttgatcaggaggcatcatataagaactaggcggatggggcagtggctgattccacgtggaggggcctgctctgaggctgctggtgttcctttggtggtcagaacctggcatcccatagctgacttctataacccacgtgccatttgggcctcctgctccttggcttagtccctagttcgttaccatgggaacgtgaagctatccttaatatttctctaaattctggagtgtgtgtgtgactcggggagtttgtgttctcatgattacttccgcctcaaggttcgggcatctccagatgctacctctttttcacactgaattgactccttttcatttattttttgagttggagtcttgctctgtctcccaggctggagtgcagtggcgtgatctcagttcactgcaacctccgcctcccgggttgaagcagttctcctgtcttggtctcccgagtaggtggacttataggcgcccacaacgacgcctgacaaatctttgtatttttagtagagacggggtttcaccatattggccagactggtctcaaactcctgacctcaggtgatctgcctgcctcggcctcccaaagtcccgggagatgggattacaggtgtgagcccctacgcctggccaatgtaaaggaaattgagggggtacccagattcgaagcggggacctcttgatctgcagtcaaatgttctaccccgaattctaccccctctgctgactcttgtctcattttctatcaaaacctcatccatggctttggtggctcatgcctgtgtcccagcgctgtgagggccaaggcaagaggactgcttgaagctcagagtttgagactagactggacaacaaagtgagacccccaacagtacaaaaatatattatgcaatttccttggtgtggtggtgtgcacccgtagtcccagctacttaggaggctgaggcaggaagattgcttgagcacaggaggtcaagactgagtgagctgtgatggtgccactatactccagtctgggtggtagtgtgaaaccctgctgctaaaaaatgaaaaagccaaacaaacgaaacaaaacaaaccctacaaaacctgacccataacacaggtgagaatgtcctagactttcctgaagactggggaaggagtgatgggggaggggccacactgcacacatcacggaagggggacctctaaccctggttattcctgctgccaaggcagcctcatttcacagcttctccctgcttgagggcgaagctgtccaccttccttcccagccctccttcctttcgccctcctaagaaaacatacgtcatcttttctcccacaaaacagatggagcacttctttttggcgtgggttctggctaacatccgtgcactaagggtctcatctgttacttccaaatcctaccaagttgttttctcaagcaaagatgggactttttgaacactgacctcgcattaaattgtgtaaccttggaggttggactacatgtcgaaccaaacaggcaagaggaagtggtgaccgggcttgaggggtccctctctgtgatctccattccggtgtgctgtgaccccctttgcccatcacacggttgtgtggttgtgttttattccacccgctcctcgtgtgaagggggcactgtgttcactctatcaccttatccctggagcacccaccaaagtgccgtgaacagagtaggaattcaatcaatatttaccgaacgactagatgtgctcagcacggtgctaatggatgattagaaaagttaataatctcagctcttaaggagtttatagtctagtcaggaagccaaaaataacacagatgagaataattaagcctccaatctgatggcactgactgggggtgcatttatcaagaatttggaagcacgtaaccatacttacattctttgttgcatacatagcatttaaattgtgactctcatccaacttatcactcagatacatttttttctgtgttaaaaatataaagccatatttccagagatttttaaagggcccaaaagattatgaatttgatcttaacatcagcagatgacaatctagttttaacaagttactttgaattagtcaaatctaaaactcactttagatttgttttctggctaatattctaattgagagacatttccatggaggtattaggttaaaatactgtttttagatatgtgacacatttccctgtattttagaaatctcttgggtatcttaagagaaatttaatccatctgattttgatccaaatataatttactcacaatgatggagaaatatttgatatccacggaaatctattgatgcacttaaagtttttctccagggaaataagaaatcacattttttcaagggtgaatcataaacctacagtgtctaatttttctgcttatttaacaaaacctgagttaagtatcaaattgggcagttccagatcatttgtttttaagttttttagtcttttaaactatgcagaggaaattttattcaaagaggtttttttttccttattctgacagttttatctgctatcctgtttttttccctaaacagtgatttttgaagatttaaggtaataacacaattttgatgtctgtggattaatggcgtctgtattcacgatgtttcagacctgtcagagcttggaaatagcatttaaatgtattgcttaattttaattttaaaatactttctctgagaattagatcccagtcctaagtgagtactttgaatttcaaagaggggatttaggccaaggtacagctaaattttgtcctcttgaaagacctgaaatccatttacaaataaaattgaggtcttcgtatcaatattatgttttggaagtgaaatgtgcaaggacttgtgcagtgtcacatcttaagaggctgttgggtgccatcgggagtcgaggcagggcctggcatttcagcgaccctgctgctccacatgctggttatggagtactctccgacttgtccacgcttccaagttctgatttctggcctcctgaggatggtggttttcctagcgcttctctttcacagtaggttttgcatttctgacctgggccttagcctctttctttaaggtttgccttctggccagatccctgggcaggggcccagctcctgctttgcggccctctgctgcctgcagctaatgacagtgacccctgcccggctccactgactcataggatctgatgcttggatcgttgtaatagtcttctggtctcttcttcttttagttcatcaaacagatcttaaccatgtaaaccttcgtaaatattatttcatgtggggattggctcaattttagcgggtgggtatacaaactggagacagactacctgggtttagtcccaaccctgaaatttattactctatgatcttgggcaagttacatgaccttggtcaagctagttaaggtctctgtgccttagtttcctagggtgaaaaatggggttgatgataccctgatgagaggtaggtattattttatgaagattaaatgacacagaaggagaagcgtttagaacactgtgtggctatagtaagtgctaaataaaattagttattacatagattgccctatccttttagaattttctgttttagaattttagaatgtttttaatcttcagtacttgctatcgtcttttttaatagaaataagtctcgagtttagaggtagttataggctttgcgaattgagtaacattcttttattttttaaaaaatttattttttcagatgaagctggttcccctttatatttaatacaaaatttcctttaaaaatctaggttaaaaagaagtgagtttaaaacatatcaactaaatcataaataaatcgtactatggttttaaatatggcaaaaatcgtgaacacagtgctcaaatgcctgaagtttgaggaaaatctgtgaggggtgggtgcttcgggcctctggtaggtcttagctagcctggggctcttcctgccctcctgtgggcctctgttttagccagacagcccactgatgactgccacatcctgagcattcctgcctttgggtttgttcttgagaatacccaccctattccacgtttctgatttccactcatcctcatggccccatttgagatgaacatcatctgtaaggcctccccagtgcctggctccaggcctctcttcttcctccaaactttgtcgtgctcaagaaagtgcctattgtgtgtatttggcagtcatttcttgccacgtgatatctaataacttccatggatctgtcctgtttctgcaactggaagaagatgagcggaacctcttttaggtggggacagtgtcttagtcatctcaatagccccttgaaggcatgatacggtaccttggatggtttctatgttaatattttctgttatgtgtccatattgaggtatcatttatgtaccacaaaattcacctcttctaaagtagtggaatttgctttttaacaagtttgtacagttgtgaaaccatcaatgctgtccagttttagaacactgtcatcacccccaaaagttgtctcctgcctctttgcagtcagtctgctcacctgcctccagctaacaattgatctgctttctgtctccatagttatctttttaaagataaatttcatagaaaaggaatcatccaacatgtagtcttctctgtatgggcttttccacctagcatagtgttcctgtggttcttccatgttgttgcacttactagtaattgtttcattttattccttagtggcagcagatagaccttgctgctgggtgttcagattgtttccagttttgaggtattatgaataattcttccatgaatgtacaggtctttttgtgagcccatgtcttcatttctcatggatagattttggagtagaaataactggttcctatgatcagtgtaactttttaagaaactgctaaactgtttatcatgttatattcccagcagcaatgtatgaggattcatttctgtacatacttgccaacacttgatattgtctgtctttatcctaatagcctttctagtgggtgatgaggcatgaattgaagatgactcttgggttttcaggttgagcagttggatgctggtgctaccatttaatggaggttgagaaaggaatgaaggtttttgagaaaaagtcaagaattctggtttggccaagttgagtttgaggtgccagttagcctttgaagaagcaccgttaagtaggaagttggatgtatgagggcacctatgttaattccagctttgtgaattcattaaataatgaaacctgggatggttgcttgaaatttttctaccctatatatgaatctgatggtctggacaagtcacatagtttcggatgtcagtttcctcatccataaagtaatacctattttcctccaaagcttaggtgaggagtgaatgagttaaagagtgcaaagtgtttcttattgtggcggttgttattaatacgtgatttcacttttcatttatttcatttttatgtccattgtggcttctaacctcatatttcacacatagcaggtactcagtaaatacttaataaatcaatgaatgcaagtaatgactatgtatatactagtggagaaggaaggaggggagggaaaggagaggagaggcgaagagaggtgggccaggcagaggagagaagagagggagggagagggagagagagagggagagggagagggagagggagagagagaatgagaatgagaatgagaatggatataatttgggttggccttaggaaggagggctctcagaattccacactggagctttgtgtaaaggaagtttatcttctatgacaccagggaggcaacatggaagacatgattttgggagatgtttcaataataagaattgtcacgtgtaaagcatggttgtgtttgcaaagtgtcttatcttcctactagaccttaaacatcttgagggttggagcctttctgatgtgcctctatatttcccagagccttactaatttcagcatactataaatacaacaaatacctataaaatgagtatgttggtggatgactcatgaacaggttgtttccttcctgtgtccctgggagagcatgtctgtgcttctaccacagctcatgcatggcttgtgtttataatgatttgtttgcatgtctctctgtctgtcctgagctccatgatggcaggggctccatatcccttggctcatgcctggcaagtagtggttgttcagagagtgctggagagaattgttcgagtgaatggatgtgtctaacactgaaggaaagcagggaaaggagaccagatctgtgctctttggagtttcagattgtagctctaaggatctaaatttccagagggagagaaagtagggaaatggtccataactcatttgtcttccattttctgtcccgtgggctaggtaggtctgttcttgatatggttgggagagtggttgcctgtctcagtgttcaatgtcagatgacaatattagctcacattgtaaatattctgagagtgccataccctcaaggtttcttgttaggttatttcattagggagtgttttctaagattggcttaaagtaaaggattttaaactttttctaagagagacattttaaatttattttaattttcatgggttctccaaatgcagtagactttttggcaaaatctcaggtaaacctcatacatataaatcacagaaatggaagaattaggtaggtgcaaaagtaattgcggtttttgccattacttttaatggcaaatacttcagttaatgcaggggtgatctaggacctcacctgcttatcatttctttgtcctttgtcaaagccctgaagcatctgggggactttagggctccttggaaggaagtttgaaaaaccccaggtatagaggtagtctgttcattttgacttcctgtttcttctgccactctcaagagacttctgttaagtctgtagaaagacttccccatgctaccatctgtaaccaccaactacgggaaccctagttcactgttggtgggaatgtattttggtatagccattatggaaaacagcatgaaggttcctacagaagttaaaaatggaacttccatatgacccagtaattcctcttctgggaatatagctaaaggagatgaaatcattaccttgtaaagatgtctgcactccaatgtatgctgcagcattattgacaatagctaagatgtggaaactaagatgtctatcaagggaggaactggccaggcgtggtggctcacacctgtaatcccagcacttcgggaggctgaagcgggtggatcacttggggtcaggagttcgagaccagcccagccaacatggcgaaaccccatctctactaaacatacaaaaattagctgagtgtggtggctgcatgcttgcagtcccagctactctggaggctggggcgagagaatcgtttgaacctgggaggatgaggttgcagtgagctgagatcacaccactgtgctccagcctgggcaccagagtgagacttcatctcagaaaaaaaaagtctatcaagggaggaataaggaccatgtgatatatgtatacaatggaatactagccttaagaaagaagatcttgccatttgccacagcacggacggatctaaaggacgttatgctaagtgaaatgtgcagacacagagagagaaatattacataatctcacttatatgaaatatttttaaaaagatctcaaatattaatacacacgtagagaataaagcagtggtttccatgggttgcgggtggggagaggaattggggagatgtagatcaaaggataaataaaaacagatatattggacaaatgagagatctaatgtacatcatgactaaagttaataaaattgtattagggatttttgttaaataagtaaattttagctgcttttgtcccacacacacacacacacacacacagtaactctgaggtgatggatatgttagtctgcttcactgcagtaaccattttgccatctatatgcatcccgtatcatcacgttgtcaaactcaaaaatacacagtaaaatttatttttttaaaaagaacaaagccttaaaagaacaaaagaacaaacctaacaattgcctccttttgtatttccctttttgtgttcattttcacctcctctttgagcttgaatcaaaaggttttgaggccaccagtaaatcaggtaaacagtaaaaactggagggaaaatgcctcatatttgtgaatttgccattgcacattcccatggtcagtgtctgatgtggatatagaaagcagcatcttgtccaaggacatggctaggaggggaaaccacagcgggtagacgagaggtaggtgtttgtcttaggtcattttgtgttgctataaaggaatacttgaggctggataatttatacagaaaagaggtctttttccttcacagttctgcaggctgtataagaaatatggcattagcatctgctggcctccggtgaggacctttgtgctgcatcaaaacttggtgcagaaggtcaaaggagaagcgagcacctgcgaagaaggaccaaacccaaggggcgtcctggctttataacaacccactctcagggaacgaatctattcctttagaaacagtcccgtttcatgagagtgagagctcacttgatcccttgagaatggcaccaatccgttcatgtgggatatgcccccaggagccgaacaccttccacgaggcaccacctcccaacaccatcacagtgggtatcaaatttcaacatgagacttggtggggacaagcaaaccacatccaaaccacagcagcatgaaaggggatgagtcagatcttgggttactattgaaaagggctgtgtgtgcctgctgggattcatggtgcacatggagagcaaaatgagtcctgggaagcagagacttaatgcagcgggggctggctgttaaaattttgaattccctagggcctggcagtgtgagttggaagacaaaaatgactgggtgcctctgggagggcctagcagtccaggagagcagaagctctcagagccagaaccaacagagctggcagaagggagcgatgtttggatggaatcaggaatgctggagttggctgggatggaaccaagaagtcaaaacagtaaggcactagaattagctgggcagattcctgaagcagattcaggtggataagagtttagttaatgtatagtattgcctctgtttaagaggctataaaggatttttgtgagtttatcttgggttgtaacagccgtaaatactggagagatggactgcaacttttaaaaagttgatgtaattcacatgccataaaacttgtcattttattatgtacaatccagtggtttttcgtacattcactttgttgtgcagacatcaccattaaaccgtgaaaatgtttggttcactccaaaaggaaaccccatagtcattggcagtcacttccaattcttccctctgcccaggtcccagcaaccaataagctatgttctgtgtctgtggatttgcttcttctgaacctttcatatatatagaatcatacaatatgcggacttctgtgtctggctttttcatttagcatacttttttcaaaggcccatccatgccattgcatgcgtcagtgcttccttcctttgtattgctgagtaatattccaatgtgtagcccaacaacattgtatcagttcatcagctgctgaacatggggattgtttgcattttggattattatgaacaatgattctgtgggcatttatgtgtgcatttttgtcaaatccttttctgtgtagagatgatcgtgtgggttctgaacatggttctattaatatggtattttacattgattgagttttatatgttggactggtcttcttttcctaggataaatcccacttggtcatggcttataatcctttttatattttgctgtgttcagtctgctagtattttgctcagaattttttcatctatattcgtaacgatattggtctgtagtgctttaaatttttacttatgttcattattcacatttaaaaagtgacaaaaattgtatttatggtgtataacatatttgcaaatatgtatacattatagaatagctaaatcaagctaattatgtgcattgcctcacatattattttttgtgatgtcacatattgcagaatcttatttttaaaggccaaatagtattccgtttaccatatatattttcctcgtttatctgttgatggacacttaggctgatttcctgtcttggctattatgaataatgcggcagtgaacatgggagtacacattgtcttcagtatactgatttcattttctttggatatatgctcagaagtgagattgctggatcatatggtagttttttttttttttttgagttgaaattttgctcttatcacccaggctggagtgcaatggtgcgatcttggctcattgcaacctctgcctcccgggttcaagtgattctcgtgcctcagcatcccaagtagctgggattaaagatgcgtgccaccacaccccgctaatttttgtagttttagtagaggtgggattttgccatgttggccaggctggtctcgaactcttgtcctcaggcaatctgcttggcttggcctcccagagtgttgggattacaggtttgagccactgtgtccggccggtagttctatttttaatttttgaggaacctccatactgttttccataatggctgtattaattcatattcctttcaatggtgtagatggttcccttttctccacgttcttgtcaatacttgtttttgttgatctttttcataatagccattctaacaggtgtgagttaaagggtctgtagtagtactcttgcagtgtctttgctgatattctgtgtttgttttcctgttctttatttcatttatttccactctagtctttattatttcttcattatttaggagtgttatttaatttccatatatttgtgatttttcctttctttttttggtctgtattgagttctacttttattccattgtggttggaaaacacactttgacttaatcattttaaatttattgaggttcattttatagcctaacatattgcctgctggaggatgttccatatatccttaagtatgtacattctggccaggcacggtggctcacgcctgtaatcccagcagtttgggaggccgaggtgggcagatcacgaggtcaagagatcgagaccatcctggccaacatgtgtgaaaccccatctttactaaaaatataaaagttagctgggcatggtggcgcacgcctttagtcccagctacttgggaggctgaggcaggagaatcgcttgaatccaggaagtggaggttgcagtgaggtgagattgtgcctggtgacggagtgagattctgtctcaaaaaaaaaaaaaattctgctcttgttgggtagattgtttggtagatgtctgttggtactagttgatttatagtgttggtcaagttttctgtttccttgctgatcttttgtctagttgttctcacagttgtggaatgaaaggtattgaagtttccaactatcattgttgaattacccatttttcccttcaattattttagattttgctttgtgtattttggggctctgttcttatgtatgtttatattggttgtctcttcttgatgaattaaccctgttagcattataaaacgtccttctttatctttagtagcaagcgttttcttaaagtctgttttgcttgttagtataaccattctagctctcttggggtttctttttgcatggtatatatattttacatagttttactttgaacctttttatgtctttgagtataaagtgtgtcttttgtagacagcatatagttgaattttgttttaaaattttaatccgttctgccaatctatgtcttttaattggagtgtttaattcatttaagtttaatgcaattactgatgagataggatttacttatgctattgggctatattctacgtatctttgtcttttttgttcttctgttactaccttattttatgttaaatattttttcaagtaacattttaatttccttgccatttattttcctctatgtttttgagttatttgcttagtggttgccctggggattacagttaacatcttaatttataacaatctaattcagattaataccaatgtaataatatacaaaaactttgctcctatatagctctgttctattccttctttactcttattgtcacatgttacctcttcatagattgtgtgcttttcaacataggtttataacaacagttctatgcttttgtcatttacatcagatagaaaaaagagtacatttatcccattttaaatattttagaaatgcttaaggatatttaaaaaattaaactatgttacatttattttaaaatacatttatactatttgtaaaatattcacttctgcagttacctttatacttactcctatatttcttcattgatttgatttactgtctagtgtcttttcatttcagcttggtggaaaagttcctttatttcttgtagagcaggtctgctagtaatgaactctgtttttatttggaatgtcttaatgtctccttcattttcaaagaatagttttgctgacatagaattcttggttgacagttattttcctttcagctctttgactatgttatcccactgctttctggtctccatggttttcaatgagaaatcggctgttaatcttactgaggattccttgcacgtgatgagtcgcttctccaatgctgctttcaagattctctttagtctttggctattaacaggttattggttttgaattacaaattcactgttagtctgcccacgtttcatcatccctatttgaagggacagcatgggacacttttgtcagtgctttaattcaacacttgtgatatctctgtagcattttattgatctatcaactttatggttcagtaatatgtggttttgtctttcactgttatattacttaatagaatttcagattgatatttatgtgatccgttcccataacttatttacttaatagatttgttggacagctgtatatggaaggctgtatgcaagactttgagttttcttagataaatgacacatgatcctaattgtgaagatgacacatttgattggcagagcacacaaacttaactaattactatgcaattaggatgaaggtatctatgtgcataaacgtagtagtttggaagcaaagaataggaagtcactgattttcataagtggtaaatgagcaaactgaggagattagatagattagcaatttgagaccttgagttatctaaattagaacgtggcagaatcaaggactagaagtcacttttctgggttctttctatgaaacgatgattctagaatgtggctcttttctatgttcaagcatcataggtaaaaatgatttcttaaaccaggtaagtgtgtgaagcacagactggctattttgcttcaaaaggtgtttatgttaaaaataaaagcaaacagtacttatttatgcttattatattgtattaacatgaattaagtaaacaagtgactatgctggaacttgaggtgtcaaaatatgaaaagatacttgctgttattaaattgaccttagatgttttattttcctttttattgttatttgttttatcaaaagaactcttctcccctgtacatctgtagtaaaattttgaataggtacagtttgtattagagcctccttaaaaataaagttgcagatcaatcaaaactatattcattctccataggataaagcatgacatttctgggcatacggttttaattttaatctgcatgcctccgtttctattctcccatgagtctttgcggcaggacaaggaaaagcaagtcttataaaaagaaatacagtatgtggtgcttattaaagttacatacatctcttctcacaggagaaatttgatttattgcaggttgtgcatatgtcgcatatggacatttctagggaacagattccttattgctgagcagtgaatggcttctagtactccattattgctccgggaacatgttagtaataattatgaaaggtaggataccatgaaatctgtaaggtgatttggcagaagtcgatgctgttggtgccaggatttgggtaccgtaccacggtttcctgttttcaaatgtattaattgatccgcaaaggacatcttttggagacaagaattcagacagactggcacagcctggacctccgccaagactgctcggaaggttgccatactgggagcaaaagagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaacgtaagtttttagattttattttattttatttttagacatttatagacattaacttttcaaggagcctttctaagattttatgcagcccagccaggaagtcagagtaaaagttgttttatccatgtgtttaagaaaacgttttcttaaagcaacagcttttatttctgctgcttcatgctgtcctaaactacatcccccagcaattagtgacaacactgaagaccagaaaggcaagctgaagacaccagacttcgcttgaagggcaaacaagaaatgtgagcttggtcattatttttttgtgtgtctttgctctgaaccatttttgggaggtgggtggggaggtgtctatgtctaagagatgtatgcgattagtgaattctcattgtgagaaggaaatgatgaaaggtgatttttatgatgttggcagaaatggctgggaatggtagagaatagaaatttaaatcttttggagaagaagtggtgagctgtgtttgcaatacttggagaaaaatttcttatttttggttgattagattttataattaaacgattactgtagcctggctctctcaaaatgttttaagtagaaggaaaatttagaaagtttaccgattttctttttaatactacctggtgttttacttagatatatactttatatctaatttctgaacaatgaatctttcctattaggcctgattatgattggattgtgatagttctgttcttaaaaatcagcattattgtaggagaggttaactgtaaggcatgtgttactgtggatcaccctgattgtaagtattctgtttttaaagacagtttgacttgtaggattaagttatgacttcctataatcatgtattttctttttattttatatgccgaaagaatacaggaaaattgtatctattcacataagtactcatcattttgggcagtataaaagactgcccctggatctgtgcttttgtttggagtatgtaatcattgatttcttaatccttcgacaataaaaacctgtctatagctttccattattgcgcgccttaaatgattaattgtttcacatgttttttataaaattatagtgacacatcagcaatcctgaaaatggcatttaatatataaatatgattgaaaaatatatgaaatctaacagaggtgtttgaacagttaagcttaagtatgttcttcaactttttaattaatcaacattttgattttctgtaaaatgaaatcacttaacatttatgtgtgttgccaaaatgacaacctttgtttaataagctcctttatacactacgtcgctgatactcctaaaatggacgccaagacatgaaagacatgctgataggcactcggaaggaaatgtttgcctgactgcagtcttcctttttgaattgattacaggatcattcatgcttatactaaaaaacaacaatatatgaaacaaaaagaaagttcagcaaacaagtttaaattgagcttcattttaatactgaccgtcttattgccgatttatatttacttccatttacttcttaaacatttaacataacttcttgccatttaggtttgctaaatatataacttatttaatttttaagtccattttttcttgaagttaaaataatttttgctagctgatttcttaacttctttgcagcgaactcagaacaaacttatatccaaactatttcatgtccaattattttccagcagtatgatcaaaagtaggtgaattaaaaaacaaatatgtcagaatataccttaagaaatattaaatttttcgatactggtaaaactacattttacagtgtatattaaacttaaaatttgataaatactagctattatagtcactgaagtttcttaccaatagaaattctctctggcctacacattacatagcttaaaatgaaagaaaatctcccataaagatgttccttgtaaaacgggtataatagacacgtctttgtgcaagctttttttaaaaaaaagtgtgattaagaagttgcgttgattacatttttttaaaaagacatttagttgtaacataatgcatgcttctttatttttagaccttttgtactacaaacacattgacatttaggttattaactatttccatattagtatttcaaatcttattttaaagtatataaatactattggtttgattgtaaatgaaccctatctcacctcataattatggtcgtttgaattgtataatattttgaagtaaaattattgaggcagaaatgcgttaatatttaactgctacttgatacctattattaaattccattttgatgtatgtacctgaacatacaagcacattattctacaaattaatgcgaacttctcaggaagcgttagtccagtattttataattactcgctcatttattcatttattcaacaaatgtttattgagcactcacttaaatatgctaatattttattgataaagttattttgggtaacggggatggaagagggaatagatttaaaataaaatttaaacgcctagatagaaaaaggcagtactataatgagattaatttcaacaaagtatgttcacttttcttgcacaatacacatattgtagagtgtgattataaaaaatcaggagattagttgtattacacgtagctgtaagaatcttgttttatgactattttggttgttacattttattggccagaaaacttgagttgttcaagtcttctgacagacatgtaaaataagcaattcaaatcagggaggaagaaactgagaatgagccactgctcacatgctagatcttacatatgtcaaagcaggtgtaattgaaccttcgaagacgtggctgcaacgtaaacaacagtggcctgtttatgtgggatttttttctttcctttgttttctgttgtgagacaaaggaggaagataaggcccctcccacatcctgaggccagcatggccctttgaaagaaggtttgctagggggtgtggtatattttaaatggacctatcagttcactttctatattctagtggttcgtgtgtgtgtatgtttgtgagtgagagagagagagagtgcatttaactcagtggcctaagtttattccatgcagttgttctctgatacaaaaagaaggcataggttcatctttgaagaggagataaaagtcacgtgatctgaggagatgtacttgtaggctgctttggtggcccaggcgtgaggcagagctggtggcccatggaatggagatgaggagtgtctcagccgtgggtatacactgctgaggtcattcagcagatactcccagaggacttgctctgtgccaggcaaaagatataattgctgcccataggaattcctagtgtagttgggtagaggagaggataggaataattgatgaatgtaggtaccttttcaggttaccaaataccttcgcctgttattccatgtaatccaagcagccatgctgggcgcagggactggtacacaatggccacttaataagtattcatggaagaaataaactgagtggcgaaccagagtattagcttgttgagtcttatttgactaagagagtgttttttccttcatggatagaaaaacaaaaagtactgtgctttctttatcttgtttctctgttgctggctatgggtttagaggggtgcagcagagggccacattatttgtgaccacattaggctctcttgcggtggccattggagatgatatgaaacaaggacttgcctggtgtggggtggccctggacaccggctttctctctggccagccctctgttgtcttgcattccctctgtcctcattttcccaaagcatcccatattgtactttaggacttggtggtgtggcctgagcatgcagcaggccagtggagtgcccagtgagtttaaagtgtttcttttgagggcaggacaaaggcagaggggatggagacagagaaggtggtgagggcagttgtgcagagttgagggcgctgcccagcaagcagcttcagtcctgttgtagctgcagcactaggggcctttgagggagcaagggtgaatgtgggatcctgggttagactgcaatatcagcaaccgcaggcgttgagagggcataaggtgttattgaggggctgcatggggggatgtaaatgggttgctgaggccagttcatgttgaacatcgtctttctgggtctttgtcctgggaggttttgaggcccaggagagggagaggcagagtcaggagcattgtgtatagttctgtgtccaaggcggtgaggggctggaatttagcctcagctttgctgcccaagccctgtgccttgatctgctgcaggaaggtaccaagtccccattgtgcttgtggaggtcctggggtgcatacaggcttggaactggaatagcaggtattgggagaaggtcaaaggtctgtggccagggagggcagtgttccagtatctgaccatggagtctagggggctaggggatgtgatcagaagtgttctagagaacatggtgaaacaggggaggatgagtaagtagaaatttagatcaagtgaaagaaaaggttttgagagtactggagttaggagtttattctgaaactcatcagattctgaataattgtaccacctctgcaaagctcgacttaaaagtttggccgtgagttgtgctcaggttattttatttctccaaaagcaagcagaaagtgaaaaatgttacctgtgtgtgttctgtattgcacgttatcagaggagatgcacattttcttctcttacagttaagaatctctcagtcttacacaattagaataccccttatgtgtggatctggaggttttgtgcaaaatactgaagaattagtccctctggagtgatgccattcttttatccttgtctatcaatgtcatttatatctcttttcctattagcccttctaagttattgtacctcatctgaaaagatcaaattgttctcaaagacccaggagtgtttcaccttagctgtattcatgggaaatctgcctttgaaacaaatagtcctttaccgtcttgggttagagataatgttcctcagcatctccccaaactgagtttgaattttgactcaattttttggttgtgggactttggccaagttatgtaaacctaatttcttcatctgcagaacagggatcatggtatttccctcacacgattttgggaggagaaataaggaaatacatgcagagctcttagcatagtgtctggtatgtagtaaatacttaataaatggtagatattatttatgttttacaaaattatttttttaatttttagaaattgtgataaaatatgcataacatattttaccgtcttaaccatttttaagtggtatcaggtacattcacattgttatgctgccattaccgtcatcaagccacagaagtcttttcatcttgcaaaaccaaaattctgtacccataaacaataactttctattcttcccttccccaaaccccgcaacagaatcgtggcaaccttgattctgttttctgtctctatgaatttgactacttcaggtacctcatataagtggaatcatacagtgtttgtccttttgtgactggcttctttcacttagcataatgtcctcaggattcatacatgttttagcatgtgtcagaatttccttcttttatgaggctgaataatactctattgtatggacagaccacattttctttctccattcatctgccagtggaaacttgggttgcttctaccttttggctgttgtgaataatggtgctatgaacatgagtgcacagatatctctttgagctcctgtttccagttcttttgagtatatccccaaaagtggaattctgggttgacaatttcttttttttcagcgcaacttcagttgtactcccttcttttgcctttgtgttttctgatgagaaatctgctgtcatttgaattgttttgcccttcagctaagatgtcctttttctctcactactttcaaaatcttgctgtgtccttagttttcaaggaatgtgttatgttgtgcctttttgtggatttctttgggtgtatcctgtttggggctcattcaccttcttgaatatgtaggtttatgtcttttgctaaattgggaaagttgtcaggcattatttctttgaatacttccccaggtgtgccctctttctcctttccttccaagacttggaggatgtgaatattaaaactttgttatagttctaccagtgcttgatactgattattttttaagtctattttctctttactattcagattgcataatttctattgttcttaccttcagattcacctattcttttctctgtcatcttcattctgctgtttagctcactgggtgagttttaatttcggttattttatctgctatgtctttactgagactttctgtttttaaaatttgtttcatgcccatttttagttgtttgtggaaacatgtttataatggctactttcaaatccttgtcagataattccaacatctgtgccatctcaatgttggcatctcttgactgtgttttctcgtttaaattgaggttttcctggttcttggtatgataaatgattttgattatatccaggcatgttgggtactatgctatgagactggattttatttaagccttctgtgttaacaaaccttctctgacactgtgctagcaggggaaaggggggcactccctcatttctgtgaggtgggggagtaggagggtaccttattattggtaggtgagggtgaaattcaggctacccatagttgatactgttatttttattgttagttttgtactgggtgcagtaacctggacagtgtctcagctctgtattccttaaatttagcttatgttgttggtgctacttgtgtttgataacttgtttaatgatagttacattctcaaattagggactgagccttctttaatcactagctacccagagattagtatgtgtttaccactagcacattgaataaaagaatataagagatgacattgtagtttctactttattaatttagaaaaattatttttaaaaggagagaatacgctacctgggtaagatttccatttttttggttattaacatgcgaggttttatcagacttttgcaacttatttttagaagaggtcagtatattaaaaatagtcagaagaaacagatttgactgaaggctttaaaaatgtcagtgataaagtattctgtttcatttgtgaattcaaacctgtagcttcaggacagatcttaaagatgatgcatgtaactttggaataatatattgtcagggttcttacgggtcatctgtgctgtagcattgacagtgagatcccagttttgcatcacttactaactggataatcttgggaaaatctccaaaactctaaaggttgacttttcctataagtgaagtggctgtcataataccaatatcaaagggttgttcagaatattaagtgagataatgtgcctgaaagcaatttagctgataggtatcataaacatgggagacaattatctagttagtttctccagacacatgaggatgatggataaagataatgtacctaattctgtatgcttttcagctgtttattccaatagactgttttatatatatatatatttaaaatgctttaaaattgtgtaaatatcgaagaccttcaaatagatagcaaagtattaaataaagtagaatgaatacccatatacccattattcagaagtgacaaatgccatatttattttcctcagatgttaaaaaaaaaaattaaggatataactaaagccttactctctctcacgtctgaaattggtgtagaacactttcatgcacatttttctggaattacagcgtatacatgtagccataaacaatatattttacatgtttaaaaactttgataaaatattttaaactgttgctatccttttgcaaatgaaattagatatttctgagcgttatctctattgctaatgtgggtatgaggctgtagagtgtctcattttagcgtagccattcttctgtggatgggcgtttagggatctgctttgtgctacccatgctgtcatgaccctcctacacatctgggtgatctctagaggaggacttagaaatggagcccagtttctgaatatttcagctttactcagtaatgccacgccattctcccaagtatttgtaatgtgaacccaaaagtatctgagacaggtctcaatcaatttagaaagtttattttgccaaggttaaggatgcatctgtgacacagcctcaggaggtcctgacatgtgcccagggtgatgggggtacagcttggttttataccttttagggagacgtaaaacacatcattcaatacctgtaagatgtacactggtttgatctggaagggcaggacaacttgaatcaggggcttctaggtcataggtagatataaaaattttgattggcgactggttgaaagaattatcctcaataagaaggaatggctgggttatgctaaggggttgtggagaccaaggttttatcatgcagttgaagcctcctggtagcaggtttcagagagaatagattgtaaatgtttcttatcagacttaaggtctgtgttgatattaatgctggcctgcttttcctgaattccaaaagggagacggatataatgaggcatgtccaaccccccttcacatcatagcctgaactgggttttcaggttgactttggaatgcccttggccaagaggagaggtccattcagatggttgagaggggcttagaattttatttttggtttccagtacccatttatattcctgtgctagagtatcaatgttcttgtctcactgtatcttcaccaacagttggtagtaccagactttaaaattcttgtcaatctcatgggcaaggaatattttgctgttacgtttattggtatagctgattacttagtgagattgaacatcttttaatattggtaatttagatttccttttctgtgcattctgtattcatatgctttgcacagtattcttttgagttgttttattcttgctaatttgtatcatattaactaatcctttgttatgctcatcgaagataccttctcaatctttttttttctcattttccttatggcaactttggaaattaactatggaatatgtttgaaaaattggaatgttttcatttttcattttcagaagtgattttagtaataatacatgcttacaatccatgctttccgatgaggcagagagggctaatgggactaatttcttagaatgcatcagaattttatctccttaattaacatctagaggaaaaagtttctcattttccatgtaaacttttggtcaacttgaaatgtcaggcagattcttagtccccaggcatccatcattgaattaaagagtattgtggagttttactctattatttgcagggactgctatagcacaccgataatgtaggcacattcccattgcatctgcaatgttaccaaataggagttctagggcccttagaaagaatgttctgttgatctgattatagtgctttctatacagtgaataatctcggtgcaataagcactttctccttcccctaaccagtagtcttgctaacaaaataacttaattgagaaatgcacactgttggggcaagtggattgagttgtggctgaggctccttgtgtatcttttgttgtgcaatcaagtagcacttattcaccgactttgctcatgctgtcccgtctaaacaaaacccacctaatcttccaaatcactttgcaaaacaaaagaacacacagaagatatagaaaccaggaggaccaggcggctgtggagtattttaggcagcactccctctttccctgctagtaaccatgtatatgaaattgctttagtaattatacatctgttttaaaattggaatcggaaaggatactctttccacaatcctataggaaccctccttggttgttcaaacatttggcaccactgcgtgtctgctgatggtttgccacagtcataggtgaggttctgggcagatattaacagctgagggaagagtgggcttgcaaacccaaacgtggaagtcagaccttgaggtatggttctcacagacttgactttcttaaggacagtggccatacgctttgctcagtcaattccagttggccttattgtactcgtttgccatttactgcagggagtgagcctcccttcagcatataggaaccagtgaaatgtcctctcattggctagctttgatatttccttctttctccacttactgaattcttacctggaatcagcatttggctccagtcaccgtctctgcaccattcctctactgtttaaaagttttaaggaaaacttcaataaagagtatatgaaaataatgactgttgtttaattacaaaccctgttttctctaggttatctaagtcagtgcaactctgtgagagagactggcagacacacacaccacacacgtttcaggtgaggaaatagaggcccagagaagtgaagtgcctgggcttgttagtagcaatgctagagtttaaatcaagtcctctgcttccagatttgttgtgcttcttgtgatttcacatttgttcactctgtcatgggaccaccaggagaatatagtaagttggtgcttttatggtagcctctccatacacccttgggaatgtgtccttaggtcattccttctgtctgctacccacccacctacctacccactcacacacccacccacctaactacccacgcacctacccacctaccccttccctccacccgcctacccctctacccacctacccattcacctaccccatctatccaccttcccacccacctacgcaaccatctaccccatccgtccatccatgcagctgtcagcccattattcatttagtctctgagtccctcagtgctgagtgatgaggccacatcatggatagaacacagataaccgctgccatcacccagctgatgatacagtggtgaaggactacagatcagtaaatgtggccaagcgcagtgactgttaggagaggagaaaggatcctgcttttcctcaccttcttgtccctctgcaactcagagggagaatcaaaattcacattttttagagaacatggatctttcagaatatgagagtttcatgagtgtttttttttttaatttaacacttaagtatagcactctgaaaaataaacactctagagttttagtgtcttagaggtcatttagtttgcctccttgtaaccaaaccgatgaaaatctccttttctgacctcctgagaaatagatgctagaatctctgggcagcagtccttgtggtactcgtactcagtgcctagcaaagaggtccataatgagatattctgtgcgtctctgactcagaacattcctgtttcatcttccacctggattccttctaatgcttttcaataacagatcagtgtagttgagttttgtttagctatttctgtatgtaagcatttttaaaaaaggaaaaagaagcaaaagaaaaccacaaaaacccaacatgctgtttaaataaagaaaaatgagttttacttccaagagagctttcgtcattttcttaatgcttattctccttctgagagcttgttatggaacagagtgtgacagtagtttaccgtggtgagcctgtcttgtccgggccaggggatgaattagagcactgaaaaaggccagaggagtgggcagaactgtacctaaattatccccggatattgctaagtgattctactttttaaagacctccagagagagcatccctaatctcctttagtttgcctttacagtgtttaatgacctttgctgtcaggaaattcttcctcatatttaacccagctgtcccttcccaccaatcactcccatttcttttgttgtccttggtggtgacagaatataggggtcgttgtcttcttgataatatacttaatgttcctgaagggtatgagggaggcctcccttagcccagacttctgcaagtgagagaaatataaattttttctcctttacacccccgttctcagtggttctatttggacatataatctctgacgtttgttcttaagtctctgttgcaaacattcacatcaggccttcctggagatacccattggttccattttcactcacagggcaagatcctttcatgatttccctggctgttgattcattcacattaactcctgtttgttgagccctcattaggtgggaggtaccaccctagtggctgatgggatgtgaagaggagtgactcccactgacttgcacctagaaggaggagcctgaatgtcacctgccagttacagtccttgcgatagtctgtggattagaactgctggttcctctcttccacaaagacttttttttcctgatttatattttggtacatttagagtttacattgaccccatcctcagaaagttaaggcactgtcatattattcatgccctcttctcttgattcattttataaacaccccgaggaagtttgcacgtagaaactttggcctgtgagcaattggcgaggctgtttcccattagattctgtgcagtcctcacgagggggtgtgatggatctttgcaggtctctagcacttatcagaaatgcctggcacgttttaaacaaactaatgactggtggttggttgtcaaatgagttgttgggaaattttttttttttagttctctgtctctccactccttttacctcaacataaaagcagcccagagcttctgcctggctgccaatgtaggcagccctcccacctcagctgccaagctcttagcagatgaaataaaagtctatttataactggcctctgatggatttcctccctacctgggctagtgctccatcagcaggtgtactgaacagatggagaagggttttaagtttttcagttcaattagatcaactctctaggttctggccagcgcattccctttctcacttagtttcttcctcttggcattaaaattgttgagcatagcaaaacacaaattaagtccaggagataaaatgcatatagtgcctgcctttaaaaaaagcactttggctcaggaaccatatttgacatcatatgctaaatctgttttaacccttttttacctagtgcttaattttaatgtgttttaaatcaatattagagtactaagatgctaaagagcacaaatgctttctttttttacttttcttttcttttcttttttttttttatttggagatggggtcttactctgtcacccaggctggagtgcagagatgcagtcttggctcactgcaacctccatctcccgggctcaaacgatccttccacctcagcctcccaattagctggggcaacaggcacgcacctaccacactcagctaattatttgtatttttggtagagacggttttaccatgttgcccaggctggtctcgaattcctgaactcaagtgatctacccatcttggcctcccaaagtgctggaattataggtgtacgccactgtgcccagtcttttttcttatgatgtatttttagcattggaatttaagtgttttgaaactatatcacactgtttttgaagaaactttatttctgatagtagtttagtttatatgatgaagcattttaatgaggagatgaagtcattcatttcatgatggttgtttgatgtctttttttcacagtttgttgaactgttcaggacagtgatcaagtgataccacgcagtggtccaaaaccagtctgaatatggccttaggctctgggttttaacaccgctagtctgtgaaagatcagttgccacagtttttggtttccacatatgtaaagattcgtcataattagcaagttcacccttagtaggctgtatcacctcttgttccccacatcccagatttcagtccgtccttggctctcggatgggaggccactctgattgcagccacagttcatgccccacacagacattcactgagcctctgcccagcgttctgacacagacttccacaaggcccacatctggattctttgtccacgctaacaccatcacatttaattaattaatatctttgtgaagctgggtttgaaacaagaaaggtttggactgtttcagtggatgttttgttcatataactggagcaggttttctttggtggttttattttgccccattctttattatttctggatattttcaagagtgtggattatccagatttgtggcttgttctccagcctccctcccattttgttacccactaagatgcatatcatggttgtcaggggccaaaggagactccactgagtcagcctcactgctggctggaagtggggtgcatgatttaagttaggagaaacagtgcaaacaagaccaccgcttcctatttgtgtcattgtctggcaagtgcctttgaagattttctttcattgttttctgtactttttcacagactctcatatttggaggatgagttaaatattacctagaaaatcacttctctgatccttcatctccttggcaggatctgtgtcaaatgtcttgattttcacagtagtgatcgcgctttctcccaggctggctgacctgtgctgtctttggtaagttattctgttgagttgtggtgctgcgatctttctatccattactttcatctgtggcttctcctttaaccttttggggtcatacagcacaaaatctaatttcgacacgtggcagcctttcacatatttcaaaaatgacccttctgtattccaccaatcagacaggacatggttcagttacatggtttttctcctaaccatctccagtctagcaatttctttattgtggagtgggatgcaaaaaggaaagtcacatttttatgtaggttctgtctgacaagtgtggaaccattactgacctagttggaggtcaaggaagtgtcagaacttcctgtgtgcttgatttgaccaagtgtagcatcttagtctcccagtaggacaaaagggtttccgtgttatccagggacggggtggatcaactttgatcatttggacctggctttggtcatttcttggtacccattacatggctgggtgatggcagtccatgaatgtgtggagaatgatgtcaaacagggtgctggatgacaagttcgggtctccagagcacttatgtggtctgtgaacataaatcattccattcagtcaaacctccacccttgccccctccctcattgagatgctacaccactgcgtcttctctctcttggggccacttattcttgtcttgtttgtgaaagccaaaacaataggatgctaggttcttgaggcagataaaatagattcccaggttaactccatttatgatttgtcgatcttttcccttcttcactcctgcagtaagggaattatcatagggagggaccatcagacaggcctttttggggactttttcttatatagcgttaacacatttatttccaagtggtttaaaggcaaaatatatgaatgcctaggtattttgagatctttcagaaaatagaaggaatgggaatgttcttgttcatgttattgggctagtattgcatgagaagagcagtcaaaagcctaaaggaaatattagcagattgaatatcagtttttagagagaacttcttttggttcacctgggtagctggtagcatgctatgtgctgtgagatggtcacacacgctgtctcatgtaggtctcacacaactgccctgtgaggcttacattctgtcattaacggaggaggatggtgacactcaagtggggaccagctggtccttgcagcagctgaggtcataggcgcttcttcctgatgttgggtttttgtggctgctcttggtgagatttatttaccagaagtttgtcttctttatttttctttttaagactcagttttttttttgacttagttttaaattccatttgttaatcctaatagatagtctttgttctctaattttgtagtcacctctgacacccaagtcccagcttttatccacagtcctgcgctgtctccttattttaaaagagcaactcaccacaatcacgtagggtttattccagaaacaaaagaatagttcttaggaaagctagtagtgtaatacagtctattaattcattagaaaagagactgaccatcttgatagatatgcaaaagccatttggtttgattcaacacctactttttcttaaaaataaagaaataaaagctgttggtaaatgagatatagaaggctacctctctcacataatagagaatttctaggaaaagctgttaacattcttactaaagtcacggccagttaaaaatgcctgccacagtcacagttcttcaaccttgttttggaaattgtagctaatgccattaaacaatataaagaaataagaaatacaaatactggaaaaaggcaagagtcattatggtcagatgctgtgattacatggaatactcatgaaaggatatttcttgagcacctactatgtgctaagctccctgtcttgtaaaacttatattagggaagacattcaattaaatatgcaactctaatgtagtgatataaattccacgacagagaaaaacacagagacctatgggaacatgatagccatggctttctgagccctgcaggggtggggttggagaagtttttctctttctcaaacttgtcaagctcatggtgacctcaaggcccattgctgcagccattccttgtctgaagagctctcacccttgaacttttatggctgccttctttgactcagggggtctgggctcagttgtctccttttcaggagaggtcattcctgaccaccccgtctaacatggctccttacccctgctggtccataacagtgtcacccctgcagtgacttctgttggctccttgcatattctctgtctgcagctccatcacctcacaggtatcctccaagagcgtagggcttgtcagtcttgttcatggttttatcctcagggtagagaactgtgtcttccccctgtaggtgctcactaaataatttgttgagtgaatgtgctggaagacaggaggtggagacaggatatggtgcttataggctgccccttcaggaggaagcagagggtggagccctacctgggctggggaggcatggctttggtgaagacaggtcttcttttttttttttttttttttttttttttttggaggtgtgtgtttaaatgctgagcgaaaagttgatttgggagatctaaaagaagggggaagggaggatctatggcagactgggataaagggcacaggggttagcctgaaagaggaggggaaacagcttttacctgtaatgggagggtaggaggaggggattgtgcagaactgacgttcataggtttggtgatgggatgttggggaagttttcttctttgaatgatgctattgttgacagtgagaagtggtgggcttggagatttgaataaagtaggtaataaaatgggtactggccattaagaaagagaatgagacagagcagactgagaaatgtgggaggctggttgggtacccagttaaaggtggaagactgttaatttatggtgacaccaatctgtgagttcaggagattgtgcattgaagccttaagcagcccaggtatttgcatgtttttttttttaaaaaaaaagattattaattgtttagtgagatctaattcacatactgtagagttctccattttataattatacaattcagtggttattagtatattcacaaaattgtgtggccatcaccactgtctaattacagaacatttttattatccccaaaagaaactccataccctttagcactcactcctcattctcctcttccccctgtccttggcaattactagttcactttttgtctatggatttgtctattctggacctttcacgtaaatagaatcatgtaataggtggtgctggtcattagcatctggcttcttttgcttagcatggtgttcatggttcatctatgttgcagcatgtatcagtattccattccttttatggctgaataataatccattttattgacataccatattttgacattttatttatccatcatcagttggtggacatttgggttctttttactgttgggttgtttttagtatttggctatctcgaataatgttgctgtgaacattggcggacaagttcttgtgtgaatatatgttttcaattatctgggggccagacgtaagagtggaatttttgggccatttggcaacctatgtttaactttttgaagaatgtccaaactgtttttcacaatagctgcatcattttactttgctaccagtaatgtatgagcattccagtttctctacatccttgccaacacttgttattattattttttaaatgacagccatgctaacgggtgtgaagtggtatctcattccaagtgtgtgcatattgaagatgcacttagattgatccacagttgggattttgctagaaggctctatggaaaaagagaggtcttacgtagctgaggatggtggcaagtggataattgaagtgacgggtcagggattgaattaaagaaatttgcaggaccaaggaaagcaaaccacaaaaatttactaaagggaagaaaggaagccttaaattaatgaaagactcaatattgtaaagatgtcaattctcttaaaatctcatatgtaaatgtaatataattctagcagaaatcccagtgaaaaatttgtgaaggatttgctaaaatgatgattaagttcaactggaatgtttaaatgcatgaaaacactcaagatatatttgggggaaaaacaataacaatgatagggacttatttaccagatattaaaacatactataaaattagttattaaacagtgtagttttaggaatggaataaaccagtggattgctggaacaaaagagaagtcccaggttaacatgaacatgtattatagagatgacattgcctcgtcagaagtgaaaggataatttcataaatggctttgggcaactggcttactatgtcaaaaatgtaaagttatatccctgtctcacatcagctgacagcacaataaatttgaagttaaatatttgtgaagaaaaatatattcatagaacactagaagagtaactgcggtcatggggttagattttgtggaatggaagagagaccagcctcacagcgaagaggccattgaagacttggacagagctggctgtgatgcagccacagccaggaacagtaagaatggcaggggccactagaagctggaggaggcaaggaaagatcctttcctagcaccttcagagggagcagggcccctccagcacctcgatgtttggacttctggcctccagaactacgagaaaatcaatttctgtgtctaagacccagatttgtggtaatttgttgccacacggccctagggaacaatgcagtgactctcagacaggatttgatggagagagtggtcagaaccagtggcgctttctaaaagattgatgccatgagctgtgtttgtctagtctgggcagacaagagatttccattcatgattaaggagggcccacggatctgcgtgatgaatttgaggaggatacactggtcccgcagggcaaggacgtcatcttagtcactgctgtatccccagcgttaagaagagttagaagaggacacagtccacactcaatgactgtttaatgaattaattaataaatagaaaacacacaaaaatgtaaacactatccatttttaaaacaagatactaatttttgaataaaaccaggttgtggtggggaccatagggccagaatagttgccgtccccttcacctcccacttgattcacgcatggtggctcgaggggacagagatgtgagatcgtggctggaaccactgctctgagttggagctgctgaaatggtagcttggcggtctgccctcatggtgcatggcttgaagctacatgtcaaaggaaagcaccatccttgcaaccaatgacactaaaactcaagttagattatggcaagcttgtccaacccgtgggccacatgtggcccaggatgccgttgagtgcatcctaacccatattcataaacttttttaaaacattgattttttttaaattttaagctcattagctatcgttagtgtattttatatgtggcccaaggcagttcttcttccaatatggcgcagagaagcccaaagattggacaccccctggactatagtattaatgcatcacatagttcattcttttcacatagtgagtaaaaagtaattcgtttgataagcaattcttgagcacctcctgtatgctgaacgccatgctacgctctgcggtacagagaacaaagaggtggtccttgcccttgaggcttctacagattgttgtaggctggtagccatctagataagtagacaaatcacttggatatcgtgtgataacatacatgccatcgatagacacctaggatgctgcaggagcacggagcagggtctgccaacacactgggcattgtagattttacatatgatggagttttgagattacaggctcatgcctgtaatctcagcactttgggaggctgaggcaggcggatcacctgaggttgggagtgtgagaccagcctgaccaacatgaagaagccccgtctctactaaaaatacaaaagtagtcgggcgtggtggcagatgcctgtaatcccagctacttgggaggcgaggcaggagaatcgcttgaacctgggaagtggaggttgcggtgagccaagattgcgccattgcactctagcctgggcaacaagagcgaaactccaagatggagttttatttgggccatattgaggcagaggctcaaatgtaggtgaaatggttggttaactgtatggaataatgtgaagggagctgaaaatccatctgcccagagcaactatgcaggagcatgcctgaaatggcagctcatatttcttggcctcatgctttctaggagtcctctcctaaaacagagacgcctctgtcagattcctagagttcttctaagtaggcatgcctactttgttgagttcctaggtttgatttttgagggaagagaagtcacaaaggatggaacatgggatgggggaggagagaggttggagcagagcactgggcatttagggaaaagaatcgtgaagggaaaattcctagaaggggcaacaaacacagcctcaaaaatccacagctcttccctagactgggtctgccaggtgccctgatccagctctctggtcagccgcattctgcatagaaaggggagcagggctggtcttgtccccatggaagtgtgaacttggggctcgtcttttgggagcagagaaaaatagttccttgatatacatgtaagtttctatgtggggtattagaatgaatcctagctgttgggagcatgtcttttacaaatcaaattaagtatcttttatatatagatatagatagtctgtaatttgatggtactgatgagagtgaaaacaatatgtggacttgcccatttactgaaagatcaagcaaatacatttcagggtctttttgatagctgtgagtattacttgctagtattaaaatattttaattttcaagaacttggactctgtttcctttgatgaaccagttaggaaatattgtcagagaaaccctaaatttactctcattttcagtcatgaatgaatccctgattactgtgatgaagaaaaatcctgggtcccaacttccttgcccaaatcaacacaaatgtaacctttcatcttgatcaggagatgctgaaggtagaacataaacaaaaacataagaaaccgttcatcactctgagagaggtttaattttcatcagtcaggaaagatacagacaccaaatcaaaggtgttgataggatttcactgtaaggttttggcgattttcttttccctgggtgttaattctccccttgggctgatggtggttggcagagctggagcattcaccgtggcttttctgattcctctttcccatgttggagtaatgtttttagttcattgcccaaatagccttggcagctataatcagtcactggagtatatccttgattgtaggagagacttgataataatgactctttcattcatttattccacaaacataggctgagtgttagctgcgtgcagtgaaccatgggaagtgctatggggaagcacagctatgtaaatcatggctccaactatgtgcaaaggccccatgacataaataagcacagaagatgtgtctgtacctctgtatctgctttataacctccctgaggaaatgctacaggcctgatccatctctcccctctttaaagactgtcaggggctctctatttcccccaccatagagtccaaactcgagcctagtacccaacattcttcagaacctgaccccaagccatctgggtgtcctcatctcccaccgctccgcccacaccctgggctccagcatttgactcttccccagtgtgccgtgtgctccttaccgctgcccctggccttggcactttctgttctctcctctgaggacgcctggcctcatcttcaacagctggtggacttctacacgtccctcaaaaccagctcctctgttacctccaatgtggcactcttttctaagctaccccaattcccacccaaggcagaatttgtctctaggcttgtgctagaacatgtaggatacaggggttctttgggaagaggacattgggaaggcatatgggaatgtggaatatgggaaggcaacaattcttggctttcctggtccagcccgggctggtctggtcccctccagatgatctcagcgttcatgaaggcaggttctggagacttaggaggagggacccctcccctgccttccctgggacgtggaatcccctgtgagcaggatggatctagggtatgtcttttagccttctgtatatctgcatagacttttcttctgccttctcatagttcatagcttgtgtctacacaagaactctctaaacatgtgatagcgaattaaagccattaactccattatctgggatattgtttcaggtatattttaatattgctgtataatttgtccataaaatgcttatcttcataatgaaatatgaatgggtctttgtccgacagaagacttttgttgaataagatgatggcagaacgctgtaggatcctgctatttgaatcttcttggagtcacattccttagcatctagaggaggtaacagaggacatgtggacgtgctttctgctggcgattaagtcccaggcttgggagtggcttgtagcaggctgatgattgaagtctggagtgattctagcacagaaaagcaaccagggcgcaaggtatttctgtgtgtatttggttcgctgatcagcacttgggttaccaagatgattaaagcacagccttgccctttgggagagaaaaccattcaaagaaatgctgtgacaaaagacacaagcattgagtgatcaagtacagcatgtgcatgattattggagagcaccaggttgtcagtgaagacagtcgtaagggaggagagatgaggtggtgggggagacgtcttataatcgagtagagtactgagaacaatgctggggttatctctctggtgtacaaagggactaccttggtcagggtcctggcagaaatgtacctaagagggataattggagaaagctgaaggaagacactatttacaaaggtgtggtcaggattaagagaaaccaacaagagctggcagagagctttgaagctttaccatgcctagacccaaaaaggggcaagaagagagcaatgacaagtattgaaccgtgatataggagagggtcgccctgtaggaattgtgccctttagtagaggaactcagccactgccaaactgtggaaagagggctgggggaagaaataccgagtctcccatcagtgtatcccattggccaagtccaacagaaaccagagttcaagggagcccattgatacaggtcgtgcaacaggatagagagtggtcccagcagagcacacagagactgtcctgcagaaagactgattaggcaccggcaagagtcgtactcagccatgttgagagccctgctgagcttggaaacaatcactttgtgattgtaccaaataggaaggatatgggattctcattgggtgagcaagagtgctttttctgttatttggaagaggtatcactctaagacctgtaatttgcccatccgtgtctggtttttgacactggcaccctagaacatgtacaaaagggtagtgacaccacgatttaaggaccagctctctgtgtatggctcagtcacttccaaaatactaagctaaaatgttttggattcttatgttttatccagcgttacctcacgtcaattcagttcagttcaattacattcggatatttgctgaacatcaagaatttcttggaactatgctggatgtgctcaggatacccagatgagaaggcatggagttagaatacagtaggggagatgatcatgtaaacaaatcgtataattaaagcgaagcctggtgaatctaatggaagctcttaactgacctgcccttgcagactcactgtgttaattgggaagccttgttctctctccaaacgctgtggctgctgggctggctagcctacatggtttcggcttatttggctgtgtctctgtgcacctgtacacgtccatgatttgcatgtttaccaagagtctcctgtgtgtgttcccaaatcattttatgtcagttgttagtaattaaatttatacaatttaattacgttttaagtgaaccagtgaaatatagatgcaaaataaaaagctttcgtttgcgttaaaattaagtcaaacatttcagaaaaagttaataaagggtagtcacttaaaaaatgccatttgaaatgggtacagataagacagctcctcatcccttaaagctggcagtaaggatgatcttgacaacaataagtttgtcgatggtaggcaaaaaattaagactgtaccttgatggtttctcaatttttctgtgagggaggaatgagcagtgaaatgatgggggtgggagcctgaggaccgtgaagacagcttgaaatagataacttggcaggggaacgggaggttgctggctagggcctggagaaggacttgtgggcagcactgaccgtgcatccacctgaggctggagattgtgatttttgtcatggcccccacctacctaaacaactgtgcaactttcttttgcagtgcttgacaggctgacgtagaagtgcaaaaatagttgcttagagcgatccaggatggggattttgtgggggcaggtgtggcaggggtttaaggggaaacgagagttgagtttgggcaagaatgatttaaaagtgacttaagccttttggccagaattgccatttttcattaatttgcctatgtgatgaacatgaagggaaagaagagaggtacctgctatgttttctttctttcttactccctctccctctctcttttttttttgagactggatcttggtctgtttgcctaggctggcatgcagcggtatgatcatagcttactacggcttcagactcctaagctcaagcgatcctcccacctcagcctcccaagtagctggaactacaggtgcacaccaccatacgcaactaatttttaattttttttttttttggtagaaacagggtcttgttatgttgcccaggctggtctgaaactcttggcctcaagtgatcctccttccttgggctcccaaagtactggggttacaggcatgagccactgtgtaaatgttttgtaggacttttagaaaacatggggttgtgcctttggccacatgcatgcttgtggatctacaagaacagcggtcctgtaactcttcagggaaggggcaccacatatctgtcctgtcaccatggcaaagctggaagggtctgcagagctacccagcatgctgctggtgttgttgtaaccaagcagagggcaagattctcgccatgagaattgatgtacatgtctagcatgtgaagcatcctaagggctgaggtgggttcctgaaacctgtggaggaaaatgctcagtgcaagaagccaaagaaaaaggcaccaggctcagcgggagcacccgcctggagaagcatactttgtgaggatcagcagaaaggagctgagtgtggaagctgtccccaagtcatggcacaaaagtattcaaaagaaaggatttctggattgttttttaaaaaacaaaactgtgatgtaaatgatgaattgtgctctgtggtctgattaggaatgtgagtggatccagagtacagtggggctgaggcaatggaagtatttttttgtgtttttttttttaacttttaggtcagggatacgtgtgcatgtttgtttaatgggtaaacttgtgtcacgggggttcgttgtacagattattttgtcacccggataccaagcctagcaccccaatagttattttttctgctcttgtccttcctcctgccctctacactcaaggaggccccagtgtcttttgttcccatctttgtgtccatgtgttcacatcatttagctcccacttctaagtaaaaacatgaggtatttggtttcctgttcctgtgttagtttgctaaggataatatccgccagctccatccatgttgctgcgaaagacatgatgtcgttcttttttatggtggcatagtactccatggtgtatatgtaccacattttctttttacattctgtcattgggcattaggttgattctacatctttgctattgtgaatagtgctgcagcgaacatatatgtgcatgtgtctatataggagaatgatttatattccttggagtatatacccaataatgggactgctctgtcaaatagcagttctgtttttagctcttcgaggaattgccacactgctttccgcaatggtcgaactaattcccaccaacagtgtgtaagtgttttcttctcttcacaatctcaccagcatctgttatgttttgactttttagtaatagccattctgactggtgtgagatggtatctcattgtggttttgatttgcatttctctaatgatcagagatgttgaacttcttttttatatgattgttggctgcatgtatgttgtctattgaaaagtgtctgttcatgccctttgtccactctaatggggttttgttttttcttataaatttgtttgagtttcttattagatactagacctttgtcaaatgcatagtttgcaaaaattttctcccattctgtaggttgtctgtttactctgttgatagtttcttttgctgtgcagaagctctttagtttaattagatcccatttgtcaatttttttcttttgttgcaattgcttttggcatcttcattatgaaatctttgcccattcctatgttcagggcagtataggttgtcttccagagtttttatagttttgaggtttacttttgagttgactttttctatgtggtgtaaggaatcagtccagtttcaatcttctgcatgtggttagccagttatcccggcaccatttatggaatagggagtcctttcctcattgcttgtttttgtcagttttgttgaagatcagattgttgtaggtgtgcaaccttatttctgggctctctattccaatccattggtctatgcttttttttttctttcttcttcttttgagacagggtctcactctgtcacccaggctagagtgcagtggtgcaatcgcagctcactgcagcctcaagtggaagtctcgatgagatcagggaggagtaggtgtgaagacagtagaagttctgggaggctgaggttggggaatggccctttgaccttgggattgcagaggtcgaggggcttctggtgtgggtggggctgcagccttgggtggtgtaagtgaagtgataaagaccactggatcagaagacatctagaaacatagaggcaaaggggtttcaagaccttctttggggacattgagaccaccccaaactgccaagatttgtgatagataagtggacagggagatcattggcaaagccattgataaatatggtgacagctccaagaagattggcaggcgagagagaggctgaggagtgagtgtggtataatggcatgggcctcaaagggcttttccctaaggagaggggaatggtggttttcccctgtatgatttctttggggcaaaccagacccgtttttctgtaagcacaaaatttgtgcttttgattagcagaatatctgctcccatttgaggaggcatctgtctgctatccgtgtgactcttatggaaaattctaaaagtgactggtgccataattggagctaggactcacttcttgctcctatgattctactttgatattaaataagtttcctttatgagacaccagtcagtaaatagaacaggatgtatggttaaatagctaaaattattttcatcattgcaattatagtatgccttgccatttcaaaccaaatatccacttatctttcctgaaattttgcaagaaatctattattcgaggatgcagagatgatttttttttggttgagttaaacatttttatggattagatatgaattcagtaaaaataattgaattgggtaatatgaataattcatgacatgtaatttcacatcagttctaccttaaaaataaagctattggtttatgtactgggaagatgtattttattatttagaaaggtagagaacattattttggaatataactcactgtatgattaactagatacattaaatagtaagattgaaagaaagtacagaattcaaactaaggtgctttgatgcaattcacctgttccatcttcttgatgaaacactagttgctctgtgtctgtcattagcgattccgcaaggcatgtggtgataagacttccagattttgaggatatgtccagtaattgtgcttgaacattgtaatgggtgtgacggctgccaggtgcctcatttggggagtaggggacaactttctggctaggtcattctttccaaagacatgtactctctgcttcctctgtgtgtagcccagcatactgggacatccatatgactaaggcttggggagtttcttgcagagtggtgtggtggcacagatcaaaatcttggtagaaaagtgagcccaggtagtcacaggcttgacccaagcctggaaggaggagcaggagttagctatggagaagaagaggggagagaagggggacactgaggagtgagaatcacctgtgcagtggtaccagggccagagggagtcagtttggacctgctggctgcaactggacggaagaagcacatggactgtggtgggagatgaggctgagaacattgggggccaggctcctgaaccgggctaaggagcttgaacctgatcctgcaggtatagcgggaaccactgagcagcgctgatgacagagatgttctgtgttggtaccatagtcagccgaaagtctctcgtgaaagttttccctcttaaatgtttgtggtggtagttcaaaatggaattggtccacaaaggtattgcacaatagaagatgcagtatcttaaccattgctatcatttgttgatgaccagaagttcaatcacagaaattgataccaatacctgttattactcacaacaatgcgtcatcctttattaggctcctagtgccttttggccattttacactaagacaaaaccactaactgctttaaaaggcgttggtcacaacttttatgatttgagattaatcaaaggcaccgaatgtcagagtctcctacagaactcagccaacttttagggcaaggctctgtacttctccatctttagaaggaaagcagggaaaaccgtggaaatcatgctactttcattctcttcttggaggactatcccctgggtaaaaattcaaggttcttctaattaatacattgtaactaacacattaatgaatactgcctggtgagatgagttgtatcttaggtcacagttgttgaagccagacaacgtgaaagaagatgatgggcaaaatggatggttttagttacttcttttttaaataccgtattgtttttgttaaatgatacaagctttctatgaatgaagtaaaatagtacctgaaatgcaaaggaagtaaaaatcactccaaaatttcatcctctagaacagcagttcccaagctctgtggcaccagggactggtttcatggaagacagtttttccacagactgggggcaggggcgatggtttcaggatgcggctgttccacttaacatcatcaggcattagttagattttctttctttctttcttttttcttttgagatggggtcttctgtcgcccaggctagagtgcagtggcatgatgtctgctcaccacaacctctgcctcctgggttcaagcaattctcgtgcctcagcctcacaagtagatgggattataggcgtctgccaccatgcctggctaatttttgtattttttagtagaggtgggattttgccatgttggccaggctggtctcaaactcctgagctcaagtgatccactcgccttggtctcccaaagtgctgggattacaggcatgagccaccatgtccagcctagattttcataaggagtgcacacgtgcttagatatcttgcacatgcagttcacaatagggttcgcactcctatgagaatgcaatgctgctactgctctgttaggaggcggagctcaggcagtagtgctcgctcacctgccactcacctcctgctgtgcggcctggttcccaacaggccacagcctggtccactagctaggggttggggacccctgctctagagttaactacagatgacattctggcgaacatactaccagacatttctctagaattcataactttgtattcttagtccttcttgcaaactctggtgtgcttggtcctctctgtaggatatctgttgagattgcctagaatttttttttctttactcttcaagtttcttaatttttgccaagtgttccattattggaacgctaagcatgtgggagttatttgtatcctactcagggtcatcgccaaggtctgtttgcaaaaattcaaaaaattgcaacctcaggcataaatgggtacggactatgttcaattttgtttcttctttttacagtgtgtggcttgttttgtaaacaaatgaatacatgaattaaatctatatggagtacaaagggatgaaggagaaacagcttctgagctgtttgtaaccatccttgtttgcataacctacttattattgaattcagttcagagatcatgctggtggtcatcttactggttagctttgcctcactggactagagtcactcagatgaaatgagtggaggatgatacattaatgttttccagagatccttcctgtagcttactatttaacatccaatccatcaatggatatttgatattgggattaaggtactagttatatttatggataaaagagaattgggttaccttagctaacttgatcaaaattcaaatggttgtggttaagtagaagaaataggtaattttaaaatgccagagtttgaatgagtgcaagtaaaggcatgtagatatgaaaacctcatccttttatcttgatggtgttttgaaacttcaagtattttttttttcagacctccaggaagaatggattttttattgccttcacgtggggtggtttctttgtgtacgtgaatgtgccaccagggcagtgtttctcctggggcagtgtttcacagtggggcaagttgtggacccacctgtgaccgtggtgcatttccagagaggagaactgcggatcttgtgcattctctgtgtctccttctatttttcaagagacctttaaaaagtttctgtctaggccaggtgcgatggctcacacctgtaatcccagcactttgggaggccgaggcaggtggatcacccgagatcaggagttcgagaccagcctggccaacatgatgaaaccccatctctactaaaaattcaaaacattagccaggcgtggtggtggaggcctgtaatcctagctgctcaggaggctgaagcaggagaatcacttgaacctgggaggcggaggttgccgtgagccgagattgcaccattgcactccagcctgggcgacaaaagcaaaactcttgtctcaaaaaaaaaaaaaattctgtctaaattccagtgatgatcagatgtgaacataaacacgttcaggatcatatacattgctggatttgccatatctgactttgtctgtttctaggatattcgaaattctgtgactcctattaatgtatcattctcctggggcatcacagctgaggctggtgtaggctcactagtagcccagcctggaaaacaagctactcagcacactcctcttagcttggctttgttgtgtgtgcacttcatgagggtgatgctgcccatgtgatattccagatgtaggtgagtctccagaacggacagcagctacagtagtgtatcttttagagagcacggaagagttgcttaaaacttcttttctattcaactcttcatcagaggtactcttcatgacctcatctattcattcatgcaacagatatttactaaatgtttacgttgcaatggacatagtagaatgaatcatcaaaagcttgttattatatattaggttgattttttccaggagaggagtttaggaagacattcagtctccttggtaaacttgtacatgcctttactgtcagccttacttaaccctttacgctatataatatgctttctctcttaattttctcacgagtttgcaagccccttgaggggtaaagatggtatctcaactcttcgcagttctattttatgcaaatagaggcagtggtggctaattgatgattccatcatccagaatatcttatgcctctagcttctgactgacggagactctgttttttaacagatgatctgaaatgagtttgctgtaggttctttgctgtcttggtcacccctggacatgattggtattctgcatgactatcattggtagtggtagcatggtatcgtaaaggcaaggatgtaaagagaaacaaactcgggcttcagggtgaaaacctttggctctcctacttggaaaatggacttgacctgaaaaatgagaattaaagtctacatctttcagggttattcagaaagttaaatgaaataaaataaatataaagtgatgaggtgaaataatttcttggaataatgagtttccttgattcacccttgagcagacacctgttctcttgccctgcagcctctgatgcagggaaactgagagcaccaagcaggaccttgaggaagagaaggggaagaccagctcaggaggaggcctgattctcatgcaggcttagagcacagcatgcatgggttggactgtgcagatcagaaggggtgggaatgctgttcttacaggcttaggttttctctctttattcctccatccttgagcccctggaggttcaaaaaagcaaagataccagttattaggaaaaataaagacattctgtgtttgtaagtggctgagttgaatctgtccaaaccagcttatacttgtgcaaactctgtgtctggcttgcacagggttgacattcagcaaatagtagttccattccccatatttctcctctctctctccgtaatgataaatatgaatacatacatatctatatataaaacctgtgacataaaatatatagaagcaacttggatattaaagtgtgagtttgtatgtgcacctatccccatccatccatatgctagcagtacctacatcccttggaagtaactggataattggagacatgggtgggatgttgaaggggcatttctggtcatcttaatgactgggagtgctattggatgtatcaaggacgctaaacattcatcagactgtcaggcagtcccttatcctcaccaatagagaatttttctgccccaaatgccagtagtacttccattgagaaacactgtatactgacagtgtggaacatttctcagcaactttgtgaattagagactgctcattattctatcatacaggataacaacttttcaggggaagttatctttaacttccctgtgccccgactaatggtattactcggtgagaatgttgactgcatgttgatccccactgggggattctagacatgttaagctctaacatgtatgtgaatattatttcagatctgagggcattgtgatcattgttctctttctgttggtgtggatgaaataagagttgttgctgcttggatattttcccctccgacattctttcactgggaagctattagacaaaaattgtgtaggctttgtggacaagacatttcgacggaaaaaataatcttggcgtcactatgcacacacacagagaccgcacatacaaagcgattttggagggcccttttgaaattacatagggaaaccaacagtgccagtaatagcacggggctctatttctcacagtgcttttgaaggcatagaaagcaaatgacaattctggcggtcgctaagatgtattttgcagtggctggaaagaaactagcattcttagaggagtccagcaaattgtctttgagcctttgagggcacacagaaagctaatgacacctccgaggaatagccttctcaggttttagatgccacagatgctaaagccaggatataaaacctttcttatagggcctttaagaatcctcagtgtgcttttattagcaagctgagtgtgtatatagagatgttaatggtctgtggagcaagctcagcttgtttttgcaaactacagaactataaaagttatcagaaaggacacattcttgcctattgctttgttcctttgtttcttatttatttccttctctgtggaatgttagggcactgatcatgtgctgggtcccgtggatacaaaggggaatcctctgtggattcttctctctggaagcttgccctccaatgtaggagaaatgtacacgttcatatccacagtgcaaagtatagaaggcaatgacaatgcaaataaagcctaaattaaatggaaatttcgccacagaagaaattacttctagctgataggatcaaagaaagctacatagacaaaagagtggaaatggtatttaactattttcaaggatatgtaggatttgggcaggtagcaattagctttcaggaagaaaagaagacttattgtaggggagggcagtccatgccggggagtggcattcacaaaggttatgagtgtgaagtgagaatagctaaggttagcaggttcgtaggtgtacactcctgaccgttgagagaatgatcctggatttactgctcgttaatgaatggttaggaatcctagtattcacacattgatgtgctacagaaatccctatggagcttgttagaaatttctatccctgggaagctctccataccctgtggttagaagatctcagagatcttgccgtctctcattccctatggccagtgtccaccctgcagccagccactggggactctgtcgctgcctcttcctgagctgggaggcgatgctgggatgccagaaacacacaggagggaaatggagaacacttttctcagaagtataatccccaaatctcctcttaagccattacaataacatctcatattttatttaattttctttaaatggaaaaaccagttataccaaatgaaaacaaatgactgaagaagaactgaatgatgtttataagccttttatatgattttttaaattgagtttttggtctcctaattgattaataaagggaaagacagagaagactgacatgtgttatcttctgtcacagttcagatagagtgaaatgactcccaccttgccaatacaattctcaaggttgattgctaattttaatttatctgaaccgtgcttttcaatgaggtgatattggtcctgatcgttctgtaaattggagattttgcccgaggaagttaattctcccctttcacaaaaaaagtttggactttcagatgacttatttgacattagcaatgttagattcttgctccactgcagctctgcctggccactctctgttctttttgtcactgaattctctgaagcgtgtttgactctgcttaggggacccccatcactaagcctggggtctggttaccatggatcttaggcagtttggctgctatagcagcataccgtaggctgggtggcttcaacaacaaatttatttcctcacagttctagaggctggggaagtccaagatcaaggcactggcagacttgggaagtccaagatcaaggcactggcagatttggtgtctgatgagggctctgcttcctggtttacagatggtcaccttcttgctgaacagagagagagaaagcaggctgtcctataagggcactaatcccattcatgatggatccacctggtatatttaaaagcccaatgacagtcctgtgagacatgtaatagtaataagatactaattgctgtttatcaaatgagccttgtgtgccagggactgtgataggatcagaaaggttaaacagtttacccggagtcataaaatagatgtttaaaatagttgcagagtaggtacacaaagatatgtcttttgacttatctagatggaccccataatgcagaagaacgagtcttggccatttgcatactgacacttgggctagcaggccagaaggttctacaataggcctggcctcaaatatatttcacttgtaataagcaccatatggggtcctgccttggagctgagtcatacaagagtgcctagagtgccttttaaaggcctacagccatccaactcttagggaagggagtccgcattggacttgggtgctctgggaagtggtctggttcctggatcaattgttgatgaggtatatatttcaatcatgttttcccacggactgtggggaaggcggtgagggtggctggagacagggttggttggggagaaggggctgctgttggttgaacattagttacacagagctgcgtgctataaattctggctcactgaatcctcacgaccactctgagacttatattattaatatgtattagaaagaggacagtccgtggggtgctctgcctcctggactcctccgtcaggaaggttgttggttcagggccagccactgcttggctaacgcctcagtgcttcagcgacaaggaccaggccgtgggcacaaataaggtcttaggtctctcctctgtgcacatccaggagagagattttagggatagttcctactggcttcatcactctagggtttaaatctgggctttgctgcctaccagctgtgtggcccttccagcgtgaacctgtccagacctgagttttagtatacccacagtggggaaaaaagacctacatcacagggttattgttaggcttaaaggacgagacagatgcaaagtactaagcatgtggcctggcacaggggaagtgctcaggaaatggtagtgactgttaagactgtgatacttggaggctgaaccttaacaggatattatcctgacctgtcagtttagctctttggatcctatggtttttttttgttgttgttcttttgtttgttttttgagatggagtctcgctctgtcgcccaggctggagtgcagtgtcacaatctcggctcactgtgacctctgtctcctgggttcaagtgattctcgtttctcagcctcctgagtagctgggattacaggcacctgccaccatgcctggctaatttttgtatttttagtagagaaggggtttcaccaccttggccagcctggtctcccaactcctgacctcaggcgatctgcccacctcagccttccaaagtgctgggattacaggtgtgagccactgtgcccggcctggatcctatcttaaaggaatttctgtggtgataaattatgaaatgcctttctcgtgccatccgacctcctgtgttcactctctgcacctttctattgtttcactggaagtgtcatgatattccatgagcacgttggttgctattaccacgtaagacaatgggaaaaaagaagcctccagcttctgggtgtttaccgtttggaaacacagcacaacacttgacattctcagtgctgagctcatgtagaggcagcagacagactgcagatacgtgcctgtcctgccccattagctgcttcgcaatgggggtttcagtttatccctgtgccggtgttgctcccaaacacggtgaccgtggggcacatccatgcctgtctcacataccaaggcactgtcagcatgtgctcctgctgcaggacccttcggccaagggattcatcctgcggcacaggctcgagtctaagtttacccgtgacctgtggtcattctgtggacggcagaccaggcatgactgcacgcctcgtatcagaactcggaagcctggtggtgacaggaaacagtccgactgctttagagaggtattagtgaaatgtctaggagggcagtcttctcctatggcagaacagagcaactagaccaaacgcttggttgaagtatatctttaagtctttgattaaacatgccgttgcattttctgtttaaatgttgttttacaagctgtgttctgactgcaaggtagggtttctaagaaatcagtcccaaagagctcttgccccggagtgtttgttgtgtagcctaggtgggctgtaaaagctagagctgttgctaagggaaccaacggaggaatgtgaatttgtaaatctctcaatcacattaacattttgtgtaatatctgacctcagctttactttaaggtgaagaggaagctggtgtaggaatgatactggtcaaagatcaatgagagaggcactgtcattttagaacttgacactttgtcatcagcatttctatttcactcttgtaatacacaattctttatttctttgtaaaaagtcctatataagcaatacctgccgtggttccccacttttcaggccatgccctctgtgacattgggggttgcctattttatagagaggcagagtggtgaggagaaagtcattcggtgtttttgccgttgaaacctaaatctctaaggtgacaaaagaaatcccagtttacttggcatgagagagttttgccagttccattctacctaaaatgctcttttgctctgttttatataagagaggaagaagtcattttattgtgctgaaaaacagtggaagtaaagttaccaacgagtaatattaatgacttcaattcataatattgggataatgactaatgtgccaggtattatattaggtatttaatatacatgatgacacttaaatttatactatggtcaggcaaaggtatggttcatgatcccaagcatataacatgcacaccagctgaatataagatgaaagcaacattctgtgcattcgcgtgcccctatgctaaatatacttaggttgacccatatgaaattgccatttttatgggcaaagagagccaaatatcggtaattccaagtggttcagcccagcacatgtttgcatatacgcaaactggcagacgcagttctggaattttgttgagacatccccaaagtgtttcacaggcctacagacacgtgggtcttttcacagaggcataacgaaccatgcagaaaggtagaatcctcagatgctttatctaataatcacagaactgaagatccagaaggatccttgggggctgcgtgttgcactgtggttgtttaatagaagtaggccccatgaggtgaggggacctgcatgtcgggtgagttagggctgactgtgaggctgggacttaggcctgtgtggcatctggaacactgtattctatccattttaaattttaggccatgaaagtgagtaacacatgggctgtaacttagaagtcaactaagtgataagggcttgcagtcacgctgggcacagggaccccgggcagagaggagctctgcggtgcagagaggcacattggtgaagggagccaggcattcagccacatggtagaggagggcgtccttatctatctcaactagcttctgctatcggacttctggggagaaagggtttggtgttcaaggcctaacattgcctttcctctcagaaggtctcgttcatgttacacagctttgttcaccctgagcctagcaagctctgagctccttggagccaccattcctctctcgtacgcaagaaacaagtcccagctcgggagcccacaagattaaaaagtgcagataaccagtagccgtatggaatcatatgtcttgacaggagctatggacttgtcctcatttttaaatttatagcactttgaaaaatcacaagtgtgggcctgtacattgtagcatatctcttttgacacagtgggaacgagagcctttacgtcaagggatactggttagatgcaggccttccagaagcttctgcagtagcatcatcacagctgccctgaggcaaggcaggagcccactcggggtcaggggttcaatgtcgggtcccctccttgcaggacacacttcattgctgttgggggtttcacctgtgactgtgtgtcttgccctctccttccccattcttggtgtgtctttgtaaaattagaacttgtgtcttcttctctccacatccctgtactcagtgtccaccctgctgtctgtccagcatggacggcaaatagtctgtcaaacacctctctagtcattgtcgtcatgggcccaaaaagactgttagcctctttaccgtatagatagatcaaatatatatttttgtcgaattctgcagtaacctgtgatgtgcgttggcctgagacaaaaattcgcttccatcctcagatccttgttgtgttctgaagagggcacacatttaacagaacaaagctcgtctgctttgctgggacgatgggtggctcgcccagcaaatcatcattggagccttctttattttgacgtgagttttcaaaaatagcatttctgcttttatttctcgacttaaaagcatattttaaaaaattggttttctgcatttgtgtaatcaagtacaggaatggttttatggttttgtttgacttaggaacgtcttggtgcctgccatttttcacggccatcatctgaaaggttctttccactttcacaagttgttaactgctttctttgagagcaagcaaagtaggctgcctcaaatatacacctggaatcggtatttatttccttattctgtgccctgtttcattccaagattgtggtatactgggaaataagagaattcaatgaaaagggcttctataacaaacgaactaacccattagaaagaactgaccataagcttagtaggaatcagtcatgtgatgttgcagctaaaatagcgaatgctgtggttttcaaacttgtctaaagtgggagaccccacttcctaacagtgttctgatttgggaccttgtgcacaaagtgggcagtgggagtggtgactggggaggtataaggagcttagagcctggatgggtgcctgccctgccccttccaggtaaccccctgaaacttgaaaaccattatgttaatacgttaattatatagctatagggatcccttaagtaaatacaaagttttattactgtagaggcatgtttttatacattgttttatttgaccctgaagaagagaccgcaaaggcattatctctagtgtctgtatttttcatagaaggaaactgaagatcagggagattagtaccatgatcaagagcacacaggtaatgcataaggcagcagggattggaatgtgacttagtttagtgctcatttcactgggtcacaggcgtatatagatgaaataagagccttggcttcttggagctggtcagactctttctggattgttttgttcagtgatgggtggtaaattggagaatgttgagagaggcgtgactgggatgtatccctgtgcagtacagatagaggtgaaagattttaaaatggatatctctttgagaggtaattcattggtgtcagctggtttcaataaaggtgctatctaaagaaaaaggtgctatctacagaaaagcttgaagatgggagggtgtgggagccgcgggacacggtgtggatgtcacagtgaagggagaaggagaagaaagggaggcccaaggcagggcagaatcttgctgcaacttcgatgttgagcattctggcccacgggacacacacagcccaccagttttcaaaatacattctttgttcctttgccaggataagaaataagacggctgctttcatgtctctacttctcaaatatgtcagtcttttcagtgacattcttttattcaatgtagtgggtgatctgaattgcaagaatatttcctattttcccatgggactaaattaagttatttgcattttgaatggaatagaagactctaaacacatttatttttttcttcctgaatcatccttggaaaaagaggttgctcgctgttgatttatttcacaattttatctgggtaaaagccacttgcaaaaccactccccttatcttagtacaactgtgctagtgcagaactaaggccaaagggtggaaaattccgtgagagtgatttggattcactcttaaaatgatagcagcagcagcagcagcaagactcacagcagcagagctagctaccagaaacaggtggccctagagctccttgtccccagaaatacacaggtagaggctgggtgctgtcagtctcagtccctgaggagtagacctctgtgttgggtgttacattaggccagtctgttcttttgagatctaagattctgttattttaaaggctttcattactatcccattagaaggatcaatttgaatttcttgtatttgagtggaaaatgccgaagaatactgaggtttgagtttctgatgttttgtgaatttttcactgttgatatttcatcagaaagaatctgagaatgttatgatgtaaagtgggccagatttgctaatctattttaagaacatgtaatctgtgaataataaaagcactgatttgaatattggaatgataaagcaatattcttaattttaaatgattcttgttttaaaaatagcatgttttaaaccacttctcatgatctttattttcacttattttttatactaaattcgggggcgggggacaagtgcagttttgttacatggatctgttgcgtagtggtgaagcctgggctttactgtagccgtcacccaaacagtgtgcattgtatccattaagcaatttctcatccctcatcctgcttccaccctcccaagtccccgatatctgtttttacactctctatgtccatgtatacacattatttggctgccacttacatgtgagaacatacagtctttgactttgtttctgagttatttcacttaagataatggccaccagttctattcatattgcttgatttcattctttttcttggctgagtagtagtccactgtatgtatgtatatgtatatacaccacattttctttatccagtcatctggtggtggacattgaggttatttctatatccttgctattgtgaatagtgattggcacaggtgttgctgaaagtgtcctgagtgtaagaagtagagaaggattgttttcctcagtgttgtgtgtaaagtgcccatattttatttgtgtaggggagagaagatttctgttcttacccatcgctgggtttctggctgagtcatctatagcaaaagacagatgaacaggaaaaaagtatacatttatctgatgcaagttttctgcgacacgggagccttccgaaatgaagagcgagggaaacagggaaacctgtgtattgtatgcttaggtttgatgaagagaggacagatgtggaggagtgtggtgtgattagacaaaggaggagtgagctaatggtgataaacagagggatactcagcaagtcctgttggttctgattcttctctgtgtccctgtgtattcatagatgtggttgttccttcctccagttacagggagggcacttcaccaatgagaatcttatgacctgccataggggagaagggcaggaaaagggcatagagtagccttcctgcttctgctgctttcttgaatgccacagtgccatattttcaggtagcatgtcctgaaccccatcatttgcatagctttacaaagatttcctatttttatttttgattggttttcacatttcaggcatttgccataaatgtttagctttaccttgatctacgagatttggaatttgatggcctataataaattcacgttttagcataccaagggcctgatattacaagcaaatgaacaaacatacaacccctacatgaactgttgtgtaatatgcataatttctcggtttctctattttataatttggatttttctgcagcagggatggagagagcacattttctatcagaagttaccagtgcacaggaaaaatgagtcaagatcaactgactaaaaagaagcttaactcctttaagagagaagtacgttctactttgctttaaaaaaataagaacagggacataaatctatctaatggctaaaaatagaaatgagtgattgaggatgaaaaagagaaggaaagagaaagatcacagacacagacacactcggagacttcacagtaataaagaaaaaaaatcaaggactcagagtgagacacagacaaaacgagccatacacctaaagatgaatatatgcaaggcaggcaaacggaagtcctttttgggggctgtgcaaatactggtgtaacataagaaaaggtgatgggcagatgcagtgagttgtagagggcctgttctgtccaaaggcactcaaatccaacaaaccctgcgctcaccaaaggaaattcatctgtcatccactggccaccagcgtagaccctgggttctgaacacccacagaaatgggagtggacgttatactgagtgcttaccctgtgccaggcctggttctgtgtgcctcgcccctcacgccttataatcctcacatcaccgtcgggaggcctgtgcaactgccatttccccacttcagaggtgaggaagcagacctagaaaagtttccatgacttgtgtgatagcacacaactgatcaaggatgagttgaggtttgaacccaagaagcctggcaccagaaaggaaaacgcactccaatgcacaagacatacattgtcacccacacaggcccagccatctcccctcctgcttcatctaaccactagaagtgcggggatagttatggcagagacaaagaaacccactcagagaacacacagaagccttagagctaagcatgcatggagtcacatcccagccttctggcttctgctgtgcacataatttgtatcctaattttaatgcagtcaatgctgtagtagacctctgaaagatacacagataaatgggaccagagtgaaggaactcacctcttgacaaatgcctgctttttttttttttgttttaatttagtttgctttcttcttttgacctggcataaaatgccaataagaatttgctagagacaaaacttggcagcaggttttttgccaggtgaaaatggggttctaggattaccgtggttgcactgtgcctagctggtagtaggcactcagtcaatgttgatgactggatcacgagatttagcagttgtttaaccatcagtactctcccaattttcaggatttttttgtttgtttgtttggagatggagtttcgcacttgtttcccagtctggagtgcaatggcgcgatcttggctcaccgcaacctctgcctcctgggttcaagcgattctcctgtctcagactgccgagtagctgggattacaggcctttgccaccacggccagctaattttgtgtttttagtagagacggggtttctccatgttggtcaggctggtctgcaactcccgacctcaggtgatccacccaccttgacctcccaaactcctgggattacaggcatgagccaccgtgcctggcccttatgtacagtgtttccctagttatctcagaaacttctctaggccaacgaggtaggtaataggattcccattttccaggagaggaaaccaagacccagaggactgtctggactgcggtcttagagctggcaagtgatggagatggcacctgagggcttctgcttctaaatccgtgttctgtcctctaggctgcactgcccttcagtggtttaagtggaaagccatggatcaatctctagggaaatgtggttttcagagcagtagcatttctgacaaaggtgaagctctgatttttcccctctcctggaaggaggaatattaaatatctgcagtgtctgaatttctttaaccttccctccaatctttagtctctttaggaggttatttacaactctgacttctgtttgtttttaatgtcctctgcaattgaaagaagacagtgagtgtgatgcttaaatgtagtagatttttcccggactatttgataagatctattttgtaaaggaactgccaaagtcagttgcgataatagccataatagttttaaagtgatgttttccaatgcagattcacttattgcctggtttttgaaattattttgagtaactattagaaaataatactttaaaccatgtttttatttccaaaaactctaattgaaaattaaacattcttcagaacaaagaaagcaccttccttttcccagttcccaccctgatcctttattttgctccatttccccataaatccagataactttgttatgtggagtaagaagtagaagatttcactggggcatgctttgacttccccagttccctccatcaaagaattaagcgtaatttttatccaaagaatgggatgaaaggaggattccctgcaccgtcgttttggtttgtcctcttctttcacggggaaagaggagctgaaatgtgcttaattgtttgctgcatttcctgtgcacatgtacttatccctcacatcacccgagaccaagtgaagagggagtgtttagaaaaaagagagggaggctgatacccgttgaaagtaaaatgctggcatcttaattttaagagaacacagaaagccaaatgctttcagaaaagggtcccttcacggagtaatttgcctggtatggcatcccagtttgttgtataatttcagccccgttactatggtaacctgctttagtgtcgcagcgattgttaatcaggatttgtcgttattcccctttcatcacgaggctctatatccttatggattaaatcgcagttctcatcgacaatggcatagatcaaacattattgccagacataaaaccccgggtcgctccctgtcattttccccgttaccagaagcagcaaatgcaagctgaagtctaacttttgcaaggaaatcagggctccttctggctcctctgatatctaccctcatgacagaattccaagcaagagggccactttcgtttccaatcaccctgtgcccatgggaagggcaagcaccattttgcgtcactgcaaacctgactcttcagatacatatccagacaaaaagttgttttaatgtgacctctaactcttcctcaaaccttattcttattcttggagcagccgactttttctttctttctcatcgattttgtagattcttgtctgctgcttttctataggaagtccgtgtcaagaagcaggggagaccaagacgccactcctgttgaggatgttctgtggtgaatcacagagcctcgtgaggctcgtgggatggtggcttgcttttcccatttgtgaagtctggtggtaacagtacccagacagggaagtgaacaaccctatagtatagtgaccggatttagcagggccggatcgccaccatctttaggaaagtcaggttaaaggaacataggagcggtgaagtctcgtggtgccatgttctaggttaggtgcatatcgctagtcgtagtgtgtcttcatattgcaaattgctttgtttaggagcgagaactgttaagccacgcttgttaatagcctctggagccagtctgcctgggttcagtgtttggctctgccacctcctaggtgtgtgaccttggcaagtttttgaacctctctgagtttcagtacctaaaaccagcgtaatagtagtacctacctcagagtccgtgaggatgacgtaagttaatatttgtgaagcgcttagactggtgactggcacgccatcagtgttgtataggtgtttgtaaatagatgaaacagaaccaacattgcacgtacatgtattcaaaatatattcaagatcagattatccaaataccagtaaggtgttgaaaacagcgcttccccccctcctcccccttccctctccctgctttttttccttgatctctgcaatgtgcccaacccccaagtataattctgattggctaaattaattctgcagcatcctgctgtgaataattatgttgatccagtgtgtatctcatgcctttttttttctctttgcctaaattataatgtgacaattgcggctcacagctggctcatcagaggtgggcagttgggggattggcacatctgactgtgcttctctgttaactctgtgccttgattgcttaagacaagacacatgtaaaccccatgattattgccatttttttggactttgcaaagactctgccttcaaacataaagctgctgggctcgttttgggggagggggcatgtaggagtctcctttcccctccccccgcctctccctgcttttcctttcagacaataaatagctgtcaggcttatgtcaaggatgaaattataggtgcacatgaggccttgattacattgttttggagagattgctattagcatactgaaatgaagtctaatttttcactggcggagctgagtcaaactccagggacaggcagggcctatgcagtgcgaggcgagaaccgtccgatcggagcacctgttctatgtggggatcagcttttccttccttaagacaaacaataggaataaaataattcatacgaagaatagctttgcattagaaaagaaaggccaactgataaaggatggaataagacatttcggttagataaggctctttgtgaaatgaccgtatatgattttcaagtgtgtttaatccatgttaaggcagcatctcgcttgttgattcaggctgtgttttagcctgaagagtgtaccatctgattttttaggttgcttgccgcctgcataattcattttctactgcccggccctgcaagcaggcatcctctgaagaggcgtgtttgtgagcactccatccacggggcgggtggccttcttgtacttttgatgtttatacattctgatgatgtgaccctgtgacctgttcactttcaaaatccttcaatataaaaattattcttggcaagtggtttccctgaaatgtgtaagacatggtgcctcgagaatgatggtggattaataattatacatggcttattgtataactgtcgtggctcactgcagtgaaaatttaaaaattacacacatacacacacagatgtacatacacccgcatctgcacgtgtgtgtgtgtgtgtaatgattttggcattgtaacttgaaagcttattcaatatcattgtttcatcattactattattaagggaaaaaaataaggatttggtgtgggtggagaggacgggagcgtgtcctccaatttgaaatctgtaacagtggagaaaatttgtaaacagaccgtatatttatgtatttggagtatatactttcagtacctactacatgcaaacagtgcgctgtagtcactgcagattcagagctgagttagaaatggttcctgctgtccaggagtgtgtggtttggaccagaacaaaacaagcatgaccacataaccctagagcagcaaagaatggtgcgatcgtaaaggaagaacccatatttgctttgggttttttttcccctagctatttgggtgatgttagagtaaactgaggaagagaagagagagtgaaggtttaatggaggaggttgtatttgaagtgtactttgcagtgtgggtagaattttaaacacagaaataaaagaaagacatccccagaagggtgaaactgtgagcaaaagcagggtgaggtctcgtctggccagaggttctctccctgggatgctcttgcatcggtagagaactgtgagtaaaacagctgctgcctgaaatccagacacaggaagcaggtgagtggctgctgagggccgagggctgggggtttcgaggaaactaggagtggctggatgcaggtaccaggggtattttgggggtgatgacagtgttctgaaatggaatgtggcggcggttgtacaactttctgaatagactaaaagccatcggattgtatactttaaatgggtcagttgtatggtatgtgaattatatctcagtgaaggtgttattttaaaaaaaaatactgctgcatactgatgaaatcacactttctgggcgtggcgctggtctgagcctccttaggagccctgggctggagcagacgctggacatagcgttcagctggaaggagaggtggggctttatcttagcctggaagggcttgctgaaaggtttgcaaaacctatttgcaaaagggagccattggaagttttaaagtagggtcttggcacattcacactattgtttaaaaagctactcacagacctgtggtagatggtttctggaagctgggacgccagctggggccttgttgggttaccggcagaggcgaggtggcccttcccaggtacagatgagtgccggttgcagtgagagtcgaaatcaggtgacaaatgtaagggacacagagagcagaatgtcagcagggcccggtgctgtctggatgtggcacgagtgggagagagggtctgacgggtcctcaggtttgagccagagtagatgagaaggagcaggcctggaggatgtgacatgctcagtgttgcatgtgttggattcaaggaaccggcgatccatcctggagcaagatgggaatgtggctctgaccccagcaaaggggctggccaccgagcctagggagtgtggagggtcagcttccgcagcagctcagtcatcagctgttggcaggaggcctcagaccttcaccacgtaggcctcaccacctctgtccccatgtcctcacaacgcagtggctgacttctcccaaggcgtgtggtccaggaatgagtgaaagtcacagtgtctttatataaccctgcctgggaagtgacacactctgtctcctacgggtgacgccaaccaaccgtgtacagggtagaaggggtcacacagggcatgagaacaggaggcaggggccatggggctgtcctggggacagtctgccacctcttgatgcctggcactgctcttggcatggccatctgcatggaaaggctgtaacgagaagggtgctcaaccaccagctcacaggcagggaagcccatgctgcctggaggattcctgcattctcctagcatctgtggcaccccccacgtcccaggggctcggagacaggtcaccgtttctctggactgtcactccagcgagttcaccgcccttcgactctgagcagtgcagagaccccggaccacaacaaccgtgttcctcagactgatgcgaaactccaaagagcgggaaaacgactttagagggaccggaaaggggaagcgagtctcccatggtttgaggtgttgctgcccgtacctgtgcacttggccacagtccaaagtgactccattgcgggcacagccgtggggctgacgtgagaccccagcctggcaaagcgagcactcggaggcagtgggcagaaagggctcctctcggctctgcagccggaaaggagacatctttttagataagagttacagataatattctatttctggaaacgcaaggatgggtgggatgaaccttcttaactaatgtgatccattcagaagtatgttaaaatgtatcccttcatataatgcaccctgctttaatttttagatcagggctgaagagtttttcttttttttttttttatgagaaagggaaaatgttgtttttaaaattaggaataggaatttaggccaggcacggtggctcatgcctgtaatcccagcactttggaggctgaggcaggcagatcacttgaggtcaagagttccagcccagcctggccaacatgatgaaaccccatctctactaaaaatacaaaaattagccaggcatggtggtgcacatctgcaattccagccgcttgggagtctgaggcaggagaatctcttgaacctgggaggcagaggttgcagtgaactgagatcgcaccattgcacttcagcctgggcaagagagtgagacttcatcttaaaaaaaaaaaaacgggaatttagttatatttaacaagtaatcattttgggaggccgaggcaggaggattgcttgaacccaggaggtcagggctgcagtgagccaagatctcattactgcactctatcctgggtgaaagagtgagaccctgtcgcaaaaaaaaaaaaaaaggaaactctgtctcaaaaaaaaaaaaatcataacttgttgagaagtaattaaagacatgcagaactggagaaggtaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaactccgatgagtccgagtgaggggtggaggatctggcgattgtgtgtgtcgctggtaaatttttttttttttttgagacatagtgtcactctgtcgcccaggctgggtgcaatggttcaatcttggctcagtgtaacctctgcctcccaggttccagtgattgtcttgcctcagcctcccaagtaggtaggattataggcacatgccaccacacctggctaacttttttttttttttttattcgtagttttgctctcgtcgcctgggctggagtgcaatggcacagtctcggctcactgcaacttccgcctcccgggttcaagcaattctcctgcctcagcctcccaagtatctgggattacaggtgcccaccaccatgcccagctaagtttttgtatttttagtagagatggggtttcactgtgttgaccaggctggtctcaaactccgcgacctcaggtgatccgcccgcctcggcctcccaaagtgctggggttacaggcgtgagccaccgcgcccggctgagaaattctttatgcaacttctgtcctgctgccctccctgcccaggcccctccagggcctgtgctgattgaagggagaaggtcgcaccttattacaacttacatcgccacctcgtgatacttgccaatttcccctttttgcagagagagaagggaaacattgggcaggctaacgttttaataacattgtttggttttcactgtattaattgtgtgtctaccttctgtctgtggacagtcacaggctgtccatttgtagtggtggtatggagttctctttagaaaataaatgcatgtacatatagtggtttccatgaaatacgtaaataatagcacagttggcagaaaccacaaaggtggtatggaaatgactaatatttgagaagcactagtttgtggcacatgggacggtatatttgtgctgtagggcacagcgctctgagctcccggagagcagattttataaacactaaggtggttttttttttttttttttggccaactttatctgtcaatttacaaatagttgctggtaagtgctgttttttcctcctgaatttagttaaaccaccaagggaggctttcttacactgggattgcagttgctctgttggattggggaaaaagtgtcctaatgacccaggaacactttaataaaaaggttcagttgaaactacaggaatgccgagagctgactgaaaatgcagagaagttctaagggggtaatcggcagtgagggaaaagtacagtgcctcgtggcttctaggatgtcctttgtcctatattctcggctcttttcaaattgaaggaagtgggtgagagagatgctgctaattacatctatgaataaagtgacacagtgcaccggctctgagcagagaccaacacaactcgagagagaaaatcagtctgtcatatttgtacaaatatgtgcacttcgatgataattaccatagtcattgtttactattgctgcattatattaattatctattcagtgatattaaatacataactctaaacatcatccccgaacaaattaccttttatcaattgaaacaaaccaattaaaaatttcaaaatgcaaccatgtaatcaacggcttactacacgataattatgaccaaaatgccaattaatgtgttaatatatgacctcaaatctacagaaacaaacaacaaaaaaaagcagcctcacatagcaattatggcctcgtttgattgacagatatctgtgggtttgtttttctgtctgactcggtaatttgacttatatgaaaacagccggcctgttctgtcccgtgttctgaagcctgttctttcccgtgtgtgacaagcgcgcaggattaaaaagcacagccttttctcttcagctcctgcatgtcccttccctgcactgcccagttgcatccctttccagcatcgtttctgctgctcttgaacctgtggagtgggaagcaagacagggatctctcattttatatatcagtaaggtgtggcgtggacagacccgtgtcgctccctggacaccactggtggtattgattttatggagcagaggctggtgcatgcatgtgtgtgtcaggtgggcagtgatgggggggtggggatgaggcatggtgataattcacaacataccctctatctagttgggatccgtaaaggaggaggttaggggagggaggatccatgcctacttgtggagggtatcaagaagggcttcctggggaggtggaggtgagccgagctcaccaggagcttcaccttcctggggaggcgcagtgagccaagactgcaccactgcattccagcctgggtgacagagcgagagtctgtctcaaaaaaaaaaaaaaaaaaaaaaaaaaataagggcttcctgtaggaagcttagtcagtggaaaggatttagagaggaagggacaggaaatagagaacagcaggccgggcgtggtggctcacgcctgtcatcccagcattttgggaggctgaggtgggcggatcatgaggtcaggatatcgagaccatcctggctaacatggtgaaaccccgtctctactaaaaatacaaaaaataaaaaattagccgggcgtgttggcaggtgcctgtagtcccagctactcgggaggctgagccaggagaatggtgtgaacccgggaggcggagcttgcagtgagcccagatcgcgccactgcactccagcctgggcgacagagtgagactgtgtctcaaaaacaaaacaaaacaaagagaacattctagcaggagaaagggcgttgagtgcttgggttgggtcaaggcacaagtctggctgaaatttagaatctttgaaggaaagcgatggtgagattatttagactgggaagatgaacctgccaatcttatttcttattctgcgtgtgtcacttgatgagaaggccatgtctccaccctttagtaaaggccaaggtcatttaaaaggttacctggcctttttaagtgacttgaaatgtttagcacagttttagaaggtcagtgtctcaccacctgacccttatttccttggtttatgatggccaatttattgcgtctgttttattcaaaagaaaactgagggtgcttctgaagtagtttcttatttcaatgtgtacacacctccactctgaaacatggctcccttaactgcacaggcaaatttatcacatgtagttgtgaacatatatttgtgtgtgtattgcagtggaaaatccccttgaaaaatcagcaaattggacttcagcttgaaaagtatagacagagaacaaaactgtctgtgtgcaaatatatgtatatgtgtgtatctaaaaacatatataaacacatgtatacgtatgtatatataaataaaattggattgagtcataaaagtataaatatgtccaatgtaaaatctactagagaaggagtttgtttttatgactcagagggaatgtgtaataaagaggtatttttaagaccgagagccagtgtgtgtcagcttctttttgcccattgtttgtgtcctgggcaggaagatgactcactagatctgaatcacaaggcaattaagagccccaggaaaggctgatttcaggatggatatttagaagcttcagctaaatcaggtcttgggtatctaggtggattggggaatcagtgaaacaaatatttctcttcattgttttagattctgtggatctcttgctcagtacagaagtactttttttcccccaaaaaatcatatgaagaaagaggaagcgctgcccattctgaaggaggttgttaaaaatgagtaacgcacacttcatgttcacagcagcagtattcacaatagctccacgtgcccgttgacaggtgaacaggtagacagaatgtggtctatctgtgcaatggaatagtattcagccttaaaaaggaaggaaattctgtcacttgctacaacagggatgaaccttgaggacatgatgctatgagaaatcagccagccacaaacagacacatactatgtaattccactgagtcgaggttcctagagtagtgaaattcatagagacagaaggtagaacggtgatttccaggggctgaggagaagaggggatgaagagctgctgtttaaaggatgcagagtttcagttttgcaaggtgaaaaattgctggagattgatcgtacatcagtgtgaatgtacttaccactactgagcggtacacttagaaatggttacgatggtaaatttaatatgaggtgtctttcaccacaattacaaaagtggaatgagtgaagcttattaaggatagacagcagatggctgagaagttggcctggctggaccgttgtctggggggagcatgtggatgaggcatgaggtggggaaataaggaacctgtctttcttccagttaattgttctttcccccttgccttccaccttcctttccctcctgatggctcatcctgtctccctctcacgtgcctgctgtatactttcttccttttccctgctggtccacccgacctatttttactccctcacatttggttgtctttatcctcggaggagaatgctcacaccagcgtctttcttcaggacagctttctaccttcctttttttttgccattttaagaccgacagtggcataaggtcactgggtgaggtagagatacactgatctttttttggtggcagttagggatattgacattggtcatttcccaaagcgacagcagtggtagcacaggtgagggtgtcgcccaccgtctgagaaacccatgaagtacgctggctgctcttccatgttgcccccttcataacaaagtgttcgctatcacgttaagaaatatgttcgaggaggaagccgtgcaacagcttcagaaaaaaattctagagctagaacatgcagttggttttcaaatctcatattcttaatttcaatccttttatttcggatccaggctttaggatgcctctctctctgatatcactaaataaaaattatccaaatgtttaacattatatagaaataaacataatggtgtatttgacaaaatttgacaattttcatgtggatattnnnnnnnnnnnnnnnnnnnncatgtggatattcaatgccttgtggtcaaagtttaaatcaaaaccaatgtggtcttggcttcaggaatctgtaccatcatagatagcagtggagaagaggaaataatagtctggtatccttaacccataatatagattgtatatttgttgaaagtagaatgcaagggtggcaaaggcctgatcttgttgagggatgggaatttgtcaaacgcagtcactgaatctgtgtggtggacacgcgtgcttgaaaaccttgcggaagagtagccatcaaaaatacttacagttcttaccaaggttacggcaggggtgaccacccaataaggtagcacccaaatcggcttcactgcttcaatacgatggaaggctcaaggacacatttgtggttttttttttcttttctttctttcttttttttgagactgagtcttgctctgtcgcccaggctggagtgcagtggcacaatctcggctcactgcaagctctgccttccaggttcatgccattctcctgcctcagcctcctgagtagctggtactacaggcacccgccaccacgcccaactaattttttgtatttttagtagagacaggatttcaccgtgttagtcaggatggtcttgatcacctgacctcgtgatccacccacctcggcctcccaaagtgctgggattacaggcatgagccaccgcgtccagccaggtttgtgttttataggaagaataaatttccattttaaatgaaacaattctacttttttcttgtgaaataatgttgaagtatagataaaatatatcaattgtatgaagatcatttaaagaaaatcacatgtatattgaaaaagattttaatttttttttcttggaaatagtgatctattgttttaatggaaaaaggaagtgtagtttttaaatgttctttaatattgatttacagaagcttaacattacctttttaaataccacaggtacagtaaaatttaatgggaaagctaatttttaatagtttgataatgtgtatatattttatatatatataggttttaccttgcattcgcattttaagagaacaagcttattttatgattaacagaatcattaaaaattttttattgtaagcttgccagagtcctagatttaaaaagttatactcacaccacatatagtctaatgacgacaataaggataaagaaatactgaacttttttaagtaggcttatgtcggtagggatattgatgacattctgaaactattttgtgtttatttaggagagagtaaatgagcaactaagtgaattgatgtgttggacaccaacattttcactgtggaaggagacataaatatgaggaatgtgaggtactggatttgagttgaaagtatcagtatgaagtcatgttaaaatacacccacgctctctctctcactgttgtggttgtatcaactgaagagcctagaagctgtgccatcccaatacgcacacattctctctctctcacttttctagttgtatcagctgaagagcgtagaagctgtgccatcccagccattatgagcatctctcatgcccagatcttcgtttctgaatttctctttccactagaagaaaccatgagagaaatggcgagcctgagatcctttattgcaccaaaagcaaggaagtatggaaggagagctgagggcttgccaggacattggctgacatggtctctcactggtcaaacttgggatggttggaacatcaataaagaatattaatgatcatggattataagtacattaaaaaaacccatatgagtccacagtgatgagagttgggctggagcagggaggggaaagctctgctttataggaacatgccagataacaaatatagaaggagttagagaattagaaactcctcatgttataaccttaatgtaatcaactgattcaggatggatgtgaaaactattggatgagaggctgttgatgttagcacagtattctctgtgcttttgcaatgtagagattggccgtgaccttaatgaagtggtcaggtttggcgtcactaatggtgggagtcctgatgtgatgcggtaggaggatacctgaagcccctgggaagagtggcttcgatgctgccaaggagaatgtcatgaagtacagagctaagtgcaggaactgtttcagattagggagaccaagcagaaataacagccaattgcagtgaatgaaacttggtcggattccatatcgaaacaaacaaaatggctataaaggacatttttgagacaatcggggaaatgtgagtgtggactgtatgttggatgatggtattgaatcaccctttccttttttaaaggtgtgactggataggagaaggtgtttattcttgagagatgcctgttggattacttagggtgaaatttcacaaggtcttaagtccagttttggatagtttggtaaaaggaaagcatgtgtgtgtacgtgtgtgtatgagagagaggggatttgagaagatattaattcttggtgaatgtaggtggagagttatcagtattcaatgctatatcgtttgtttctgtaggtttgatatttttgaaaataaacaataagtaaaactaagtggcatagaaattaatctcttcttttcatatggacacatagagacatggtgctaggatggcatgtgggaaatagtttctgcaagatgagcatattcttcctccactgcccctaccagagaaatgtgaatgctgattcacttcttttgaccagtggtgatggaatagaattttccagtcatgcagttgtacttatttccttctggttctgtatcgataagcttcattcctttttttttttttttttagcttcattctttagaaattggattctttacttagtcaagtctataatcaaaatagactttccatggtaagtaaagtaacatgggagcgcataacaatacctgtcatttatgaagacctactgtgtgcttggcactgtgctgtgcttttatttaagtcttctccattcttcatcatccccacattaccaggaggagacaggctcaggatgacaagtggcttttgcaaggccgcgtggtgaatacatcgtagatttgaaatttaaacccagttctttctgactctaatttacctatatgttcatcctccagtatcatgctacctgtatgcctggaaataaaccattttacatagtttctaatgggattacatttttaaaggaaattcatggtagtaaagatctcgttaacactcccttgatgtatggtatttgagtttaagtgtgaaaagaagacactagcaatggacttgtactgagattcaggaaccctggcttctgcttccagttctctcactgtctgatggtgtgatttgagggccttagtcttatcaaatataatcattggttggtctggttgatatctcagttaatttgggaaactaaaatagcatgacattttcaaagaatttttaaaaagattactgtggcagaagcaagttctgggggtggaggtgcatgaggagggcttgggatagtgggaggtggctggagtaggggctgggttattaggggtctgtaggcaatgttagggcttccaactttgtaaggggcaatgaaagttctcataggttttttacactctaaaataataataataatagttctttaatatcaaatatgagagtcagagtcaaatttccctcatttatactttgttcaaatcaggacctaaagaaggttcacacattgcaattgctgataggcctctctccccctctctctgcccgccctcttcttctttctctctctccccatctccctgtctctctcttcccttccctctctccatccctctatcttttaataacagctgtattgacatataactcacataccgtacaattcatctatttaatgtgtacagttcaatggtgtcttattccattgggctactataacagaataccatatactgggtggcttatatgcaacagagataagtttctcacagttctggaggtggaaagtccaagatcaaggagccagcagatttggtgtctgatgagggcacacttcctgcttcatagatggcaccttcttacggtgtcctcacatgctggaagggcctcttttataagggcactaatcccatccattagggccccatcctcatgactgactaataacccccaaggctccacctcctaatactgtcacattgtgaggaaagatgtcaacatctggacttcaagaggacgtaaacattcagaccgtagcaaatgggtatgaactgcagtcagacagttgtgcaaccatcaccacagtcaattttaaaacgtttgcattacctcaaaaagaggccccatagctgtcagcagacattcctcacttcttcccaacactcccccagctatcggcacaataatctactttctgtgtctatagatttgtcaattttggatactttacataggtggaatcagataatatgtggcctattggcttctttcactagcataagttttcaggattcatctgtgttgtagcatgcatcagtgcttcagtccctttgattgctggtcatcttccattgcatggatgtatccataattgtatggagacaccacattttatgtattcatcagttgacagacatttgggttgtttctactttttgtctattgtgaataatgatgctgtgaatatttgtgtacagttttttttgtgtagacacgttttcctttgtcttagatatgtatctaggaatggaattgctgggtcatatggtgactctgcatttaacattttgaggaacttccacactgttttctaaagtaggtgtgctatttttcagtcccacctgcagaggattccagtttatccacatcctctccaacgcttgctgttgtctgtgtttttgattatagccactctactgcgtgtgaaatgttatctcattgtaattttgatttgtatttcaccaatagccattggagggttttagggatgaaatggcatgatctcatttagattttaggaagatcactgtcaccgtatcaaagaggatggatgagagaggtgcaggcagattaccagataccagatgatggatggcagcagacaggccaaggtagtggcagtaagaatggtgagaagtgagtggattacaggggaatctagaaatactgtccgtaagaatttgtgattggtcagatgtgaggattggggagcgctgaaactgcatttcctgcctgggcacctgcgtgaggccatccattgacagaggggacagagcagggtgggtagtggagagtggtgtgtgcagatctggaggggttgagtttgcatttactatcaagagaggagatcaggagtggtctctgggctggaggcagacatttgggaattgttaatatatatcagcagtatctccagaactgggaatggctgaggttggagagtgagaggaaactaggatatttgagcttacctcttacttctggagctttgtgatgcttttgcccttttagaaaaatgcatggaagtacagttttttactcaatatggaatacagttaaagaacaacatttccttcactttattgaaatttgttgcaggataacatctctgtcaaagcactttacaaggctttctagtaaagtaaattttttgtgtattgcagtggggagaggggagggggttgcctcttgtaaggcagaatttgattggcattatctcttaagtcttcatttccagcaacaatcttaacatgctgtttagatttaaatggtgggtggaccatatgtcatgaagaggtacagtgatagaaaacaatctctaaatatctaacccatttaagtggttcctacaggtttttatgtttttgagatacatgcctaattttggattattaattcttactggaattttgtctgttaagttaggaagaaacgacttataaagtttcctttggttttccccaggaagatacttttataacatgaaatctttaaaaaaccctttagaaaagtggtctatataattcttagcagggtgttgagatcaagtgcttttcttcttttcattttttacactttgtcagttgaagatgtgcaaagaagtccatttgaaatttccctcgggccacttaattcagcttcattacagtggaagtgggttaaaaatgataatcatacagccccaacaggtgattagaaatatagataggatggggccaggcacagtggctcacacctgctcagcactttgggaggctgaggtgggcagatcacgaggtcaggagatcaaagaccatcctggctaacacagttaaactccgtctctactaaaaacacaaaaaattagccaggcgtggtggtgggcccctgtagtcccagctactgggaggctaaggccggagaatcgtttgaacccaggaggcagaggttgcagtgagccaagcatggtgccaccgcactctagcctgggcaacagagcgagactccatctaaaaaaaaaaaaaaatctatatagatctctatagataggatgaatccatgacacgtccttaaaacagttttattttttccgtttcatgaatttagcaggaggatcctattctcactgcaacctctgccacccaggttcaagcaattctgcgtcagcctcccgagtagctgggattacaggtgactgctaccacacctggctaatttttgtatttttagtagagacaggatttcaccatcttggccaggcagatcttgaactcctgacctcgtgatccacaccccttggcctcccaaagtgctgggattacaggcatgagccatcgtacccggccgagatttcatttttaaaaaacatgaatccaagaagtgacttgagttccaaataaataaatttataaatttacttatgttctagaataaatgcaagtaattatgactgcattagtgcagcattaattaacattgctaattctttgtaattatgccaaataataacactaataaaatgtaaatatcaaatgaataaggcgagagcctcccctcctctttttaaagccactatattacagtgtcagattatgaacacacaatattatcaagcttccagatatccactttctaaatacggtctgtgtgaattctaatgaaaacatcagctctgtggtataaatctcctttgccgcctggttcaatgaggggctgcccagcaagccaataattccattcctcagagcattgctgagaatatttatataattaaatatcatctgtttccccatttaattcctggtggctatcccccaaccccctggctgtttttgctgtttccttgggcaggaatggcacaataaagttgctgcagtgctgatggattatcttcattaggtacttgggtgatgagtccccaagcactgctgaatttgatttaccctgtgcaaaggcccaaccttccatagaagcgctaagtagggcaggttttatgcagcttgaactggttggtgtgaagaagaaggaaaaaattaagttgttcttctagaaaacaattttgggaaatgctttggtctcttaggagagcctcctttgcctccttttatacaatctcaacaaatggtgatactgaaagtcctttttggtaagaagaggcggatgaagtgagaacgtggtgagctggagagaatgcaggagacccgggttctgcatctggggtcagagctgaagccaggctgaccttccttgggtctcggggtgtctgcatctgggcagcgatggaacaggactgtggctctccaaggccacttcagctttggagtgggaccttcgtgaatcccgccctgcccctgataaccatgggccctgggcaagtcaccccatctctccccgcctctgacactttgtctttaaaatgggaatacaccacttgttttgcccacttgttacagggtggtccggaggtctgaatacaagagcgcactgcatggtcctgtgcggatcccagctcgcagcaggtgcccacaggacgccgcccctcgcttccctcatgtcctagattctgtgagacacagcccgtgacactttgaagcagggccgtaggaattccgatgggaggtgattagagagaataaacaaagtgacggagttgggcctgagacaggggagtggtctgcggtggaacagtgctggagtaactcctgccactctgagccaaggctcttatttatttttattttggacagggtacttgcagaatcaaggctttgggagtctggtgagtggtcagacccttcatgaatgggattggtggccttataaaagggactccagagatgtctctttctctccttgcaccatgggaggacgaaatgggagtctggccatctgtagcccagaaaaatgttctcaccagaacctgactgctaccacgaagggtgtttaacctacattgagtgccaactgtgcttctcctttaattcaaagcctttgatttctgggggtgcctgttctgatggcactgatgggcaccccctgttgagtggggcaggtgacgggaggaggactggcggccgtcagtgggggctaccatgggggtccagggggcctgtcaaactgtggcacaggggaaacccgtagctctgtgccttactattttactataccatctcatttagtgcccacgatttcttaagaggtaggcactgaaggggaaacctgtagctctgtgccttactataccatctcatttagtgcttatgattccctaagaggtaggcactgaaaccattaccatttgtagatggggaaaccaagggtcacagtggcttgcccaaggccacacaggtcataggtgggagaactcattggagccctccccgcctcagccacgacagtcgtgtgtaaaggtgggttcacggaatatcatggggcctcctgtggtcttaaagtttgcacctctccaaattcctaggttgaaatcctagcccacaaattcgtaagttagtatttggggagggggctctgggaggtgatttgttacgagagtgcgaccctcatgaatgggaccaagagccttagtgcctgcctgaaagggacctctttgcaccatgggaggacacaatgggaggttgaccaactgtagtccagaagcgggcttgtaccagagcctgaccatgctggcaccttgatcttggacttccagcctcagaaccatgagaaatacacttgtggtgttcataagccacccagtctgtggcagttcgttatagcagcccccgccgactcagaccacgctgtaggatttgaagcaggtgtgctgagaatgtagggtagacatgtcatggtggccggtcaccttccattgtcttctctttctaaacggcacccaccttatgggctgctatgagaaggaaatgaggccagtgtgtggactggcgcacccactgttaatcagctgccgctgcttggcccgtttcatctgcccggaggccgttcctcactgacatcagctagtcattctgcccttcaccttgggagggcatcacaccttgtgccttcgtagagaaaaattcctgtttctgccccacgctggaaagtcagataaagccagcacatgtctggaagatgcaagatgaaatgtgaaatcagtatggcattgggtggaaacagaattctactgcacgataatgacagccgagatcaaaggaccgtctatttatcgataagagtgaaggaaggataacatggcagccagaggcgtcatcaaaggggaggatggctggggtaagaccctccaagggggccacaggccctacccagatggacaccgcatgctggtgtggcagacgagggcacagaccagtgtggcccctccgccctttgccccagtcggcattgtcggctgttgctggcccacagctgaacatgctacgtgtcatctagaaccagcctttctgtctccatattctgagtccacaagggacagtaataatgttgggcccacccctggaaatgtaagaagaaattctcttagcctgtcttatcttgtacttgattctttaggtccttctcttaagtttttcttttctgttctcctgttaatctgtctttctttttaaaaccgcatacttacacagctagcgttttattgcagaatactacttttaactggacctaaagagaaaagtctaaggtgttagcaggtatcattctcaccagtcatgaacgattgccattcacagtttaatgttatcctagtcttatctgtcctgacctcatttcttgattaaaatgttcctgttaaatttcctgtaaatccttcctaggtgaaaaatccctccgagggctgcgtatcgcctggggctgtcgtgtattttggcagcagatcccttcccttggctgctggctgggtttctccaagctaatgctgttcggtgcaaaggaatggccctcgttagcttcctgagctttttagaagttttaggctgtgctggttttgaccccttccttcctctctaggactcctgaataggccgaagaaaaaattaaatatttaataaacaacccaatgtcacagagaatgggaaaactcttgggattacatacttgtacccaaatcctaatagactttttatgcttattgttaataatatactatatttgaaagcagagtataatgcctaggacgtagaaggactttaaaaaatgttagtttcctttccctgtagaatagtcaccctcaaccctgggctgcacttaaaaatcacctgagccagtggctcaagcctgtaatcccagcactttgggagacctaggcggtggatcacaaggtcaggagttcgagaccagcctgaccaacatagtgaaaccctgtctctactaaaaatataaaaattagcctggtgttgtcgcagacgcctgtattcccagctactcaggaggctgaggcaggagaatcacttgaacctgggaggtggaggttgcagtgagccacgatcatgccactgcactccaccctgggcgacagagtgaaaaaacaacacaaaaaactgtattgatgtctgggctgcatcctagaccaattaaatcagactcttggagagtgaagtccgggtgttaatattttaaaaaggctccccaggtaattctaatgtgcggcctaggttgagaagatcagctcttagaagaatacagctggccgcctttttgctttatacgttttgagctgctggcttctaattagagttaatatcattacaatataatgcctttgttttacattaaatttaataagaacaaccactctgctctccaacaatatagctactttctctggcttaagtgcttctattctttttttaaaaaacaaacaaacaaacaaacaaacaaacaaaaaactgagtttccgattaaaaacccaagcttaggccagaacagaacttttgaactgcagtcaaacaaaattttagataattgttttctaatggcttcctgacaaatggagactaaagacaggcaagggggctaagaccaggctgggtggggagaggggacagcagcacgttggtacctgggtcacctgccagaaaatgagtggcagtctgtgcccaggtggcttcaatttcctgataaaatgaaaaagccatgatatctctgtagaccgagtctacgtcctaacccccaaatcaggacacatagtcttgtaagtgggagagtatacacgtggacattgtagctggaatctgagcctcagtttccccatctgccaattggaggcattgcagagtcctcctcaggattgcagcacgggtgaaaagcttgctgacaaataaatgcttcctatgtgtcaaacaccattctcagttttaaaacgtgttaaataactctgtgagcagttaccttatcacctgtcttatactgaggaggaaatcgaggcacagagaagccaagcagactggcctggtccctggaatagctgggatttgaacttggcagtgattccagagtctgggcgtaaaacatctgtgtccagtgcacaaggtacccaagaccgtgtgggcacaggatggaccctcaaggcagcgaatgaaacccggggctggtaaggtcaaaggtgtgtgagcagcagtgatcccagcttcactctggagagccagggcagtctcacactgggtatgaggtgggtgggtatggtagtggtgatggtgttggtgacaggcttctttagaagttttggagcttttggtttctcaggtagcaggggagaatgaactcagaatattattaatgaaattatctgtaaggttgaaatgtacaggagtgcattttggcataatggtgtgtatgtgcatgtgtgtttttgtgtttgcataactgcatgcacgtgtatgcatttgtatgatagtgtgtgctcatatgtgtgtatgtgtttgcatatgtctgtgcgtgtgtatgcatttgtgtgactacatatgttatatttacatgactacatatgtgtgtgcatgcatatgtgtgtatgtgcatttgtgtgtgtgtgcatatgtgtgtgtgcatgtgcatttgtatggggttgtttgtgtatgcatgtgtgtttgtgtgttggagaattatataacaagcgactttgtctcattcttcagctttgcattctgtgggctggggatctgcatttttccctccagcctcttgtattacccaagctcactcattcacttgatcatacttttacaactctgtgacatttttaccatcttagctgggcccttgcttgttggtggttttgcccatttctaggtgtgtggcctccctggccctcatctgtcagcagagcccatggacttaccccagaattgcaaccctggaagcatcttagcatcatctgggactgatgcccccatacccctaattaaatcaggccctctgctcgggagccatgatgggtctagtgtattcctagggttgagaaacaactggctgtattcacccaacctatgagaagaggatgaggtgacatggagaagtcagtttacaagagctggagcaaagtgcagagccaaatatcttggcgctgggctaatgatgcccttttcattctcccctcttcttcttccctcctctccattctcttccaacactgcttccccaggtcccctctcccatgccaggaattaaaatgttttgtctggaaacaagtgagcttgactaacgtggccgggctcccactgcagctgagttctgcatgttctgatgtcagtgttgtgagctttaactggagattggtgtccaaaggcagccgatactgctctgtccatttctgttgtgctgaaaatcacatggaaaccaatcacataatgatcttgggaatgaagtattcaatgcacagtgttattaacatgtaaaagacttagggcaaatcacttttaagtatgacaaggcttcagatgtgtttggtttgagtatagggaaaagagtttggggggttgtttatcagcagtgccatgagggaggcttatttcttccctttaaatctggatgaatatgcctgtgtgcgccgcatgataataacaatcacgccagccaggagattagctgagcttttgctctagtaattctagcatgcaaattcaaaggactgcagaggaggcaggggaggagcgtacttagcatcttttgctcccctacatcctaacctttgtgctgtgtcttaggttcatcttagggacggctgaacgtgaaacctccatgatgtcaaaagcctggagagttgggtccatgcatgaatgctgatccactttctctcatagtgagatgtacaaacagaagggtacataaaacttaataattatagaaacccatgtaactacccccacccctaaggaaaaaaacattgccactgccctagaaggccctataccctgatgttatttaagaaaatggaccgcggaagagaggcacatgggtggccaggaatggagaagctctgttaggacttgggcatggcacttcttgactgtttctgatctttatgaggcagtagggattctggaacccaacagtttgggttgcaatctcatctatgttacttactagctttgtgtccttgggcaagtccctatgctccttgtgccttagttttcctatctgtaaaatggagataataaaagtgtctaccttgtaggataattgtgagcatatcaagtgtgttaatacatgtaaaatcattaatacagcatcaggcacatacatgttaactactattactttattaataatcttggttctaaaaccttgtgttgttttatatgtggaattcccagtcttctaaacagtatctctctctatagatgactgtattatcctggtcttccacgtcgctggtgtgctatcatccctggccaactcagatgtcactgggcatctccagcacagccactgttcttccttccactccatgcagaatgtggcagcctggcacacaaataatttttaataaaattttagtgtataaatgtggtttttggaaagtagggaggagggaagtagcattgatttaatatttaaacagtaccatttaaacctagtagcaaaacccctatacgataatgagttgtagtctattttacagatcaagaaagtgaagctcagagaagggaagcaactggcccaatgtcacatagctagtaagtgactcagctgggattcgaccacacttctgttttcagaagtgcccatcccttgcggggatttgagctctcacagcccagcctcccatccttgcaggaatccttccttccacactcccaaaaactgaccatgtaggcttcactaaagtaaatcataaatttggaagtctaggacatcttgaacatgctaaatatgtatcaatacacctgatatattgtttccagtcacagataattccagttgattttcaggcatgtgtagatactcatgatataaagattgagttgttactaatcactatgaggcacgggcaggtcttgaggtagaacctcatgaggggaatgttataagtacttttgcattcgtatgattttccccataaccttctctcatgctggcaggagatagctctcttttccaaattctcaagttggcacagttatgaaaaccttctaggacatcagtgtgatgatgtccagagacaggggcagactcctgatctgtggctgtgcttggtactccctcaccccttcattggtctaatgggccagctgaagaatttacacaataggaaaattggccaaagccttaacattgttaccaacctgcatttcttcatgaagaaagcacaatacttgccttaactgagggaagtttcgcaggaaggggtattcagctgtgtgagtatgtgctctgattcttgcctgtttctcagttccctgtgtgttactgccactttcatttattactgtttgcttattttagagctatgtaccttgcaccctgtatgaaattaactcaaagtggatcataaacctaggtgtaaaacataaaaccatcaaacttcgtgaagaaaacattggcaaaaatctctgtgactttgtgttaggcaagtgattcttagataagacacaaaaaccagaagccataaaagaaaatgatagattggacttcataaaatgaaaatgttattcaaaaacattgttcagaaaaatgaaaagacaaatcttgcccatgttcattcccaagcatttcattttgtctgatgctattgtaaatgataccttaaaaactgaaaaattcctaaccattcatcattagtacataacatttgtttttaataattttattttttaataatttgttttaataagttttgtatgttgaccttgtcttctgagacccattaagctcacttatttgttcttgtaacttttttgcccattccttggtattttctttctttctttttttttttttttgagacggagtttcactcttgtcacccaggctagagtacagtgacgcaatcttggctcactgcaacttctacctcctgggctcaagtgtctaccactacgcctggctaatatttttttttttttttttttttttaagtagagacagggtttcaccatgttagtcaggtagtcttgaactcctgacctcaggtgatctgcccactttggcctcccaaagtgctgggattacagacgtgagccactgtgccgggccttccttggtattttctatatggacaatgcttgtctccctccaaattcatatgtagaaacctaatctccaatgtgatgatatcaggaagtggggcctcgggagatgattaagtcataagggtggagcccttaggcatggagttagtgctcttataagaaaggccccagagagctgccttgcgccttctgtgatgtgagaacacagtgagaagatagccatctatgaattaggaagcaggtcctcagcagacactgaatctgctggtgccttggttttggacttcccagcctccagaattgtgaggaataaatgactcttggccctccatgtctgtcagttctgcatcagtggattcaacgaaacttggatcaaaaatgtttttaaaaaaaacacaaaaatacagtgtatcaaccatttgcaaagcatttacattgtattaggtattgtaagtcatctagagatgatttaaagtatatgggaggatgtgcataggttacatgcttatactgtgccattttatgtcagggacttgggcatcctcagattttgctacctatggggttttggaaccaaccccttgcaggaactgagggacaactatactgttgtttatgagccatccatttttatggtactctgtccaatcagcccaagttggctaagacatagatgatcatgtcttctgcgaataatgatagctgatttcttcctttgctatctcaatgaattttacttccttttcttattgtgctagctaggctctccagcatgatgttgcataggcgtggtgagagtggatatcttcccctagctcttgatccgaggggaaagcagtcagtttttcaccatgaagaatgatgccagctgtaggtcttttgagagcactgtcatttttacttttatttttggcacatggatgggaaggctaaagacttgcaactgactttcctcctatacctttaacattttgctgaatggtagagaaagagaagctgggccagatgtagtctggttagaatgctgctggttgggagtgagtttgaatatgttttagaaatactttgtctttctcttctatgtgccattcctcttagtctgttcttattcctgtacactccctagtcctgaaaaaagtagtgacagacctgacattttaagagcactatcccaatttaaactgtactttttttttttttttttaacagagctttaaggaaatgaacagctctctacattttcttgtatttgtagcaggaattctgatcaaattttcaccttttagtttccgtgagagaaaacaagggccttacacctttgatgataagacatcaagtaactgttactactgagtaaaatgtaagaagaaatatactttttaatttgtcagcattgcccttccctcagtgaccaagttgctgcacatttgatagcacaggcaaccacagcaaacgactgatacggacttacccagttaattacctaaagattatattactggaaaaagctaaatcatcaactcaaccatgtgtaaacactttgaacatcatctttaaaatgtctttgcagtttgtttaggtggtagtggaatttgtacaaagtatcagtcattgtaatagcattctaataattctgttaacaactgcttgaaatcagaaagtattatttctgttgtttagatttgcccaagcatttcttgtgtaatgttataagctgtttatgtgcctcttaatagatgagagaatgcactatgtgaagtctgaagtatctgaagtaggtaatggaaccagaggaacttaggttatgagatgggggtatataggtaatatcccatatatcatagtaataacaagacatagaaactaatatactcactcccagatttccatggggactaggaggagcctccattgtagccggggtcaggaatggcagggtggcagaactacagatgcatgctccctccatgccaatgtgtggaaagggagtgacggacaaaggcagtgggatctggtcacgggagtatgggttggtgtgtgtcaccctgcatggggtatgatactgggctgctacaggagctcatggattccagatcagcaaaggaatgccatttaggaggccttgggaggtgctgatggggttggaggggtggcaaaagccagaaaagatgggactggtaggaaggacatggctcctgggcttcattctggcgctgtctctgaagcttgagcggaagagtccagctgtggtcagtggaagtagcagggcaggggagggggaggcaaaggggacgcaggtttctagcttggaactctggctgatggcagagtattagcgtaggggcggaggttagggaatatgccaattagaccagtaatggagggaatatttgacctaaaaataaaagatagacttagaactcagtcttaagggggcaaaagaaatggctccacttgatattgtaaataccaattggaagttggagtgaacttctaagaatctagggcccaaagtctcccatgatggggatagtggactcaccagagatgggaaaggaggccaggtcactgggcagcagggactcaggttgcctgtagctcaccccttcgcttactcggatcttgattcatttgttgggccatgcataccaagaaccgattatgtgccacgcataggtgctgtgttacaaagatgaaagtgagtcttaaagaggttatgtgtgagaaggggacagatgggaccagtcattctcagcataacaccgagtggaaataaccatgacacagattggagcaaagtgaggaggtgaagcagggagaggatagggaagaagaatattctaggtggagagaaagagaaagcatgtataaagaccatttaaaatagcacacttctggagggccacctttttctcacagcaatctgggtcttacagccctttttctgttcaaagtcttccttaatacaaactgttttatttaaaatcttagtgcttttggttcgactatgtgatctttagctttacagtgagaaggcggttaaatgccagggcccctctgagccgaaggctctccgtgtctgcctgcagcctttgttctctgccatgtaaaagatgaaaaattgtgtcagcaatatcacacccagttactgtgaaatcaaggaatcgctctggtgaagaatctgggggtgaagaccagacaaatcgaaacggcttggcgtcatgatttaactttgtcaagccaaagagagggctcgtgtttcaatagttagcctcaccttgcatctatactgggccaagtcttctttccgtgaatcctgaaccctgaaggaatcggcctcctctggctggttttaggcattgcccataaatcgaggctacaactgttctccaggcatctccctgacacctcaaacgtatgctcagcactccttgggccccatgcccaggaatctttccgcttgtctcttttccgggcttgcagccaggctcaacttttcaagatgttgtcttccaaatcctgccttgattaactcaatctgcagccccttctttgtcactgttttcttgtcactcttttggtttctcctgcagtcatctgtgtgcctagtctgtcccatcttaggcatttgcaattgcaaatgactacattaacatttaattcacaccaggcagcatttgtctgctgcataaagacacacctggactgcacggaagactgaggacctgggctaatggtcccagcgtgctgtgggtttggttggctgaggtcagcatccacattgaggtgggtgggcctgggcagatttctaagacaagacaagatgtgaggactcgtgtctacatggtatcttctagcttggaactctggctgatggcaaagtattagtggaggggcagaggttagggaatgtgccaattagaccagtaatggagggaaggtttcggggaaggaggttagaagcagccttagctgtctgcacattccaaacagggatttgagtatttgttcctggatattttggtgagggtgtggagaggtaggagaggggagcctgcttccaactttgtaaagagagagaagatatgaaggacacagatagaggagcttgctgacagctagaaaagagaaggtgagccgagcagatggcgtgcaggtgagcgaaggcatggctaggggtggactcgggatggaggagcccaggaggcttcccgggagcaagtctatgtgtttggtgtcacgcaaccatgcttttcccacaacccttctgtcttgggtcttgtggcactgtcttggttctcttgctgcgtccactggaggcctcttctcccatgacttcccagctcacctcccctctgtgagctcaggccccagcctgcagtcctacgttcttcgcactctctcagcttcctcccctgagctcatccaggcccccagtctctgttttcacccctctggagcagactccccagcctgtctgcagtcttgtccccatccgccctcttgctccatctttcattgctggttagacgtgtctactgctatctctgtcacctccggctcagcgtgctgcactcagacatccaactggaggagtccatgagctgacctcagagatgccctccgacgctgagtttctttgtcaaaaaacaaactcttcactttcatctcttcaaatggcattttattctgtcctctggtgtctgtcaatagatctcatctccccagacaggctgccttcagcttcccttcacagccttgccgatcttgcccctttccctgttaatccacacagccatcacttctgaacttaattcctatagcccctgacgttctctgactcatccgtcccttgtgatctacccgaacatgattcaccatccacatttctggttctactctacctgtctagcccctttcccacaacttttctgcactcaccctcctctactatggccgtcccggtcacttcaccatcttggagcacctggcactcatgagatgccacgatggtcacactgcatcccttccctgaaaccttcccagcctgtctcggtcattccattgttttatttgacttcctctagaatcgataatctctgctacacaatttagcatgtaaccgtatatgctcagtgttccctttttgaagtatattggtcttatctccgcaattggaacatgtttaccctgttggaacatacgctgttatcaagtcacaacgatcattatttttgctttccccaaagtgtcaagaatgtaacacaggatcaacaagtgttgactaattgataaccgagattccagattaaagacaaattttagtctgatgatcttaaaagtaattatgctgggtggaaaataccctcactttgggtatggttaaaatgactatcttgaatatctcattaagaggataatgtctcattgacatttatactgacagcccctagcatggagccttacgtactggctagtgtgttgaatgaatacctgacttatttaagcttttcactttgaagatgtttggtagcatttccatccagtccttgtacataggtaatcattgtcacggaggaccaaagggtcttcaaaacctgtgatgccaagggggcattttactttctccttttgtgtgggtagccacaactctattcgccgtttttaatatttacttttggctttatcactccatcaagttgtttattttttattcattccttacaatagatgtagcagaatgggataaggcagcatcattttcttccattccattttatcttttatcagcatttagttctcatgtatagcttttcctgagtcatcagtattgggctaatggactggaagggcccaagttgaatggtaattacttactctgttgctgatagcccagatgagaataggacctattagatctgtaataatggaaatctgtgtttaatgcagatcttttaagcagtttgaaacgatctcaaattcatctctctttgccatatgttaaaatgtcacattatggttttaaaattcaggatgagaactgaagtttcaggagagcctgcctgtggaaaagtcctcaaatctgtcctttttaaaatcagaagcatttgttcatctcaaatcaagcctcctcagagatgccagctctgtctgggcagtccgtgcaggcagggtgagacgaagaagaatagggcttagttcacaaggatctaggacagaaggggactgaggggatgtgaggatggtggactttgtgtggtgccaggaggcttcccagaggcttgggccatggattcagtgaatgcattcaagtcaggagctcctttgtttccttcttcatggtagggtccagggctgaatgctcacacttgtgtatcattagctcatctcctgtttcagcagcagaagactttaacttttccccaaatactgctttcttctttccccttttcgtgtgaagaataaaggtacagaaatttgacccaagatacttctgtgcaaaggccatcctctttagattccagaccagacttacgaagtgaactggtttacacaggtcataggtcaatcaatgctggaatgggtgctcagagcagaacctagtccccacccagggctcctgccatcactctcagaagtgttacaactggaacttctggtcatcaggattgttgtgtttttgagttattttcaataacctgtatcattcttcttgtctgggaaatggccctaaataatttagcttcctcttagtacagagtcttgtctggagacatattgatgggggctgtaacctcacccagtttcataaatgaagcaggttcatgatggagctcctgtttctcaatagagaccttagaatgagaaatggttctcaagacttgttcagtttattacgtgctgtttgctgtttgattcaatgagtctcttgtatctttgcaaatggtagatgtattgagtagtactagtatggtgttgaaaaagttggtactggtgaaatgttccaaccttgaacctcctgtgacttggaagagtcttcacagaattcaggacagacaggtggtgctgattcattggtgggggattggtttatttcccatagttctaaattatgcactttgacaactcaataaacctgatgtaactgacaacacactgatggatatggtggaggataaagaatatgattatttgaatcaagatgcttatggtatggcatcctagagtcgattgctttttaaaagattcttgagctttgataactttttgttgatacattttctttgagttcagcgagctggcttcatgagtgtgttgttatccacctcttctttgggaggaaaggattgtgttttagtacttaccctgatggctatagaagtcactgtttcatatgctatatcagaattgacttaaaaattgcatgtaggtatttgctacatgttttggtgacatgatgtataccattaaggaaatttaagatctttttgatcacaaagttctcagcttacatctggttatttgttggcgttttatttattggcaagctttttctagcagcaggtctatggacagccctgaaatttctttaaaaaccagtcttggaaagaagaaaagctgtggatgcttagttgaaagttcaagttacctgcaaaacatttgtttcaattgaatttgtctatctatagttgatgtagagtgggattttagggaccagggagtgtctccttggtcctaagttaagaaaacaaaaataaagtgacttcactagaattactttgaaccaggtcaagaacctgttcatctcactgtggggtttatatcctccttaccgcttcacctgcctcttttttccaggacaaatattttacatctgatcacttcctaatgagtacatctattcctgagaatggcaaactttgtgattatatcagagcaagaaatcttatttgtaaagaggctgcctaattatccatgacatttaaaatgtctgcattgtccttgagctaagagtgtgaaaatcaggagacccaggggtgtattcacttcctgatagatttcgcttagtttaccatactctgacagtaaaaatcaaatgaatctgagctgcttaacattaacattccaggccggacacggtggctcatgtgtgtaatctcagcacttcgggaggcctaggaggggagatcacttgagcccaggagttcaagaccagcctgggcaagacagcgagaccctgtctctacttgaaaaaaaatttgaaataaaaacaaaaacacaataacattccaagcaggaaagtaattgaaaaaaactgctatcatccatattgctaattttataatgcggaaactaccacagagttataagtgcagcgatgaagatataatagacatatttttgtgtaagaaaaatgaaaattcaccttagtgactgaaagcatagattgactttgcatagacatcagtgtcaataatgatcattttagtaactcaggttttgtttcttcagttgaaattcaaagtaacccaggttcataagtaggctgtgatgttgaaagattggaaactctcaattttgtcaaagattggaactaggttgagatactttggaatgttttactagataaagaggcagggaaataaaataactgttgtttcctgtgatttgagaactacaggatggcaccagaatctcagacctgcagcccagtgaagggattccttcattaaggctcttgttcatttctttcttggtaattttgttggttttctgtttttactagaggaatatgactcttaggaatcatacctgcatgcaaatttctgatgctctgttgattcgtgagcactagaaagagttaaaactccctatttctcacaatctcccccttggcagagttcagttcactgatgactatggtgagtcagtcagtgccccatcctgtgtcatggcatcccacaggacaacattatcttttaataattgaattatttttgcctctatagtaatgtgataagacagaatcatcatctattttttaacatatagcaaaattacccagttttttgaagaagctggaaatacttggatctgcatgctaaataggtaccaaggacagaaggaagacagggttcatcttctctttctaatcgtgggactttgggctgtaagggttggtgtcttcatctttccagtaaaggggtgggactgagcaatctccatggttactttcagctctgagagtcgatcatttataattataatgcatattgcatctgtgtatttcagtcattctgaacagaagggtttttgtcttggcaaggttttgtcttggaatggtgtatatatttttgtggaatggatgctttctccctaatgtctggcaaggtcttgtcttgctttcttctttgttgacattcctggtttctggtccagccctgaatcgacccagctgatggggcatattaattgggagcatgggctgtggagttaaacagacctgggtttatgttccagttccaaacctcagtttatctggctttctcatgtgtaaaatggagaggatgctgactttgtgggttgaggtaagatattcaatgagaggttgaaggtaaagcgcttagctcagggcctgataccttccgatgccttcctggtttcctacacctctccccatgtaaagatttttatttgcagaaatgtcaaccccaaagttgttctaagtgggaaaactgtttcctctacactcacaaaacatttctgacaccaactgtatagattttccacaccaagccattctccagttctctgcagacaccaactgggtgtctaataattcaattcaattctggcattaacgacctggaattagaccccacagcttaagggactcagtccttcaaggctgcccccaacttcagatgccaattgcaagtccccaggttgtcacctgcacttctctctgacttgactacctgactcagtagtccacacaaccccctccttaggtttgataatttgctggaatggctcacagatctcagaataacagtttattatatttactggtttattgtaaaggatacaactcaggaccaacccaatggaagaggtgcataggtcaggtatgtggaaggggtgcagagcttccaggccctttggggtgctaccctccctcacagcaccctgatgtgtttaccaacctggaagctctaggaacccattgtttagggtttttatggaggcttcattatgtaggagtgattgattaaatcactggcctcttccctcctcagaggttggagagtggggctgaaacttccaatcctctaatgacctagttggttcctccgggagccagtcccaagccacctggagttacctcattagcataactcaggtaaggttgaaaggggtttgctatgactaacaagatgctccccttacccccatcactcagaataccaagggttttaggagcgctgtaccaggaaccagaggcagagagcaaatacatattcctttttgtgtcataattgtatatatttcgtgtatttttgtctggtatcagacactgttggaaattgtggtttagtttacttcagttgttgcaccgaagaaatgtacaggaaatcaggtgtttttggaagacactggattaagagctgtactaaaatgctccatctatttcttcactacttccaaatgttgccacatttttgaaattggaaaattctgttttagttgacttcctggactttacctcttgtgtatgacttcaatcttgataacgttccatgctagtcttcgtctctggacttctctatcaaatccaccgttaacccatcaaatatttattgaactctaggcactatcctagaaactggagataggtgagaatgagaaaaattcgtctacagctcccagtaaatacttgtccgcagatgggaggaggggacagaacataacctgtaagcagatatattataatttcagatagtgctacatgtttcaaagtaaacttaaagcagaaggcctggcagggagcagaaggggatgctattatctagagagcaagggtttgagtagaaacctgcatgaagtcagaaagtgaaatatctgcaggagaaatgttccaggcagtaggccagcaagtgcaaacaccctgtgggggtaagaatcttgagatgatcaaaagacagcgtgcagtatagcttgtgcacacgtaccctaaaacttaaagtataataataataaaattaaaaaaaaaaaaaacaatgggagaggaaatgaggccgaagacccatcagggatagattctaggggccctgtaggccaaagtgaagactgaaatgtatcctaaaagtcatggacaaccacaggaaacatggaagctggggatgacatgattgtatttacatttaaggcaattactgaggagaacagatgggtggagaggagcccagagagagggcaagagtagagtcaggaggcaattcactagcagaggaaatagatgaacttgctgggtcatgatggaggtggtgagaagtggtcgtggtccagacgtattatgaaggtcaagctggtgggacttcctggggtcacatagaggtagtctcaccaacagtgttagtgctctggagacctcacttctacccttgggtcatgtacctgcatgggaaaagcctttatcctgaccccaagtgccttggctcaacttcgtgattggtgtgcattttgggtgagtgggggtgagcaggagattaagtaagaaatttttttttctcttcaaaatacagacatatgggtgaaatacaagggtggggcagggagaggatatagttctcttggtacatgaccccatctacagctcctatctggatctcttggcttagctctgacctcctaactttttgaggctggggactagacagggaggtgattgaaaggcttcagggacttgcttggtttatcctctaagctgcagcagctatgtcaggtttcctgattcctgaccccaattccagatattcctttatttgacttacagaatgactaagaatatgcaaagtgagagatgaaggtgcaggctgttaaggccaagagtataaactaaactgtgtgtatcagttacctcttgctgaatgatgcatcacataaacctagcaccttaaaacaacacacatctattctctcacaatttctgtgggtcaggaatccggacacagctcagctgggtcctctacttcagagtctctcacaaggctaccctcaagatgttagataaggtggagagctcatctgaaggctcaactggggaaggatctgcttccaggctcacttgtgtggttgttggcaagattcagtttatttatttatttatttattttttatttattgtgggcacatagtaggtatttatgggttacatgagatgttatgatacaagcatgcggtgtgtgatcatcacatcatggagaatgggggagattcaggtttccaagagccattgggctcagggcctcatttccttgctggccatcgcctggaggccacacccagttttttgtcacatgggcctttccaacatggcagcctgcttcatcaaagcaccagagagagtgtcctagtcacagtgctttgtaacttaatcacataagcggctgtcctcagtgttgccatgttctattagtgagaagcaagttactcaaggagaaggctctaagtgtatccagctgaaatcctgtattttctgttttccccctttacatcagcatgcctttgaagcagataatactgtgtagaccaagtctttaaaatagcacattccatgagccaaccagccacctcacctgcctataacattttcctttatcgtctccactgatgctatagctgaccatgttaggaaccctcatgttatagcttagtttatcttaaatcttgactttgtgtttgctcttagctcttgaggactatttgccttcctagacttggtactcccttgactccctcagtcccagccaggagagtgtcattttaggccattgtcacactaggatgtaggaggtgataaagacagcttagttaggcttaggaccaaggctgtgtgagaaccaaccgaagacagacctgcaatgtgtcatctggtacttacggcctctgtttgccaggggctaagtgtgataatgggtcagaaagtataaggtttacaaagtagctgagatgccacctgggacctactattaaaagccagggcagaatcctacaactaggaggtcataacagtgcttggaaggccattgaagctacagtcaggggcagaccaagggtctgggagcttgaagaagtggcggtcaaggcaaaaatggttcaaaatatagaagttcagattgtggagaatagcaacattagtaagcagagagtaggagacaggctgatctctggctaggttatttgtccccacactttcttttttcaatcttttttcccactctaccctggaagcccaggcctagatacagaggcatagtgtttttctctgcgagctaaagaggacggtgtggcatcagggtgacaagctgagctggtggtggtggtggtggtggtggtggtggtggtggtgctgctgctgctgctgctgctggtggtattggtagtgatggtgttgacagtagtgttgttggttttgttggtataggtggtgttggtggtggtagtggtggtgatggtcttggtggtcttggtggtggtgctgctgctggtggtattggtagtgatggtgttgacagtagtgttgttggttttcttggtataggtggtggtggtgttggtggtgttggtcttggtggtgttcgtgatgttgttggtgttggtagtggttttttgttggtgttattgtgagtggtagtgttgatggtcttggtggtggtgctgttagtgttgatagtgatggtgtgttggtagacttgatagtggtgttattgttgatggtgttggtggaggtggtgttgttgccattggtggtggtcgggatggaagtggttgtgttgatgattttggtgttgatggtagtgagcagttccctcactgctctcttacacagccagcctcttaaataatccccactcttaccctctaagccccaccttagacactaatacattctaaacctcttccaaagaagcagaaagaatcagtttcctgcctgggaacagtaaaccttgataactactttctctctagatgtaaaaggtttggctggtgttattctcggtgaaaatagcagaaaatccttctctttccagactgggattaaatggcttgatttacattggattctagggttattattatttttaacacttccctgatcggtttttttagaaactagcaagacatttttaaggatgaaggcatattaaaaacaactctaaggatgccttgtctgatgcattcagcttgcctcgtccatctccccatttgttttcactgatctacttaacaacttgtgtagacaggtagagcaggcatgacctaaatttggtggatgaagagatctagattcagaaaagttagtttacatgtcaaaggacacacagtcgtataactgacaactgtatgcaaccaggattcctacctaggtcttcccactccaaatccagcactcacattgtactgaaaaatagcctgattttatcacttgacctgtgaaaggaaagaaatcaagggtgaacaaagggagagaaagtaaatgatgttgaataaaacatgagaataaacagtttgcatatgtagccttttgatctttattgcagggctgagacccggttcttaactgttctttcctcatgccttctgcttttggtaaacattcccaacatttaccatgaaatcctctctctcaaggctgaagggctgctgctccttttgcagagcccctgctgatctctcatctctggagatggctgtgcccttagcgaatgcgaatccccctgtggacaattggtgactgagggacagctgtctgcaaggggcatttcatcagtatgcatcacgactggggcttggcagtcattagaattcattataaattactctgagtcccaggaatctcatttagttctccctcagcagctggaagatgctaccagctgtggatctagggtttcccccaaagattttacctaagcattgtgggtaggggcaaataggcaaaacgatctgatgatgagtgggtggggtaagatggacaaccctgtttctgcctttctacctcagagttaatgccctgaagatgccactgggggaatcagctctgggcacagcttaatccttagtgcttctggtgggccgaggaatgctcaagggtgtctttgtgagtcattgcgagaaggtccatgacagaagagggaaagaaccaaagagagagcaatggagaagaaagtagcagatggttctctgtgatcttcaagagccaggccctggtggtattttctgtttcagctactgtgacgctttttgtggaatcctggatgaggcctgaactgaccattcactcagtcctctggacctttgagtcctgtgttcctacggaaacccactcatcttgcaaggctcaactctaatgccaggaccaagtgctttcgtgtgaatcaccccttatgattctcacaacagctccataagataggggtaatttccattcattttttttttcagagaaggaaagcacaactcagaggggttattgacctgtgcaaaggaggagttctgggttggggggagtggaacccatgggagctgcacactcagttcctttgtcccctgaccatggcactttccacacaatactgcatacgtatcggaacagcgtgcctcttactgatccttaccgtgttggaccaggacacagtggcaaggtgagccaggttggccttctgtgctcctggcctttcctcacgtggcccttttcctatcatgtattcacctcttcactgaaagaggtgcttccttgtaacctcactttgccatcctcttctcatccctgttctaggacaggggctggcaaacattttctataaagggccagatggtaaatattttaggctttgcaggccatacggttcctgtcacgatgactgcactctgccattgtagagtgaaggcagccatggacagtatataaatgaatgagtgtggctgtgttcccattaaattttatttaatgacactcaaatttgaatctcttagaatttgcatgtgtcatgaagtacttctaatggttgttcagccattaaaatatatgaaaaccactcttagctcataggctgtacaaaaacaggaggcaggctggatatgggtagctggccatggttttgccaatcccctgttctataactaattgagtagtaatcctttacctttgggtaaaatcatcactgtgttagttctcctgaaagcgcatacaatttaaacctttaactgcaggtgaaaggctttgttgcctcctaaagggatttggggtagtagtggctgtgatgggtggggcggggagaggtcacaccaagcagatagctgcctctgcctaacataacgttagtcctgccgtgctgctattgtttttttcagtggaaatgttagatttaaaacctatatgtcatttgtctttgagctctgtatggagaaaaagatcttgctttggtttttgtaaaaataccagccttagatctttttgtgtgagctgtcatcagtcattccgattgttgatcttgtaaattcatgctttttagtgttggcagagggttgcctttgtttctgtacaatttcatgaagtgtttctttcaattgggacttactttgagcttaactggagctatacttttcatctcaactagattttaaagacatgggtacctggcagcatgctacagaggattgttttagaatctttcctcagtgtgagaacttcgggaaatggtacgaccagccgctgattgagccccctttgacatttggtctccacatgatccacagtgactgagcatggcttgaaacttggccggtgatacctggagtgtcttgaagggtttcctttttactcattcttggatgtgtcctggagtaaaaatttttgtattccactatttgtggaatttggaaagaagcacaggaaaggaaatggagatttaatgaggaacttgatttacaccggtacccaagctaccttccaccaccagcttctgccgcatgttgtatgttaggaagcttactaggactgcagcagctagagtactgtgcaggtgcctgacttacacaaccaccctttcaaaaatcgttccacagcccaaggcaacattgacttaatacatttctcaacaaactgaggcctggaaatctgagaaataaataggtgggctatccactgtaatgacaaggcatgacttcctggtttgtatttcttcccatagtgttttgattacactaagcgttaccggcaggcaatagttatttgctattattgtttttaaattaatcctagaaggtcctttaagtgtatttgataaacatcatgttacctgccagcaaggaattgtactctggatatttctgtcttcagaggtagttctatagtagttctgttgtataacagaaagaactatcaattatttgatcttacagtcattatacatgtagactataaattcatgggatttaatttaatgaacaggttcctgcctcagaactttgaacattatgctgtgggaaggaaaatcttttcaatttgctttacagactttgagtatttgtaagttcaccttttaaacaattagggaatatttacatgttgaggatttctcacaagattaaaaaaaatacttcttttgaaatagttgaagactgaagagaagctgcaaaaatcgtacatagttccaatgtgcctttacaccagcttcccccaatgttaatatcttacataatcagtgtgttgtcaaagccaggaaatgcacattggtgtaatacttttaaatacagatcttatttggatttcaccagttattgtgtgcactttttttggtgtaagttctatgaaattatatcacatttgtggatttgtgtaacacagatctatagaactgttcatcactccaaagaaacttcctcatgttatcgtttaacagtcacattcctctcataaggttgtgttcagactgtttcgttaggatgtcaaaatagcaacaaaaacagaggtggattttgagaaagtatttagttttcagttgatttccacaattacggatttcgagtgaatgaaagaaaaagaatggggaactgtattcaggttgtgagcactttcacatttatagctacgatccatttaaagttaattgtcgtataaggtttgacgtaagagttggggtttattttgtcccatttagatatacagttgttccagcaccatttgctgaaaagactgtcctttcctgattgaattatctcagcacccttgtcacaattaaatcctgtcttctctattctgttccactcatttgtagaacttatgccattaccacactgtcttgattactgtaaccttacagtaagtcctgaaatcaggtagtggaagtattccaactgatagttccaaattgtttttgctattttaggtattttaatttttcacttaaactttagagtcaattcatcaatgtctacaaaaacctttctgaggtttccatcagctttgtgctgaactacagattaatttggaagataattgacatcttacagagtctttcagtttatgaacatgatgtatctttccattgatttctatatgctttaatttctctcaacagtgttttatagttttcagggtacagaccttactgacattttattaaaaatctccctagtatttcatgttatatgttgttattatgtaaagtacttcttttaaaaagaaattaacatttcatttgttgctactatgtaaaattatagtttatttttgcatactgacctacatttggtgagcttggtaaactttttagtacaaatagcttttttccttaggattttttacttacacaatcatgttgtctgcgtataaagtattttccttctttcatttttgtacgatttttatttctttttcttgccttttttgaactgactaggacctcactacaatgtcaaatagaagtagagtgagtgtaaaccctagcttcattcctaatttaaggctgagaacgttcggtctgttaccataaagtatgatgcagctgtagctttttagtagattttttttattagcttatctcccttgttgactaaaaaaagttttttaaacacaggtaggtattgaattgtatcaaatgcttttttgtagcatttattgagttgatcagattttttttcttttttagccagttaatatggtaaatgacattaattgaattttttcattgttaaaacaactttgaattccttggatgaatcccacttggccatgattgttatactttttatatattcctgaattcagtattattaaagaattttaaattctgtgttcataaaggggatctgtctctagttttcttgtgtctttgtctggttttggcatcagagtaatgtgggtcttatgaaatgagctgggaaaggttcccccttcctcttttttcaaggcgtttacataggattgatattatctcttgcttgaatgtatctagagtttctcagtgaaaatctgggagcatggagttttctatttcagattttctatttctcgtgttattttttggtgatttgtatcttttgaagtgtgtctgttattaatttgttgcctcttagctccaaatacatctttctgtgtaagctctgtgataagccaaggaatgtccttggtgtttcttgtttaatgtgagcacgacattaagcattgtcagtagagggcgctttgggggaggggggtcattgctggaggaagtctctcttgccatttcttttgtgggcatgaggaccttccgttgagcctgccccagtcatggccccagaactcagtctctgcgacctcaaaccctcagcctggtggtaatgtttctgcagccctccccacagggcaccagagcccctgggccgcccctgcctgtgccgcttctgtccgtggcagtgcccagcatccccgcagatgattccaaggcctcctgcccccgtcagtgcctggacacccccagcacgtcatgctgctagttcctgacaatctgcaatccagagggtgatgttgcctgtctggtgtctccagatcagctctggcctggccaagcccgcaaacttctcagccgtctggtggctgaagcacaccttctccaagacatctgagtcctttcatgtctgtcttccttgggcactttctgtcagtccgtgtttgccagagagagtttagatcacgtagttactattttattgtagtattctttatattagactttccattaacctactgtgtggtttgtgtctcctgaatggttatccaaaaatttcttgtaagcagtatctgagttgagacttctgtgacctatggtttttgtcattttcaagaagggtaggagacattgctatgtgttcaactggtattttttcctcctttctttactcatcccgtccttacgtgtttttgccagggacttaactaaaatctaaaatgaggaagagggagaccagagtgtagtgagactaagttcaggagtcagtaaactagggccatgactggtcgatcagcttcagcattagttttctggtgtctcatgaccgtgagcagagatgttgaggattttatgagacactataagcatagcgtcccattcttctgctgcttagactagaggtcctataaccttaagctgcttatggatgaagtatctaggctaataaatcacctagcttaatagcagcaacaattttaatgtttagattttattttatttttatagcaaaagggaaaaaacatattttactatagacatcattatgaataggaataaccccaccatctttttacttctgtctagtcagagaaaagagaccccagactcacctaaccaactgatcaacaaaacaaaaccccaccgaaatacagaatattctccccattgcagttaggcctttggcattaacttaaatttagcctccctgggaattttggaaaaacatttttcttcattgtttttgtaagccctatgaggcagaggtataacttccccaaacaaaacagcaggaaaagcaagtagcaatcccctggataatgcaaatgaataaaaattgccagaattattacaaaagtgctaaaagccctactttgatatcttacactctattcctagactttagtggttcagaaatgcctgttttagcaatgccagcacacgagggaacaaagtttgtggagaaaataaaccacatagagatagtctccaacttagaaatgggtcatgttctaggggtcgatttgtaaatcagttagactggaaatatattgttcctgtggaaattggcattataaagatgtttttttttttggcttatgtcattagttttcctttggaaaaaaattgcattatttttcttttattagaacacattactgtattaattttctatcactgtataatcaattattctaaaacttagcagtttaaaacaacactcatttactatcccatagttttcttaggtcacgattgtgggcatggcttagctgggtgcccctggatcagtgttcctcacgaggctgcagtcaaggtgtcagctgcattgtgttttctggggctcattcacagggctgttggcaagcctccgtttcctgccacatgggcctcttcatagggctgccttacgatatagcagctggtttcccccacagcaagccatctaaggagaacaagagagcacccaagatggaagtcatagtctatcatccactcacggaatcaaacccccatcactcctgttgtgttctgtttagtagcagtgaatcactaagttcggcctacactcaaaggaaagggattaagctccacttcttgacagaagagtatcagaatttgtggctatacctttagaaccaggggaggatctgctctcaagttcactgagcctttccaaccagtgagcggtagagtggatcctccccctaccaagccttcagatgagaccgcagcccagctgacaccttgattgcatgtttgtgggacaccctgagccagaaacacccagcttcctattctaataagaaattagaccacttaacttaaagtgtaccttgcaattgaacagtggttgttgtgcaacaagggagttcctcctctccatgggaagaaaactcattcctcagtgatgagtagcacaatgtggagatttctgtctatagttagtagctgaaaggcttaagcaaggatgggaaatgtattcttttcccctatcctagcttgcaaccagcttgaccagtatgtaagggtatgttcttgatgttatagggtagaaattagaatgcttttctcactgaaacagtattctgtaaatggtgctcagggtccttggaaagaattatatatgagactcattatgggctgaggaggcccttctgggcaagtttaccaccgtttataacagcatgttcatggaaaatggtttctaaatctcagacacccatttcataaacatgcttttgaaatgtgactcatttttaaattgggggtttgcccatattatattatgttctccccagaaaccttctcaacaatagtttacattttgagctataagccttttgggaagaaaaagtgacagaaaatagagattactataatttagtcttggcactaatatcctggcagacctatcaagacataattctcctcgaaatcagatttactgcaaggcctatgctgaagtcttcttatagctgaggtatgccaagtcacactcgtcttctacatttctagaattctagggtcttattcaggtgcttccaaaaacatctgatcagaattagcacatgagaaacattttgggcctgccttagaccccattcagcgcatggctttatggaggcctatggccttcccgctgagagagacactgcgcaggctccagagtgggttcagtgtgaggccgcctcctctgtctcccctgtgtttgatattttcagacactgcggtaattttattcagcaaagctccattcagtcattacagaatccatcaaagaagtgtccattgctagaatgtgcaagtttttattgagcatgtattcagggacgataaccaagcagacggtgctgctatccctaatctccatctgttagtgaagtcaggcacccagcagtgtgtttaaagagccactaccatctccactgacttccctgagttaagatgttctatttcgcctccatctttcatagaaaggcaagtgtaaaaaagcaccaccaagcgcctgtctgtgtcgtgtgtagaaccaaagtggaagattttgttcattatgtttcttaatatgaatatgcgctgggttatccaacttcccttaattagccatgggaccaagtctgctatctcagaatgacaggtccttagaagaaaatgttagagtagctgatttacatgtgctgtatctctagtaagggcaggattttttaaaaaaaatctacccacttattgaaaatcaattgagagcttcatagtaaaaacttgataatttaagggaaatatataacattccaacagcttttagaattcagaatgtgaacatataaaatagattttaagatactcttctgttatggaagaaaaattgcaagagagagagtaacagaaaggatgagagggaagagggatggagcaataattcaaacagcaccaagttccagaaaggcaaaatacttgctgctgtacgagtctcactctccccctctctcctccaaagtaaaaaaggggtgaacccacaaatacttcatttttgaataatcttttatttctatccaaaattttgcatgcttgatcctcttaaaatccttcccccccttaaaaagaagataattaaggctagcctccatggctcctgcctgtaatcccagcactttgggaagccgagacaggtggatcacttgaggtcaggagtttgaggccagcctgttcaacatggtgaaacctgtctctactaaaagtacaaaaactagccaggtgtggtggcagccacctgtaatcccagctacttgggaggctgaggcaggaaaatggcttgaacctgggaggcagaggttgcggtgagccaagatcatgctaatgcacttctgcctcctcatttccacagagtgaggaaaaaaaccaaaaaacaattaacatattactctggggactgcagcccaattttgtagaggaaatgaagtgatagctctatcttgaggccttctagggtacttacttggaattttaaagctgggttgcagtttttctaccatatgatacaaatgggatcatctttgacatttgtcctgggactggatgcagtttaagcatgaggctgatcagagctcaggggctgcttacctgcagctgccagccactcctacatcccagcctggccctcagccctgggaagagactcctgggcttccaggtgttcactgggggagcaaagactggagatgtttaaaatattttttatttccgtttctgaaaaagtaatacatcacacagaagttcaaaagtaacaagagtttttaaaaacaaattatagaatgcagtactattctcctgcactttgatttttccctcaattaactgtgtatctggtagatagtttcatatctgtaactatagttaccctattctttataacaatgctgattattgcatagcatggattattttatgcaaactgttaggaccagtatttttacaagcaatcttgtgatgactgtctttgtccgtgagcaaagcctgtgctatggaagctcaactgggatgaaccttgttaatgttccatgttaatttcctatcttttttgtttgtttgttttttgagtctcactctgtcgcccaggcttcagtgcagtggcacaatctcggctcattgcaatctctgcctcccgggttcagacaattcttctgcctcagccttctgagtagctgggactacaggcacatgccaccacgccaggctaattttttgtattttagcagagatgggggttccccatgttgcccagggtggtcttgaattcctcagctcaggcaatttgcctaccttggcctccccaagtgctaggattacaggtgtgagccaccgtgcctggcctaattttctatctctttatcactatattatttcctgtagaatcttctttgtcttctgaacctcagcaagagacaataattgaataaattggaagccttgtgtttttaatggaggccagctggcctgagcaaaactgatatctatgtttatatctacaatgattcctcttttcttcttaaagtcacatatttagctatctccttcatctctcatgtaaaaagagaatcaagacaagtttgctgtaaagtttataatgacacagttcatgctccatttttgatggggagcttccatcaagaaataaagccagaattcgttttcacgaacgaatagcagccagaaagccaatagccctgaccttaccctgcagcaggcctgctttgtaaagctgacagcagtgttcaagggtgaaaggttggtgttggtctggaacagattggaaggggaggtgtgggcccatcaggctcagctgaccattacctccgatcatttatcactgtcagagaggagagggtgcggggtgggggagccactggaccactccccgctcagctgctctctgacagctgacagtgccccttgcaacctccaggcatacgatgtgccttcaagggacagtgtggtacatgcttaaggccgctgacatgttcacaaggaagagagatgtgctgtatactgtggagcttctctagaaacgtgtgccaccttctcttcgtgctgtggtgtagaactgcttgtagaaacatttaatgatgttttggaggcacacgttgggctccagagtgacagtatgacttgggtgataggatgagcaagttcctcggtgggccttatgccttaattacatccacaatacctggggactctgtacaacactgagattttaatgtggcaaaaccagcatggacagatgctggggaggaaggaaataactttgctgcttctgtgggtcaggaagcgaggcccctacacgtctttgaaggacagtaccttttctaaaaaatgtatttatttatttttattttttgagacagattatcgctctgtcacccaggctggagtgcagtggtgcaatctcgactcatcgcaacctctgcctcctggctttaagccattttcctgcctcaccctcccgagtagctggaattacagggatgcaccaccatgcccggctaatttttttttatttttaatttttttttttaatttttagtagaaatggggtttcaccatgttggccaggctggtctcgatctcctgacctcaagtaatccgtccacctcggcctcccaaagtgctgggattacaggcatgagccactgtacctggccaggacagtacctttataaacaagaataataagtatgatttgtatatgactctttatagatatgtttaacattcatcttcaaaatgtaaaatatgttttagactcaataggaaacacatgtcttagtataaaacaaattccttttggtctatagccatgtgtttcagtacacctactttcaacgttgttattcacaagggtgtcacaggcatcaggctgaaatacagattttaatccttaaaataaccttattttcattgtcatttatattctcaagattatctaattttggtagtcattaggaattacttgtgttaatagtggtggtgagatttcataaaagtcaggtggaaaatttccatcaattaatgtaatattatatgcttatcacagacgcctaagttagacatggtacttaaatgtggcaattaataaaagtattacaaaggtgaaaatggatttcttctaaaaatggaattaatgatgatggagtgcttgtgttgggaactcaggctagtctggtgcttgccggagatgcaggatgcttggagagctgcaggcagtgctgtcaacacagaggcatgtgttgacgtgtctgatcagcaaccctaagaagtgggtcgggcattgcgggctggtgaaggctggagagagggccagggttgtctttccgtctgtatcaccaccagtaagcactgtgcaaataccagtgttcaggagccacattctaactgtgatggggtttggctgaaatgcagatccccaggccttggtggggcagatatgggttcccaggtctctctgccaacgtccatccgccctgcctacacatgcccacctgggagttgataagcttgctcagaagccctctccaagacagggacagtgacttggccctgaccagagaggatgtcaaagaccagtaatacagctggtttggtttattctggaagtccccgaacagcttgagtgtgcgtcacttggggcagtttcttagctagcaagccaggatagttcaaggtgcccacaaccctgggaagaaaagggctctgctgcaccttcctgtgatggagcaggcaagcagccggtcatgggttgttgtcatggaagagagggtgactgctttctctttcctgctcaaagaaaacagaggagtgggacttagaagagaacacgtagtattttacaacttccaaaatatacccgataggggctaactttccttttttcaagcgttgctttcagtttttttttcttttgataatttattgattagcaaagaaatatttgcttaagaaaaatttgggaataaataaaagtataaagaaggaagcaaaatcacccataaatcagcatataaatcagccacgactacagcatcaccatgcttccttcttgttattttccttgactttgttctttacttgaggaggatactttattatttttttttttgttgttcttactttttccccactcaactccatatatattattattatttcctgatgccaggaaaaaagtactcatggtcatactttaaaagttaccatataatactgtatcttagaactgtgtcacaaatttattctccatgtgtggggtcattcagcttatttacagtttttctgtattttaaacagttctgttgtaaacatctctggaattctttgtctcaattctgattatctcctacagtagctatttataattgcagtgactaggtcgaagggtggaaatgcttttgacattcttggttggttgtggtagttgtggcagggtctcctctgtcacccaggctggagtgcaatgggacagtcatagctcaatgcagcttctaactactgggctcaaatgtttctcctggctcagcctccctagtagctgggaccacaggtgcacaccaccatgcctggctaacttatttatttattttttgtagcaatgggagtctcgctatgttgcccaggttggcttttggcattcttggtacctattgtcagactgctttccaattagattgtagcgtttcatgtgccatgagcagtgtaggagaaagcttgtctcactgaagcctggtcagtgctcggcattgttttcgcaagtttgccatttgcacgaatcaaagctagtctctcttttgagactgagcatctattgtgtatttatataattaacaatttatctgcataatatcagttcccatcattcctccctttgtctttggtgatgcaacctctgtcttttgcagaatcatggatgcctgctttgggagcctggagaaatggtttccatgctgtcttctagggccgctgggttcctcttgcactctaatgggggatccctctgatcacctttcttcactccccagacagtctgcagtctcagggaatagggggcatggtaggctcaccctaggccggtaggctcactctaggctgggttttttgtttgtttgtttgttttttgagacgcattctcactctgttgccaggctggactgcagtggtgcgatcttggcccactgcaacctgcacctcccgggttcaagtgattctcctgcctcagcctcctgagtagctgggactacaaatgcgcgccaccgtgccctgctaatttttgtatttttagtagagatggcgtttcaccatgttggccaggatggcgtcgctctcttgacctcgtgatctgcccgccagtttttttttaatgaataaaaagggcttgtggttggggcatctccattcagctttgccatcctaggcttgtagtcacactagtgggcttgtgcactgagcagacttcaggaaatgcagcaggcaaatcatgagaaggaagaatgccctctatttgcataatgctttattctattaaaaatgtgtcctcatccttatttcctcactctttgggctaaaaatcctctcttaggatttttcttaataactggttgatgaaatggagtccttgagtgtaggatctgtgaaatttatctttgccccacaacactaactcctggcacttatcaatgtggagaacatccttgccagggagtgaacatgagccaaaggacccgcctctaggtaccagcttatgcctcaccaaggtgggttactgtgctggctgggctttcagcctggcctgttctgcccatcctattgtgacctcttgaagctcaggcttgttcttctgcagaaagagctgggaggtatgggggttgcctggggaggtatgggggttgcctgagctgggcatcggctccattaccagccgggaggtgtatctccgttctgctgcgtctggagcaaagggagcgggccagatggtcgtggagggcggggttgactgcggggaggccgtggtcagagcaagaggataaaatcctgaatgacacctgatttgtttttcgtgctgtgatttttcactgttgtccaattgtcctctgtttttccatcacataccttttgttttgggggcagcccccacttgcatatggtccctggtcaccatgggggagagcagtgagctgccttccccttcacctccagctttgagagtaaatctcaccttctgggtacccacagcagctggggacatttgccttattcccaccatggccttcctgggggactccctgccttgctgctcctcatcacgggtcccagctgctggttgtcgcttgccttccaggtcagggaggagcactgggaattcctgggacacaggatgagtgggcgtagtggtcagcagggaggggagaagcccctcccagtgactcacccagcaccatgtttgtccccacgtagcctctcctgacatatagaacatgctgctattgggggcaaaacccactcttggttaacttgcaccttaaaacaccatatcgcacattgtaggagctgtgagggacaaacacaaccagaacctcagtgcccctgggcatgtatgactagaggcgtgactccatcctctctcagagcccctgccccagatttgagtgacagccacctcatccttagcatctgcggagaggacctgggcaggatcagggcccagaacgctcagtcagtgtccttgaggggcccgctgcagagatgggagtggctagtctgaggccagggcttgtgggccacataggaaccttacttacttcctgactgacttgtaccctgaaccaccatgactttgtgacctggagaaggagccacaaagaaacagataagaagagggactgtgagaccatattttgttggggtgttgacagatttttaccatattactgagataaatgcactttactccagccccaccgtgaccctcctctctgctgctcagtgtagtagcagctggattagtcagtagaaacacttgatacgtcagtccagatccctcaggagcatgcggtatgggttgggttggcatggggttaataacatgacccgatgagattgtacttcttgatgaccggcagttctgagagtttagtctgatccaagactcttccagtcctgagatgattttgtgtctagtggctaaccaggactcccaagatggcagctgctgttcctggaatctccagttaggtggtgtcccctggtcacccagtccccactgctttccccaccctccttacccagaggatacgaattttaggtgttcccagttgagcacaggacagggagctcatccctgattggtttatgcctgattttgcattattgtagatgtgttaccaagcagttttactgtgcccttttcaaggaagaaagtcatacaatttgaagtgcatgagacattcacaaaacaaaataaaaagcaatgtcagtatcatcttcttaagcttttgaacatgtccccccgatccccttcaacatccagaagttgactttgacccagtcttggtctaattaactgctactctgcaagcactgcgctctcaagatgaatgaaaatctgtttcttgtcctcatatcttcttggtggaggacacgtcactgccatcagcagaggttgtcctcccagagcatgtggctttggcatgtgccccttgtagcagagaaggggctggggcatgtgcccaacccaccagttgggaggcacccactctgctatggctgggtaacagatgtccctgttggagactcttgtgtctccatttgacactctactggtaatcaatagttagggctcaattaatgaatggcttttctgtttaataaatttgtttctgtggtgaaacatgccattgattttgaaacaaatttgtaaatggtgggttaggttcccaggttagcccacccttcccccatatcttactgaacctatacgaagggtttaaaggatctttggttctttggcccccaaatacttgccttagcagaatttcaatgagaaaatgtctttaaaaactccaccttggtttctaggaatagagctggggtcatttcttggttgtaaagaacttgctattttcccattgtggagtggaaagtagctctcagatttccccttattcttttatccctagagcaatatatagtgtgggggattttcagaggtttgttatcacagtgtagaaatgagaaggaaaatgacttcttcccctgtgccatctttgttttatccatttaaaccagcaatggcaaaatgatttcatcacacatgatgcctctaagcgatgagactctatgggtactgtgttgagaaaagattctgtgggcacattcagggatcaagaaagtatgctgtgtttgattagtgatgtctgccatgggcatggtcgtggaggggaggtgactaatgtttatttgccgttcctgaaacagacctgttggaaagtaaagttcacacaggtgataataccagcctaactgttatatagagtttgttatgtactggacactgttctgagtgctttttgtatttaattctcaaaacaccccatgaagtaagtacaaatgaggaaacttaaaatgaagaaattcttacagatgaggacacagaggcatgaagaggttgagtgactaagccaagatcatatgggtaggaagtgggagagctgagagtcacagtcaggccgtcttgtcctggatcgcctgttcttagccaccagttctgtcctgtctcctgcttgtgagtgttgtgcctgcggtccacaggactgatgtaagactcagctgtatttcagtagaaggtgcaaaatcacgttttaagaacctgttatctttgggcttcaggctctggaattaaagacaagacaaagccgccagggacctcatgagtgatgagggaatagcaagtgaactccctccaccttctccaattcatgcagtatttctggtctttccatctcagccagcactgcccacctctcagttgagactaggtaaatgggaaagggaagaggggttgagatttaaggagtggaatagaggagttcccttgtatccaggtcacctggctggggaaactatttctgaggggccattttcaatgatcattttatgtaaggaacacacgcatgtacacataaagatatgtaacagtcatgtgccacataacaatgttttgaccaacaagggattatgtatatgatggtggtcccttaagattatagtggaactgaaagatttttatcacctagtgacattgtaaccatggtgacatcgtagcacaacacattattcatgtatttttggtcacactgttgtaaacaaacctactgcactgctagtcatataaaagttcagcacattcgataatgtatagtacataatagttgataatcatcataaacaatgatgttactggcttatgtatttgctatactatactttttgtccttattttagagtgtgctcctgcagttataaaaaactgtaaaatagcctgaggcaggtacttcaggaggtgtccagaaggagacattgttaccataggagatgacagctccaagcgtgttattgcctctaaagaccttccagtgggacgagatgtggagggtggaagacagtgatattaatgattctgatcatgcttaggcttaggcgaatgtgtgcatttgtgtcttagttttcaacagaaaatttaaaaagtaaaaaatgaaaattttaaaaatagaagttttcaacaaaatttaaaaagtaaaaaatgaaaattttaaaaataggaagaagttttcaacagaaaatttaaaaagtaaaaaatgaaaattttaaaaacaggaagagcttatagaataaatataaaaatattttcatataattgtacaatgtgcttgtgttaagttatgttattacaacagtcgaaaagtaaaaaatagtttaaaagtttataaagtaaaaaattacagtagctgaggttaatttagtattgaagaaagaaaatttaaaaaacaatttagtgtagcctaagtgcgtgatatttataaagtccgtggtagtgttcagtaatggcctaggccttcacacccactcaccactcattgacttacccagagcagcttccagtcctgcaagctccatttgtcataaataccctagacaggtgtaccttttttttaaatcttttatactgtatttttaccgtaccttttctgtgcttatagatatctagatcacaaatacttatcattgtattacagttgactacagtattcagtatagtcacatgctgtacaggtcatagcctaggggcaatagactataccacatagccatagcttaggtgtgtagttggctctaccatctaggtttgtgtaagtgcactctgtgttgcccaatgacaaaatgacctgacaacacatagatttccctgaatatatccctgttgttaagtgatgcataactgtatatatgtatttttaatggatcaaataagttatctttcataatggctaaagagagattttttagtaccatttacctcactcgttaatttaacaaatactcatcaaatgcccgttctgtgtccatacgctgagagaggattatggaaatggggagtcagagagctacgacccctgccctccctgagcttgcagtctactgatagatgcagtccctgtacaaacagtggcataagtgcaaagtgctacttgggtgagtgctgcagaggaaaggcccttggtcctgagggatcagggtggctgtggtggatggatgagggatgctagtgttctgaccatgcaggtgcttgcaggccatgccaaagagctttgactgtggcctgagagtcatgggatgccatggaaggggaggaggggtcttggagtttgtgtcacatgattagatttttttccctttggaaagataattgtggctaccttgggaagaatgaattggacaagggatatacaagagttagaaggcagatgtcggagtccggaaaaaggggtcatgacatttggggctagggaggcttcggtaatgaaaaaaagaagtgagggggatgctacaggtgtctggagggggacagtcgctggctgtggtggcagattggatgtggggagtgaaggaagagaagggataaggacagttagaaagcaggagcatggcaggcccattcccaaaggtgggggatgctggcacagaagctggtttgggatgggaggacatcctgtgtagttttgcggtgttcagaggagatgtcagatagggtgcactttggattgtgaacatgtgggtttcagctgggccatcgacagaccttgatggattgtcctgggaaaccaactactgtggaaaaaatagaaaaatctataattttcatttgtttgaattcaaacattttcaccctagacaaaaagaaaagaatctaacaatgagaaaggaaataaataaaaataaatgtcttgcatagtctttgtgttttcatttttatgttcttctgccagtcttttcacataaatattcatattttaattagttgtcattatagtctatgtagaagttgtaataggattgtgtttccttaccattatcccaaatattttcccacatttctgtatctctctcaaggctgcatttaaaacatgttgggtaatattccattcatttgataaatcataaatggtaattttctaagcaattcctctacttttggatatttagttgattttaagattttgttattacaggtaatactttcatagatattatgtgtatcaccttttcttctcgtgtgtttttttcttaaggtgtattcttacgagtgggattcatgggtttaaagagtttggtttctgacttgtgatatgggtcaaggcaaatgttttccaaaccactgacagggctgtgaggcaagaacgaaagggcagatctttgatctccacacggaagctcagcatgtttatttgaattcagtaaccagtggtcctaaccagatcagtgaatgcttgacagggtccttccatcacacagctgggaccttccatcacacatctgctaattgtgccagttagtggctacagacctctataaggccactgagcccaccaccttgccctcagaaccctgggctgggttctcccttttcccaggctttttgcttgtaggaatgccacaatgactttacaaccagtggaagccccagaagggaactgatggaatccctaagggctacaggcagcttcccatgggtttggatgggtgctcaagatcttccgtgacctagtctcggtctaagagatttacttgccattgcttctcaaaatagcacctccactgcaccaagacagattgttctctggcccgggaagatgactcctggccctcactgaagttgctctctcacccttgcctttgcaaacctgacttctccttcggactccaggagtggcagcgccttctggcagcacatctgacttcccacccagctctcctgctacaattacctgcactcctgcagaaccctccgtccacatggcaggacttagcacataattatatgccttctttaatgtttgtttttgcagttgttatttcttgaagataactgtactctcctcgagggcaggaactgtgtcatccttccctagacccctccaagcgtggcttcagtgctgagccctttgcctgaacccagccaatccagtgtgacccattacatcaaagcgtctctgccgatgatgcagtgtgaagcgtcttagctatccttttcttttgtgttttccacataagtgctcctattcaaaacctgctgaggatattatttagaaaatgctcatagatggggaatactcatattgtctattgatcacagtttgggggttgtaagatcaagttaatgctggaaaacaataacctggtcacttgttacttccgagtcctcagtgtttactagggtgggaagggtgactggttaggaggacctgggtggggggataaggagctgtaggaggcactggaatatctctctggctcttaaggaggctggtgtctttggcctgggtgaacagtgcttgtactgtactgaaatgacatgttctgctattgtgttttttgaaaaattgctcccaatggaaccttgccctttttacttctcactttaaatactgagtgcatcagtgttctgattgttaggagtctgcagggggactcacccccagttcagcctggaagttggagctttgcttgttttttagagatggtgtggcagaagagggactctggctgggtgtcgggagccttcaggcccggctgggtctgtagccacccattgtccagctctgcacaagctcagacctcagcctactcatttataaaatgacatacctgaactagatgatctctaggcccttctgcaatggagatgaaaaacaaaataattgaagctctcttcagagggtaagcttgggtgcatttttaactcaaaggagaaataggctcattgacacatttaatgacatgtgttagtatgtgttagaactttacacttaaacttgcatttctttttttttttttctagccaaacatcatgtcaatggcaacagaacagtcgaacctttcccagagggaacacagatggctgtatttggtaagatatcaattctgaaagaaaacccaaattgtgtgcaaagactagtgccaaatttcttagttttagcaagtgttctcagggcttcaaaatctgggctcttctagatatttacaagttgttacagccaagaaaactattgagttcctagtaatttctggggttggaaaagcttattctatagaatttagcgtgctttattttctcacgttgacaaccacgtatcaaactgagtatttgctatttcttatgtccacactgtgaattaacctgctaatttagggtttgagtttttctttgctagcacggattttttttttttccgcatagatatatcactttgttaaaggctggaatttaagtagttttgacttattattacacaaagattaatctaattgaatgatctcttccttctccatcatgaattaagcacgctccttaagagaaaacattaattaaaaatgttttcagcaaaggccaatccctgagtgatatacttaaaatgtacaattatgtggttgagcagaacttctctgttaaaattccaaactgtttggtgaagaggtcctttttaatctgtgtttccttccctccatgcctcatgtcatctaaacttccttcagaatatctctgcacatggccctttctttgcctgccttcttttctccattctttccttccttacctcttcttctgttgggcccatctcccacctcccctccccttctctctagcagtgctctggggttcatccctgtgttacccactgaaaatgacgacctctgtgctctggaatttcaactgggcattcagctgcctcccttggttccttcacctccacgtttagacaggttctgtgatgtctctcatcctaaaaatgtgaggtcccctgatttcacgcctcccgtagcttctctcctgctctggtcttgatggtaatctcctttgagggtacaaaactgctttgaagacttgaattgcgtttgaactggaaattagcctcagaacaacctggtctataaatgagcacactgaagttagattgttcccttattcccagagatggaaccagaattaggcatcagtgaggattagcagctgcagagtcataaacagggacccagttccacctcagtgttggtaaatcatgctctgtgtaggctatcaccttttaaaacatactgatcagtgatgagaaatcattatgcccagaaatttaaatggagaagttgattttgtagaaggcataatggcctctctaaaccatgtgctaaaacgtttgatttgctaactttcctgtcccagcatggtgtctgttatcatgggacagcaaatgtcacatatatcaatgttcaaaggggtcttttgatgatttatttatttattttccagtctctcagattcgccaaccccaggcatatgagaaactaagtcttatgtcatattgggaaatagtaaatgacactaacctattattagtgggtttccctctgttgtgatattgaagtaaaacttctttcttgaagggcagattcagtaccagatgggctgatgacattgtttgactacagaattcgaaataacagggaatgaggctctgtggcaagtctttcttttcttttctttctattttttattttattttattttattttgcagtggggggttgcagtggaaagatttggtttatagcggcttcctcaacattcttccccaaggccctcattgtttcactttcagcgggcaacttcccctctctaagcctccgcttttcgatgaggaggctgacaggtgaactctaaggcctctgcagctctaggcccttggcctttacctcttacgccttcaggactgaaagctcttggagcagggggcagcccctgggaggcccactgtgcatggccagcatgtgtggttttagaagagatgaatcatgtgcataatttctacaagttaacaacatataagaagcagaattctacagatgataaagtagaatatgtttgacatctaagaattcttactttagaagtgcagtttagctcttccagatgcttaaattaaggccttattttggttaagtatatgcaagcattttatattaatgtcttcaagatgatcctcactttctatcacttgtcgccctgggctagggtagagtaggggatttggggggttttgagggtggacttctgccattctgggttgtttatcactgcaatggaaaggtcaactcagcacagtgcttgactctttgggatacattgggcatttcatcctgccagcctcttgcaaagctgatggactcatatactcctcttcctagcgaggccatgtgacttatccagagccacttggccaaggaggtggttggtggagctacagtttgagcccaagtctaattgacctggaatctatgttcttgttgtgatgttccctgactctctctgcactggttcaaggaaccatgggaaggccttatagattcagggacacctttcagctgggtccacacacaaaagtatgatctgcagccaggcccatttagcaaatcgatttgtatacttgcatgccttcccggagtgctctgaaggagtcttgagaagtagcctttgctgggagaatactggttggagcaagatctcctacggctatcatgcttttccatttgaccacagtagcatgtattattaatgcacaggaggatgtcttacattcccttgactgtgagttcatcaaaacagtgatggcacttgtaattgtttagacccgttcttcagccttggaggtcttcatattttgtgataaaatagtatcactaattataatgtcattttttttttttttgagatggtgtcttactctgttgcccatgctggagtgcactggcacgatctgagctcactgcaacctccacttcccgagttcaagcgattctcctgcctcagcctcccaagtagctgggattacaggtgtgcatcaccacgctcaccttttttttttttatttttagtagagatggggtttttccatgttggccaggctggtctcgaactcctaacctcaagagatccgcccactttagcctccccaaatgccgggattacaggcatgagtcatcgcacccggccacaatgtcgttatctgttggttaatcatttgaatataccttacctttagaatgctaccgaaataagaactttgaaatgtaatccactctacagatgaccattgaacttccatgaagcttttagattagaatgtgaaatgtcaggaaagacagatagagtgtgggataaaggcattccagtgtgaaaaatgcatgaatggtcatatcaagggatcagagaatagatagatgattccttaaaaactgtcgctggcatacagtcttcacagattttcttatgtagcccaacagttagtttttctcctggtctccttttctctctggtttttctgcccccatcattcttagcttcctctgtggctctccctctcctctgcccttttggacaatgagaacgaaggtaataggcttggtcctcctggggggcttctcctacctgtgtgtgatgctgtctttcaagtcagtgggagccctctgcttgcaagctggaaaagtggagccacacattttgcaattacttcctgtctttgttcctggtagctgtgagtgcccccttggctctcacccatttgatctttagagcgcccgccctgtgtagtgggcatcattgtgctcctttataggcagacaaactgaggcacccagagattaaagaaacatggccgaggcttcctcaggtatgagaacatcttttgccaccctgctgggcctgtcttagaaaggttctctctggccgtcaatatcttaatgaaagtgacattccgttggccacggtccactctgtccacgtggagggccgggttccagcctctgcagaagtgcttgttctcagcacagaccagctactcattgccttaaaaatactccatagtcaagaagatgggtaatttcacgagaaaatcaaagcttactaatttaaaagggtggaaaatggagggcaggggattccaagcttaatttgtgaagattcttggtacaattaaaaaatattttatataaaatattagctgggtatggtggcatgcacctctaatcctagctacttgggaggctgaggcaggagaattacttgaacccaggaggcggaggttgcagtgagccgagatcgcgccactgcactccagcctaggtaacagagcgagactctgtctaaaaaaaaaaaaaatttaaactttactatctttgaacataaatttgtcatccaaactaggatacattcgagagtaaaaagagtgctgtgaacaattatactgaaataatgaaataatgagggataaacctggagggttttaggcaattaggatataatgtccccctttaacgaggttgtatattataacgtattgcaccaagaataataaatacacaccaagttaagtagaaatggaaaaataatgaacttggatagacaaagtgaacaaatggaaaaaattgcaatgacatagattggattgtatataatgtcacatccacactagtagttacgctaactttggaaattatattcaataaatattgttgtgttcttcctgaataacttcagtttgaaagttaatgcgtattcataaaacctagtttgtgatacttcaataagagtgagggaattgatctgattttacagttgcagttttaatattgtactaatactttccagggatgtagggtaatgaattctccattacttgagatattcagatggtagagtggtcatccttaaccagtttggaggtggggctatgtagcctttaaaaccctttgttctcaattactgagaattgactttgttttggaacactgaaacatttaaaaaaacattctgctaagtcaaaattctttgaacccatcattatttattttttaatttaaaagttttgtgggtacatagtaggtatatatatttatggggcatgtgagatgttttgatataggcatgcagtatgtaataatcacatcatggaaatggggtgtctgtcccctcaaacatttatcctttatgttacaaacaatccaattatactcttagttatttttaaatatacaattaaattactactaactatagtcaccctgttgtactatcaaatgctaggtctcattcattctttctcactattatattttgcatccattaacgatccccaccttctcctgtacccctactacctacccttcccagcctttggtaaccatcattctactctcatctccatgagtttaattgttttgatttttagatcccacaaataagtgagaacatgtgatgtttgtctttttgtgctggacttatttcacttaacatagtgttgttgcaacactatgttgcactatgcactatgacagggtctcattctgttttatggctgaggagtactccattgtgtacatgtaccacactttcttttttttttttttttttttttttgagacagagtcttgccctcacccaggctggagtgcagtgacgcgacctcggctcactgcaacctccgcctcctgagttcaagcaattctcctgcctcagcttcccgagtagctgggatgacaggtgcgtgccaacatgcctggctaattttctgtctttttagtagagacggggtttcaccatgttagccaggatggtctcgatctcctgacctcgtgatctgcctgcctcggcctccccaggtaccacattttctttgccattcttctgtggatggacacttaggttgcttccaaatcttggttgttgtgaataactgctgcagcaaacctgggagtgcagaggtctcttcgatacactgatttcctctcttttgggtacatactcagcagtgggattgctggatctgaaggtgtgaacccgtaccatttgggaactcacgtccaggctttttggtgaaaggtaagattctgcagtgagaaaccttaatgttgataaattgataccaagcagcaacagcagaagtacctctgcaaattctttgggttgtcgtgagtttttaggctcctagtagcctgatggcaatgtctctctgacctcaaaccactggaaaacatgttttccgggtcagattctctgaagattcttcaaacaagagtggggagcaaaagccaagccgaggacttaggaaaatgtgttttttgtcgcacggcacatctcttttgacagctaaggtgccgagtgttcgcgtgacctttttttgaacagctgtgtgaatggacaggtcccggagcaggggcccgtggctgacaggagcccagagacttgtccctctctggggtactcaccttcggcccctccaaggagagtgagatcaatgtaagatgaaccaatcacaagaaatcgtttcctgtctgacatgaatgggaggtgagttttgaatcagccccggttatttgtctgccagccaagaaaacaacattggaagcagccggcaatatgtcagacttcaaagggaagtgtcttggtgtctcactggcacatatccagcatgatgttggtaaataaccgagtcccggtgtggcgtatttctccctgaatcttgactgaaaactactgaagcccattctgtgaactctggaggggcagccactcattccaggaaaaaggccagaaagaatgacattgaaatgtgtttataattagcgaaacaatctaaattcacaagatggtcagaactgcaggctgctaactggtgcaaacttcttaaatggtagagcacttggagagataaaaataggccttcctccctgggtaatttgaagcaacttgagggggcaatggtcattggagacatagtttaagatgcattttattttatatatcttgtgcatgatttcaactttcgttttcttcttgagtgtagagaagtcagataatatagagaaggagaaagagacctttgaaaacctgtgttgaaaatctcttttggtttggaaagcattggctgggatggtgcagccacgttgacctgggctggtccagaaaagaacaaattatggagtcacagaggagggtgggttcatatgtttagagtatggaaggtggactgtaggttggaggatggcacagaatccattgtagaggggagtaagttagagaatgtttcatataataacactttacttgtatagagatcacttatccatgaacttctcccatttcggttgtaagtaagaaccagaaagtgaagccctcctcccacaaaaaggttatggaggagtctgtaaagaattcagaattcccaaaggtcactggagtcctgtaatccttgttgactctagacaagtttcttccgccttcttaagccccatctctcatctgtaacatgacaagaaaactgtttgccacctaggactgttgtcagagtgtcaggaaatgatgcattggccccttggcatggggatgacagaccagccggacaggtgctccctggcagaccacctgctctcctcactctgggtgagctgtgatcaagtccccgggagagtgacgccaacatcactaggctctatgggatccatcacctctccttcataacaccagacgagtcccgtaactcagggattttgaaggataacagacagcattagttgagaactcacctaatattggctgggtactgagaagcccatgttattaaactctctatcaggctcactctcaccatgtgtccaagtgagactggttgtttgcttctgtgtcaatacagagctctcagaaaatactatatttctcttttggcctcaactgtaaagctaatcagatgtggctaattttttcactttttgcagtagtgtacagcaaccacccacttgactgacgttttttcctttaagttttgacaacgagaaagatttattttacaaatgtggcggacatttcttaaatttctacagagaaaatacattcaacaggatgttcaggagaaacaatcaaatattttctattacttctctgttaattaacttttttaagaagagaaacataggtatagagaacaactaaaaggaaaaaagttactcattattaaatttaacccaactagcatttttaagaaaaatacggagcaatcaaggatcaaattcagataatataaaacctaatattctttttcttgttctcattctccccagccatttatcttgggacttgttataaaatggattaaaggaaaattaaaatatatgcaagacacagccaactaacatgcattagaattaggtaaatattaggccaaaggaaaagaaagtgaaatgaaatacacaaagaatgcatgtcataatcttacataatttataaaacttgctcataaatttggctctatgtttcctagcagcaacatgaagaaaaatcagttggttgcatgatggacttcatttttaaaaaattgtggtaacagatacataatatgaaatttatcattgtaaccattgtttaagcgtatggtccagtggtgttaagtaccttcacattgttttgtacccatcaccaccatctagctccagaattattttatcttctcaaagggaagctccatagacactaaacaccgtctagtcctccttcccccagcccctggtaacctctattctacttcctgtctgtctaaatttgactactctagggacctcctatagatagaatcatgcagtatttacccttttgtgactggcttattctacttcgcataatgtcttcaaagttcatccatgttgtactgtgtatgaaaatttccttcttatcccattgtatctatagaccacatttggtttgtccattcacctgtcaatcaatacttgagttgcttccaccttttcgctgttgtggataaggctgcgatgaacctgagtgtacagatctctcttcaagtccctgctttccattcttttgggtgtatacccagagatggaattgctggagcatatggtaattccatgtttaattttttgaggagctgccatatcattttccaaaacggctatacttttacattcccaccagcgaaccacaagggttccaatttctctgtatccttgccaacccttgttatttatttatttttaaaaattatagccatcctaatgggtgtgaaatggcgatggatttcagttttacttactgattctaaaaatgtacacgtttgggggaatcacacatattttggattctggaaccagaaagaaatttttcaagggtacttaggaggacactatatgtactacaaggcatttaggcagcactgctgatggcaccctaggagtgagcggcgcgcaagtctcgtggctgtttgccacactgctcttctctttgggctcgtgaccctctccccacaagggactatttggtccttgcatctctgcaggtgctagcgtgcttgtctgctggctctggtttaacccagaagttaattgcgttgtatctaaaacaagcaatggaccagctgtcttctagaagattttctgtcaatatcatttctctcagttgagttttaaaaggtatttgttttttactttgcaattgtgaaagatttcaaacaaaaatacagagcttagtataatgaagccttgctcgctcagcttccacaggtctcagttatggctaaatgtgccttgtctacatccccactccctccccctcttctatcctagcatatttaaagcagatctcagctgccctatcaactcatccatgaatattttggtatatatctctaaaagataagatggattttttacacctaaaataatactttttaaatatcatcaaatctccagtgagtccatttcccctgttgcctcataaatgttttttaaaactgtttatctgaatcatgagccagatcgtgtatacattgcaattggttaatataaatagtttcttttcatctgtaagttcacccttctttctctctttcccttgctatttatttaagaaattaaataattcagcctgtcctatttcctttagtcttgaccgaacgatcatgttcatttgtcctcttgtattttctacaaaccgagagtgagagggctgatcagcatctgtaagtggtggtgtgtttcattcaggaggcatttaacacccggttccttttctatttatttatttatttatttatttatttatttatttatttatttattttgagaaagagtctcactctgttgccgaggctggagtgtagtggtgcggtcttggctcactgcaacctctgcgtcccaggttcaagcgattcttttcctcagcctcctgagtagctgggattataggcgtgcaccaccacacctagccaatttttgtatttttagtagggatggggtttcaccatgttgccaggctggtgtctaactcctgaactcaggcgatccacccgtctcagcctcccaaaatgctgggattacaggtgtgagccactgcgcccggccctggttccttttcttttggtgaagttagcatccccttactgatcattgcctcagtccattattttcttagaaactgcaagatattctaattctagcattttttaaatttgtgagctgaaatatttctataaatagagacttctctttatcaactgtatggttactgtgagatccagtttgctgaagaaagcaggataagtggtgattttccttatgtaccattttgctccatgtatctgagcatggctctaaacgtgtattcccaagtgtcagtgtatatatggatagttgtttaagtcaaaagccatttaacaagggatagaaactgccttaatttgacggaatgaccattttcacttgggcgtttaaccagattattgaaatttgtaaccagttgggtgaatacttgaaaatagagccacagtacagattgctgcaacagatttgagtaaagcaagaagcaggcacactgtcaggtggcagaaggcaggttctcaggcaaagctctctccacggagcagcgatcttctctctcgttctttccccagatcttgtgaccaggggatgtgctgcagtgcaggtttgagtcctgaccctcagtagctcaggtttaaaaaagcaactccagagagggcctgagggttggaggaggtcttgcttctagatgtgcaatgccttcaaactgttgaaatgatagaaatggagaagcagtcaagaaattacaaagcctgctcagggatgctgcccatagcgaagattaacagctgggccatttcacctggagcgctttttcacgcctctgcttaatatcgtgaatgagtttgagggtagcagaagacactccccagagtggattttccatacttccagttctcacagaaggtgtaggtaaaactgttcgtggttatcactgccaaatttttggggattcaagaaggggagatatttactgacccacttcttttttaatctcatacacatctcgtgtatgtatttttgtaagtggtctcaaattcttttttggaacagtgttgtgtatgaataaggtaaataaaaataaaataattcccatgaatgaaatttggctgggtgcggtggctcacacctgtaatcccagcactttgggaggctgaggtgggtggatcacaaggtcagactgagaccatcctggctaacacggtgaaaccccgtctctactaaaaatacaaaaaattagctgggcgtggcggcggacgcctgtagtcccagctacttgggaggctgaggcaggagaatggggtgaacccgggaggcacaacttgcagtgagccaagatcgcaccactgcacttcagcctggacgacagatcgagactctgtctccaaaaaaaaaaaaaaaaaaaaaagatatttgttaggtccagtacaatgtacacctttttggtttttttttgtttgtttgttttttgttttcccctggtaggcaatcaaaatcaaacagtgccagttcttttttttcaggaataactggaaatgttaccactgaaagcctaagaagtgggattcagttgaagcaacatggttgaaccatgtggagaaacagacgtttagcttggcataccttaggcccaagtagtgtgaacagtgatgcaagaacctgtgaactttccctacattcttatgtacagagtcttaaaagcccacgatcattgtattattctatgtccataaccactaggtgttattaggaaaaacacttttcatcttcctgggtcatcagtgtcccagacttacacaaagaattatatttgaccaagaccaagtttccttgctgagctcactgaccttgggagcaacagtggtgcctgcagatggatgtctttctgatggaggtcccaccctatatccttccagatttcagctgggattccaacattcatgataatatggaaataatcagtgatacatcatggtagacattaccatgaagaaactcaaaacaatctttcaaaaatatgcttagcataagctgagtgaacacatagtcagatgtggccttccagaaccaagcctactcagggtgaatcagcactgtgttttcttaggaaaagaaattttattttatttttttgccatatgcctgttgtctcctaaaaagtcctttgaatctcattcatgtttttatgtgatgacccttttccagtttcctaatttccataattctgccacttgtcaggtcacgatggagctgtttctagtgggagcctgcgtccatctttcttccagcacccttatatggattcagtgcttggtgacattcttattaccctttctttcaccagcattctgtttcctcagcatatgacctttatcagggtggcagtgggcactcacattgggaagcatggaagagttttgattcatcttacaaggacattaagggaggaggactggggagggtcgtctggggaatttcaggaatgtgatgacactaggagcaggaagtgacagctacctgaggacagatgagcccagaaaccctttcccgttccttgctcttggctgaataacttgtgcctggcgggtgtgtctttggccaggcctcacactgacagctctgcagtacagatatgcagtgggatggccacatgatggggaaagcccaatagcatggagtctgtgtggggctctgctttcccacgtgcagaaaatgagagccgccttcccgagcaaatagccagtgcatgcttttatcctgctgccaagacataggtctgcagtgatgcataagaaatgaccagacatctgcaccaactgaatgacaaacagcttttcaattgctgtgaaggttttggtaactgtattgaagtttttgtccccattttttctcccatgtaagacatttttaatctaccttgcaatgaagaggctgttaaacacttgtaccagcaccacccagcttttccatgtctatattaagctacatattataaatatatatatgtatatatgtgtatatatacatatatatatttgttctttacacttaactctgagatgagaaaactaaggctcagagacattgacttccccagggtcaggctactagttaatggcagaactagttaatggcctggcactgagattatttattcacatgttcatcagatggtttatttattgcaacaggaaacaaacaaaaatctctagcagcttatactccagtagggtgggacagaaaatgagataaatatgtaaagcatatggcatgtcagattatgataagtgctgttgattaaaataaagcagggaaagagaataggaaatgctaggctaggttgaggggttgtaatttaaaataacatagtcagagaagtcatgaaggaaaaatacctgagacaggttgttttgcacagatttatggaaaaagtgtcccaggcagaaggaatgcaagtacaaaggccctgaggcaggagtggcggaggcctgtgtggctggcgtgtaatcagcaagggaggaggaggagcagctgaggtcagagactacgagatcatgaagggcaattcacaggtaattcgtgggtaattgtggggactttaacatttattttgcacactataggaagtctagagggtttaaggcagaggtatgacgtgacttttttttttttaaagccaccgtgagtgctctgttgaagatggcatgtttaggttggtgagagatgcagcaggaataccacttaggaagctattgcctcctagttcaatacttttggcttttgaacgtaactacttttaataataatacaaaaaaagctttaggcctttatagaccttctcaaatgccatattttcatagttttgtaaggttttctatccctctgttttgagaatttaaatagcccttttaaatgacacattagcttggctattatcaaaaattcaaaagatggcaagtgttggtgaggactctcactgttggtgggattgtaaattggtacagccattatggaaaacagtgtggaggtttgtaaaaaaatttacaacaagactattatatcattcaacaattctacttcttcatatctaaaggcaatgaaatcactatctcagagatattcatactctcacgttcattgaggcactattcacaacatacaagatacaatgtccatcagtggatgcatggattaaaacctgcggtatatatacacaatggaatacgattcagtcttaagaaagaaggaaatcctgtcgttggcaacagtattgattaacctggagaacattatgctaaatgaaataagccaggcatagaaaaacaaatagtgcacgatctcacttgtatgtggaatgtttagaaaagtcgaactcatcaaagcagagagtacaatgatggttaccaggggctggagagatgttggtcgaagggtacaaagtttcaattggacctgaagaataagttctggagatcttggtgactatagttaataataatacattgtacacttgaaaattgctaagagagtagattttaaatgttctcaccacataacagtgttaagtgtgtaaggtgataggtatgttacttagcataatttacttattccacagtgtgtatatatatcaagacatcacgttttacaccataaaattgtgtttgtcaattaaaaagtaaatttataaaaagtgacactagcaaaacacagatacacgtccttcctagagagtatttaggtattactattgctttacttgcaggtcaatattacctgcatttttagatagaatggtttgatttaaaccactcagaatcatgttgaaagtgtgcattggatctcatacaaaatgggtcacttcatgagagttgaagttgagaagcacttcagattgtacttctggtatacttggaatggagcacagggcaaaggaacattgtaatgtgatttagaatatgaaatcagtgcttgaaataagactataatgtatcgatgaagtacatcagcatttgcgtctatctcttaactcttttacctccacagaccactgggatagaatgtcagatattggttatcggccaaatttgggcttcagtcagtgaatttgaagacaggtcagtagaaattctccaaactgtagcacatagagaaaaactattgttatggaatgaacagatcgtcagtgattgggagagaatggcaggtggtgtaatgtatgtgcaattggagtgtcaccagaagcccagacagatactgggacagaaaatgtatttgaggaaataatgaccataaatttgatgaaaaattgtaggggtgtagttaagatgaatgccaaatctagatggttaaaggcaggggtcaaatcaagaccatggtacaaaagattttgggtggggagaaagatgggtataaaacgtgaagacccatcttactcaaagaccgcccctgtttcatttccccactccgaattccttttagaacaaatgggttttggtgacagtgtgttcagatggaatactcacagacttggactcacacctgggttcaaatcccagctctacctaatctaactagttctgggtccatggcaaatcactatagtctgcatcctaggatcatcatttgttcaatggagatagtgatatctctttggcaaggcaggtctaaatggtgtagaatatgtacgttttatagggtggtgatgcgcacatcatagctaggcccttaacagatagtagcttcttctcccaccaaaccagttctttttgtggttatctggtgtcaccgttcacccacttagctataaaccagattaagaaaattacactttttacaaagggcgtgaagaactatggaaatgataggatcatctttgcatgttagaatgattgctccagcctgagtgtgaagaatggcatgagggtgtgagacaagatttgaagaaaccagattgaagtctctcgctacagcccacacacctcttcatacccttcccaaacaaacaacagtattctcctttttcacaaaagagcttgattttcctatttaaaccacagcctcaactattaccagaagaaaaaaaaaagaccaaataaaaattatctgggtccccttttctcaagagcagagagggcacactctttaatgggttagagatgggggctggaccaggtggtagtcttgtgtatggagtccagtggacagagctgagagtccctctactgacagtccctggattcatcaccaccacatttctaagaaatctgattattacctccccatcagagagagacactcctcgtggtacagctgtgatcatatcattcctttgctggggaaatcttggtcactagaaagattcctgcactccttagtctgacatgtaaggttctgcagaacctaatttcaatctactctcctagccttttttaaatgaacactactactagggccgggcgcagtgggctcacacctgtaatgccagtactttgggaggatcacctgaggtcaggagttcaagaccagcctggccagcatggcaaaacccatctctactataaatacaaaaataagctggccgtggtggcgcatgcctgtaatcccagctactccagaggctgagggagtagaatcgcttgaacccagaggcagaggttgcaatgagccgagatcgcatcactgcactccaacctgggtgacggagtgagactccatctcaagaataaataaataaatacatgcatacaacttctcacccaacctgtgttgaggccttgtcatctcatcccttactctaaccactgcacaccctcccatatattcagttgaaaccctactcttccttgaagtctctgtgactttcctcagtccttccccctcaacccttctttgtgcctttgtttatgggataaggtttatcgccttgcattatgattagagattgaatggattacccatctctgcctgtgctctaagctttttgatgatagggcctggtcttggattacttggggcctagtctcaaatataagccctgaatataaatacttgttagatgaatcacgttctttacattgtcgatagaagtgggaaaaattctttttattcatttatttaatttgcccagagttgcggaagaactaattttaaaagtttaggtttgaatagaggagcaaaaagtcatagagagggacttaaagaggaagtctcaagggaacttctgaaaacttctttgggctttagctgttgatgggccgatgttctttatggtgccagctctcgttttgatgtagatgtctgacgagcctagttttctgggtactcgttggatgagtgacactcggagcctcagagaggagggatgcagggtgcaggtgctaggtgaagggaactagtgtttactgaccatctaccgggtgccaagccatgctgaaaggcagagatttccaagggaggaaaatggttgggagataggaaagtgacagaggaagtattctatccatgccagaaagacgtaaggtgtaaatgactgtgtggcatgccataggaaaaaatgggaagtgtgaaattcctcagattcactgcacagtaacttggggaagagctcatgatgctagtcaagttatttcttagcctctggacctcatggttcctgttatgagatttggctaagctagtggcagggaaccacggcttctagtgttttcttcaccccatttctacagcaggtgactgttcaggtgactataggggaggggtcacatgtgatgaaaacactgagtatctcaaaccagctgtcttgcctaggcctcagttttgaatgtggtagatgaaaggtttaactttccactaatagccctcccagctctgctgttccttctgggatgaaatggagtgatccaggctgatctgctgatgttttactgcttgtcaagaatgctaagaagagggtccccttgtggctgcagattgctttggggacctttcatgaagatttcttcatctgggacctctttcccacatccatatgtcctacattttctcttaggattgagctagagctgagatcattctactatattaatcaacacctactgcagtgtcatggtcattggctcattggaattccatagatctcctacccactctagtagggaaaagcaaattgcagaaaccttagaaaagtcagtgcccatgaacagacacatttaggaaatagaaaattactaaaggatgcctcttcggcaaactgggtgccatatgtgtgcatatatgagtatatatatatgtttgtttgtttgtttgtttgtttgttttttgtttttgttaaggctttctttactttgccccaggccagctggtgtgcatatttgtcaggtcctgttagagctctacagctcattctcagcctgcctgatctcagccttgctctcaggtcctcaggaggagtttgattcttttggaccgtggtgctactggctatttaatcctttatcgtcaccatgtccagctagcaaccacttgccttccagcagctgggagaactgtgctggtccagggagctggttttgagaagcctgggcttccacgagcagaggtcattctgtctagagatccatggctcaccagtccatccctggggagcagctgtggctccactgtccttcagagatacagacacagtgaggcacattctgaggagagcagatagtgagtagatcctaaaatgtgttgaatgaggagcagatgaaggagcttggattctgcttggtgacgacgaggcccgtggagttaccagagttgtcttcaagaggtcagagtgttggcaggttgtcataaggaagaggggctaaatttgtcccttgtgacctcaagggagagaattagagtgaaggaagaaacataccaggggtttgattcagtgtaggaatagctttcaagctctcattagatctgtaaaggggaatgggctacttcaagaggcagagggtaatttgagctttgactgaacacttgtttgctgtaatatgaaaggggttatgaagatttccagggcattgaggctagatgagaaggaaggtcccttccaaccttggaattctgattcttgacccctcttggtaaatacatacctggtactcttcagagaatattcccggggttaaggctgaaaaatagcaatgtgtataaagaacctggagctgcattaatcacagtgcagaggtacagtggagtgtacacgtgcatatgagcacattttaaattagggaaggggctgaaaagaaaaattaatcaaattaaagcagcattaggaatgatgtggacagaaggtaattagttgccatcaaatactgaaaatatcaatcaaccgctaattgctatatggtttcttttattagcagaaggtattttcaaattttgtagatttcaatcaagagtagggataaggaaggtgtcttgttgcattatttaacatgatgtagattttcagaaaagtaaagagcacagaagataaattgaaatgtttacattttttgccacgtattcatcttccttgttcctagcatcgtagagctgaaatctgtctttgaatcccccctcccctgctctcttctttgctggatagctgaccagaagagacttactccaggccaccaagatggtgtctgggaatgtgtgtccgtggccagggtctggctgtctctcgtccactgagctacctttctagagttgagctcaggatatttctggtctctgcctatgttccaccttctgatcaaggacctacagctatccagctgtagccggaattgagggtccttttgttgccctggtcagaggtttcatcaaggtgcgcccttttgcctttgaagaggccagggagccgtggagaggagcaccttggaaatgcgctgcatgtggtttgctgtttctgtgcccctgactctacgtgtactttattgatatccagtaaatgcccagtacagaaaatgcacctctaatagggtgctccataaaattatgctcccttcccgagatccacgtgaactgcatgtcatttatcaggtgccactgaatctatgtaatgaataatttgatcccacagcaccatccttcaaaccctgtgtctgcacggggaggctgttaattcagcttgcttgcaggcatccgtagtggtccacagagaccagcttctgacgttgtttccagggaggtatagcagaaaggacgtcggctttgaattccaggccttccttcatgggaatccagagtctgccttggttctatctatgtctttgggcaagtggcctaacctctctgaatctctgttttctcatccttaagttggggctagtagcatcttccttgtagggttatcaccggattccacatatacagatatcagtgtgtggctcacagcaggcatttggtggatacaaactcatttattcctttcccttaacttcctttttcttcatactctttcctagaaaacgatactcagttacttgctgtttgtagggaaaattttatttactcactgatcacaattgtaatgtcacagttaaagttgaggagaagaaaaaaagacgaaaaaagatcttgattctctttatcatttccttccacagagccatcagatcattctatgaccaagtgagatgttataaataatttagttctactcattttttacatgacagattaaggcttcagacatcctgctgtgtgactcagagacacacactcacctgcccttggttgagactaggtgtctttgcaggttttgggtgacaaagacctggctggtgatactgagccaggagatggtgagaaggtcaatatatgaagacgcattaagcttttgcaaagctgtgggttcagaagtagccattagagagggatcatctgagttgggtgataaccaaagagttttatgcttgagaaatggagaaactggctcaggaattctgtaggcagcgtccagagaggctgctatgaggctgcagtatggtacgtttcatctgaggactgggggccggctctgaggctgtaccacagcatgctgtgattctcagagatcagggtgaccagaggagcagctctgacctcgagtggactgagaggggatttagagggtgtgcctgcgcatgtggggagggcagaggtggtgcaggcagggagcctaagagaacagagtggacacgaacgcttactgagtacctcatagatgaaatcccctcagtgactgtgaataatattctctttactcctagtttatagatgagaaaaaaaagggttagagagtacagagaatttgcctgaggccacacagtaagtgtttcagcacgtaagtctgatggaaatatgccccattcaacacttctgaatccacgtctataatctaggaatttggaagaggaaagggagaggtgaaatgggagctctttttctttctgtgtttgactctgcattccccgtcctccccatataatcagtgaatttccactttcgaagcctcaatggatgggctgaattctccataaactggcattcttctttttaggaatccctccattatgaactacactacattgataaagatgctctgtgaaaatttcaaagtgttacagtttaattcagcagattttttccacccgaggagcctcatacgtgcaaggtgcaatgcatgctgtgctatgtgacagaatacagtgtccagggaggtgggccccatgttcagagttctctgcagagagggggttacagggaagccagcaggcattccatagggtagactatgtacgtgcctgagttaagggggtttggacatgctttggggttttaagaagagagctttgtatctgattgacattctggaaagacttaagggagaaggttataccggaaatggcactgggtggatgggcagggtttcctcaggtggagatgggggtgtaggaagtgaagtatgcacacagtcaggagggtggccataggacaaaggttcaggttggctgatggtggggtatggatgttagaacttcaacaactgccctcattttgtgggttataaaagtaatgcatgctcattacagaaaatatggaaaatatatgaaaatacaaaagaaaaccagaggcaaccattattccaatattttattgtattttcttccagactatctgtcagtctgtataaacatttttgaaaaacttcttttgacagttggaatacatacttcttatagaaatttggaataaactgaagagcaaaaagaagaacataaaaatcacctgtaatcttagtcagtaagattcttaagactgtttaagattcttgcatcttacctatttgtgggtttgttgttgtggtggttttaattgagatggagttttgctctcgttgcccaggctggagtataatggcgtgattttggctcactgcaacctccgcctcccaggttcaagcatttctcctgcctcagcctcccaagtagctgggattaccagtatgtgccaccacgcctggctaatttttgtatttttagtagagatagggtttcaccgtgttggccaggcgagtctcgaactcttgacctcaggtgattccccccaccttggcctcccaaagtgctgggattacaggcatcagccaccgcacccagcctgttctgtagttttaaagaaggaagatgacaggtttgaaagtgcatgagatggagactgactggaagggatgagaaaggcggcaaggagggagctgaggcgggcggacagggaggagggctgcagtgagggagctgaggcgggcggacagggaggaggctgctgtcaccgtctagctgggaaaagaaagtacataaaatttgagagactggaaacggtttcatttgagatgagtaagagggaagcacagaggggactcccagcttttctgtgaaggatctaggaaaatggtgatgctgtgaaaacagagacagaagatattggcttggtagtcagcttggtggtagctgtattgaatttcacgtgtcagggagccccccaggtggggatccccagcaagagttggaaatgcctgtcttttttaagctttctcaggtgggtggttaggggtttgacatctcgatttaagtcattctcagatggatgatatgtggtttgaactatatagaaagaggctgctctaagaatgtgaaaagggtcgggtgcagtggctcacgcctgtaatcccaacactttgggaggctgaggtgggcagattacctgaggtcaggagttcaagaccagcctggtcaacatggtgaaaccccgtctctactcagaatacaaaaattagccgggcgtggtggcgggcgcctatagtcccaactacttgggaggctgaggcaggagaattgcttgagcctgggaggcagaggttgcagtgatccaagattgcatcactgcactccagcctgggtgacagagcgagactttgtctcaaaataaaataaaaataaaaataaaaataaaagggtaaacaggaaagcgtgaagtgtatactttacagcaagctaaaacaggcaaagccagtttgttactttgaacagtcagcagctgtgacggcactggggaaagtgtacagtctcagggtggaatggctgtgccactcctcctatccagcctaactttctaggatcccaggggtggaggctgccctggaaattgttgtgtacgtggctgtgttctgagtgaagtctaaaagcaggggaaagagctggaagagagggagcatttggataagacactgaaggaacatgcggtaactgcacatgttctaatgggagcccagcctccctgttggtttccactctgacaagacagactgctcttcctaccccatctgttgttggagggtttgttattcagtggtacccttagtaggcagaggtggagagtggggcattctagttaacaggagtgtgctagttagcaagagaatggagtgtactagttagtagaacttgccctagccaatttatgtagtgaacccataggacatgtcagatctggaaaactgcctttcatgagtgcggaagatgtagtggtcggcctcttaggtatttttagagaatcacatttgaacaatcacaatcacagatctttaccagtcaggtcaaaatttggagtgtcaatgtgtttggaaaagggctttatgaaaatttgaactttctttaaagttcttcctgaagatttcatatgagaacccaaatcttaagggaaactaaaatctcataataaaaaatctcatagacacagatattcatgagtaatgacagattaaaattgtgagtagaaatgcaggaatcttaaggtaattctaaataaaaacaatccagtaggactattggaaaattcttaccaagtaatgattttgtaatgattgtgtcaaaaatgtaaatttgattcagtgacacagttgtaattttgatatgttctttaagtctcttaggtgcttaagtcatgatgtaagtttgaatatttttttccttcaatttaaaactttatttctacggaatgtagatgtccttcagaagttcctaggggaggtggtggtggtgacaggtaaattcattgtgtctatgacttccaaaggccagttttcagaccactgtcatcagtatcaccttaggttaaatattttgtaaggaacaattcagatatatcccggaagaggtaccttttatgctttagtccaggccctctgggttttacctgtttcttgttgtagccactgctgcagcagggaaccctggaaactctaatcaccttcgtgtaggtacaacttgaaagtgcttctctcttcttgccttctgcccaaggtgacacacccatgtgtgtgcaactgtgaaaatgagcctgcaaactcaaattctaaagaatatgaataatgcaaagaaaggaggcaacaatatgaagaaatgaaatataaattgactcgagttaattttttataacaaacaaaagcattttaaaatgtgtgtttaggatgttcaaagaggtcagtgaagaaataataaactatgacagaaaataggcaaaataaaagaactaaatataaaacttggaataaaaaatagctactgaaataattccatacctggaactcttagattgaacccagttgatgaggaacttagttaatgttttagtgaatagttctgatgcacatagagcaggaaaaagaagaatgtatctatcaattaatcagcagttaaatgacacagaggataagttgagatgtgtcaactgacatgtaaagggagttctggagaaatagaattgcgagaatagtggagaagcaatatttgagaatataatagctgaagactttttagaaatgaagatgtgaatcatcatattcaaagtatattttaagccctaagcaagataaataaaaatgaatgacatctagatttataataaaccccagaatattaagaataatgaaaaaatattaataactgtagaaagaaaagacattgcctacaaagaaatgaccatcagactgacagcaggcttatgagtgccaatgatcgtgagaagacaatggagtaacatcttcaaagtattgatgaaatgtatacccagctaaacttacattcgatagtatagacataatagaaatatttcagatataaaaagacttaagagattttataactcatagacagttactataaaacccttttaaagatatatttcagtaagatgaagaattaaaggagagacctgaagcataagaaacagtaattagttaaacaatgattaaaatgttgatcactgaagcaattttaaaaaaataaccctctgtgtgtgtgttagaagaaaataaaaaaggcaaatctttacactgcggtaatgagatagagattgttcagtgtggcgggttttgagtttgggagaaggttagaaatactaactttagacttggtttggaaaacatagtgaagtgggtatgtaacaattgtaagggtaaacactagaagaacagatttttttttcgttttgcctccaaattggccaagggtcaaaggcagtcagaaaagactaataggagagagaaaatgagggaaaagaaattaaaggaagaggatggtaagtagaaaacacaaaatgaggttatggaaagaagtttaaatagccagagtaaatatattaaaattactaattagaggaagagattatcaaattggctaagaaccaaaatcctgttatatgctgcttacaagaaatgcacctaaaataaagacacatggaaaggttaaaaaagaagactgggaaaacatacgcctggtaaatgaatacaaaaaaggtaatgtaggtatcttaatattagaaaaaataattttaagaacaaaagactttaatagcattaaaaatactaaacaataacaaaaggaatagtagcaagaggataataagacttgtgtatgctaatagcatagcctaaactgtgtaaaagaaaaactgacagaactaaaagagaaatcaaaaaattcacaatcacaggaggaaattttaattgaatctctaagaatcagatgtctcaatttgccagaaaattaaacagatatagatgatttacataacaaattgataagcttgtccataaatgtctgtaaaaccctgtacctaagaaacacatagagagaaattttatgcttttcaagcacacatagaatagttacaaaaattcaccaggttgtaggtgacaaaataagtctgaacaaatttcaaaataatgaagaccacattctctaacatgatgcaatcaaatcggaaataaaattgtgaaggtagtataacaggccatatgtttgaaagcaaaaatgtatacttttaagtaattcatggattaagaaggaaatgaaatggaaattacatcagaagagaatggcaatgaaagtactacatatctatacgtgagatgtatctagaacaaaccttagaggttaaaaacatgtattagaaaagaacacttgaaaataaataagctaataattcatatcaagaaggtaggaaatgagcagactaacagaccaaaaagtaaactgcaaaacaagataatagtaaagaaagagcagaaatagaaaacagaaaggaaagatgataaagaggatcagtgaaacccaaggtttgctctgcaacgaaaacctctaaaaagagagatataaaaatatgaatacatgacaatgaaacaaagcatcccctaatgattctcttccttctctccaaagtccaggtgcttcaggaaattttattgtaacttcacggaacaaataattttttttctaatgcggtgttacataggagagaaaataagaaaggctagccaaccaattttctgaggccagtataaccttgataccaattctggacaaggacaatataagaaaataaagttataataaatcttcataaggaacgtaaatgacaaaatctgaaataaaatagcacaggtagttcagtgttaaaatgctctatgagtaggtaagatttactgaaagatgatttagaaaaatctgttaatgtaatatactaccttaagagattaaaggagggagaacatatgatcatctcagaagaaagcatgcattgttaatattcagaactcatgcatgataaaaagcttttcaaagtaagaatggaaggaaactttctcaacctgataaaggatatcttgcaaaaacctacagtaaatctcatatttattggatccttcccactaatattaagatgagacaaggattcctagcattgtcattattcagcattgtatggaaggtcctaggccaatgcaatacaatgagataaaggcaggagaataagaatgggagagggagacagaaaactcatttgtacagaatataactttctgtataggaaatcaatgagaaggtggagtcaaaccattagaactaatagaattctctactctttctggctgtatggaaggcatactaaaatcagggtgtttttatacaccagcactaagtaatcaaaaagtatagtagaaaaaacagtatttataacagcaccacaaatcatggggtacatagaactatatgtaatacaaatatttaagatctttattttcttgcgatggagtctcactcgctcactcaagctagagtgcagtggtggaatctcagctcgctgcaacctctgcctcctgagttcaagcgattctcctgcctcagcctcctgagtagctgggactacaggtgcacgccaccacacctggctaatttttgtattttttagtagagatggggttttactatgttggccaggctggtcttgaactcctgacatcaggtgatctggctgcctcggccttccagaatgctgagattgcaggcgtgagccaccatgtctggccaaatgcttaagatctttatggagaaaattataattataacatggtattgaaggacatccaagaagacttgaataagtggagagctatgttattgttttcatagtagtaaaataaaaccttgcgtaagtcctcattctaccacatgttaactaaccctctagctgatagtacaaacactcactgcgggattttatttataagggctctagaataaaatatgagttattcacactaaaatcacctgttaagtaatattctgaactagttaatgcaggttttcattgtgttgtggttggtctcataactaggttgagtttttctcctctgctaagaggaaacaatactgaagttgtttttcttgtggcatttgtattataaaaacttggtgtgggggtggagcgcaaagctccagcccactgaatgtctgccagttaagatgatgttgggttaggttacatctggctactgtcctgggaaaatcacttttatagagatgggcttccaggtggttttaaaatttatctttctattgacatttgtaggtcaattatatatgttgactaaatttacaaataaacttgtgtgtccaaaccaaattactaatatgacaaaatatttccaaattcatctaagttcaataaaattctatttaaaaattttaaaggatatgttatggaatttgacaagctgatattaaagctgaatagtaataggccaagagtaacaaagaaaaatttgaagaagtataaggtaagaagacttactctactaggtattttgactcattaaaactagcctgattacaaccgcctgatcttttcctacacgtctgctccatccacaaggttccccacttaagccagtaatcttcgagtcagccataaccctctctttctctcaaactctgtgtcaaatctgtcaggaaatccttttggctctatcttcaaaatatatccagattctaatcatgacccatgacttcctccaccaccacttggtctaaaccaccattatctctcacttggattacagccatagtttcttaaccattcactgcatctgtgcttggttcactctagtctattctcaaccgaggacagccagagtgattttgtaaaacataagttttatcatttcctctcccgctcaaaactccaatgtggctacccattttactcagagtaaaatccgtagtccttaaccatcccacaaggtcctacactatctggcttatctgatctttgtcctgctacttcctccttgtttattccactcaagccacactggcttccttcctgccccttagaaatagcaggcacattcttgttgcccctgtaggactgctttctctaccccttgctggggatatctgaatgggtgagtgcctcactgcctccatggctttgtttgcagtcaccttcccttggaggctcaccctatttaaaattgtgctttcccagcccacctgatctctctgacctgctctgcttttcttttcattttttatagctcttgttaccttcaaactatgtcatctacctaggatttttggtgtttttaatctttttcccactagagtatacacactaaacagggtaggatcttgtttgctttgttcactcatttatcctgggtgcttagagcacttcctggcatatagtaggcactgaaaaaatatttgttgaataaatgatgaaaaaacagtataggattggtgcaggaatagacaaatgaatggagcgtaacagaaagcccagaaacgggactacttacaacgatgtcatataaaggtaacattggagataagtgggagaaataatggattatttaataacaatttatttgggattcttggttatgaatatggaaaaaagtaaactgaatccccacctcaccccctacataaaaattatttccatatggtctaacaacctaaaattaagcttaaaattttaaagcttctgaaaatataggatattatctttatctttatatatggatggacttcttatacaaggtacagaaaacataaatgataaaggaaaagatagagaaatttaagaacattcaaatttaaaacatctgtatgacaatagacataagtgaagggaaaagcaaatcagatatgaggtaatatctgtaatcatataactggcaaaaaatagcattcaaaacataaaaattgcaacaaaccaagaaaaatagaagaacccaatagaaaaatgaacagaggcactttataaacgagtgtacgtgagtggcccatatactatgtgaagagatgctcaacctcagtggtgattagctatgtatatgacataatttttttttttttaagatggagttttgctctgttgccaggctggagtgcagtggtgcaatctcggcttattgcaacctctgcctcccaggttcaagcaattcttctgcctcagcctcatgagtagctgggactacaggcatgtaccaccatgcccagctaatttttgtgtttttaggagagacggggtttcaccatattggccaggatggcctcgatgtcttgaccttgtgatccacctgccttggcctcccaaagtgccgggattacaggcatgagccaccacccctggctcgaaatatgattttaagcccatccaattggcaaatatttatatactttgtaacaccaaatgcttgcaaggctgtggcacaacagagatcctcctacactgcttataggacgattgtacctggcaaactccttttgcctacttgtccctgtagcagtgatcccagagtgcccaggcaatagctgtatcttataactcaatggagtcttgctatattcccagataaaagtgtactgttttggggactaggacctctaactctacagagccaagagtgtgggaacaaaagctacaaagtctcccgatgggtccctgagatagtaaatgaagtcaatcctgtttctctcctttgctttccaaacacgtgtattattcatttggggaacatggtgtgtccctacctttggagtgtttgattcagtgtcctggagtccggcacccacctgcacagtttgttcactgaactggtgctgtggctgtgccttggggctattccagtgctttttcaggacggcagttcctggtgacgtgcagtaaaataaaacaggtggaaaccagctgtgggctcactgctgcattttccttgctgcaaagtgagttgcttggtctgatggatgttatttaggggacagaagttggccaagaccctgaaggcaggaaagtcaaacacgtgccaagaatacatgtatgtgagtgtaagaacacatcactggccctttcagcatggaaggggcccggtgtaatcctttgccaccttatggtgggttggtcctctcaaggagtggtgctgtgtgaggcacttggtgacagtctctgttgctggccatttggacatttggtggtggcagtagctaggtggaccttggtgagcgggtgtgcatgctgttgggccatgtgtaacctatctctgccattgtggccagttcgttcctgcatccattacgcaggtactagggtagccagtgaagacactggctggcatcccctggctgggcccctttccatgctttgtggatgagtgcctctttcatggtagatgccctctggctggcattatcatgtggtaaagagatcttcatgctgcatactcactcccacatgtccacctatgtctctctaccccagatttcctaattcttcctcttccagtctttgtgtttctggcctctgactaggcagccaagccacttgctgctgcccttgagtccacagctgtcctgaacttgggctattcttccctctctgaaggaaccagttgggaggatttttcccttacccctgtctttcctggccactctagagtaaggctgcagtggagctgccctgcatttccagcctgcacccatataacaaaccaaccattcaacaccccaccccccgcacccccatcccccaaatcggcctttctctctgcccccagctggttttacaggatcgccacacagccgtaggtgcgaagtgagggagggagttggtgcagcctggtgggtgctgggggagtctggcttcctattcgtgcagctcacgcgtgccctctggtcctgcttgtgcatgattcccgatgtacaacttcctctttatgatagactgtggctgtagccccttgaccttataatctggtgggtctgatgggacttaccttttgatgggaaatttcagccacatcatcccctagtgctccatggctgccatggtgtgcactgtgcagtgtgcttcattatcacccatgtcatgatcttgaagtgctttttcccattaaactaggcttcttggtgaaatggtcgattctgggactggggtaggaaatgtgcaaggtgagtctgggacatcctgtcaaaccagagagcaaagaagctatgagacaactgaggagaaggagccaatttgaagagggtctcactggccaaagatatgactgctgaagcttacatgagagcagtcattgaaacgatcaaatatgtttaaatgaatatgtttgtgatgatgtttaaaaaactcttcgattagcctgggagatagcaagttcgtcatcttgaagacactatgtaaatggatgaagcaagcatttatcttccctgtcccatgtgaattgtaccactgagtaacaaagtagtagctgaggggaagcttttcattataaggtatgaaaatgaagtgatagaattagaagatcactattttgcaactctccaggaattaatacatctaggcattgagcacccatcaatgctaactagacatgaaagagacaactagacattttgtgctttctaatcaaagaccatccatagccccacctctagtcttgccagaggatcaagtctgagtctgatgaagcctctggatccaattgtcaacttgcagaaagttgtcctctgaggacggttgtgtgaattgaattgcaccatgagaacacagtcctcagaatccacagtgtgagaaactgaacaggtcaagtagactgtgatcttcaagggataaggtcaaaggaaaagaatggagacaatgtgttgattaaaatgacttaaagacagccggatgtggtggctcacgcctgtaatcccagcactttgggaggcggaggggggcagatcacctgaggtcaggagttcgagaccagcctggccaacatggcgaaaccccatctctactaaaaacacagaattagccgggcatggtagtacgcgcttgtaatctcagctactagggagggtgcggcagaagaattgcttgaacccgggaggtggaggttgcagtgagccgagattgcgccactgaactccagcctgggtgacagagggagactccatctcaaaaaaaaaaaaagaacttaaagacgtatcaaatttaaaaaaatgagcaagactataatgtcaggggtggacacttagatgataaagtgtaagaaacataggaagtgattactgtgaaagtcagataacggttgctttttgggctataaggtttctgttgggattggagtgtagcacacagggaggcatgtctagggtagatggcaaacttctgattcttgacccaggtggtggttgtaagggtgtttgcctaataacagtgcattgaaatatatgtttgttttgtgtggtttttttgcatcagttttgttttataacaaaaggctaaaaataagtatttaaagaaaatagtgcatactatattttatttgctgatattcataatgatcaccagattattgaaatttatgagtaattttgctataaataagcctgttttctttgtttaaacacacacacacacattttcacactcacaccttcaaagccacataatagaatgtttagcttaaacctgcagccgctagttgaaatgttgcttcatggagttttatcctcctaacaacctgtgtcctaagtcacattcctctccagaaatgtggacattgaccatattccagtccctgagacgctgtttcagccacacgtggcaccccagacccttgcccacctgcatcctggtcattcatcctcctcctcatggggtcatttcttgatccctattaagcattaaaaggggattaaatatctctctacttgcagctaatgttttgcttggtttggccaagaacattttaagttttaaaaacctggggctattggagtgggaccatgggcaaaggtcaggacaggctagctactaaaatggcctgccacggaccttgtacgtgaaggttgaaggattctggtgctctctggtgccatcgctgttagtcgttgtgcagcacagaaatattttattcaacaaactctgcagactcctgaactttaggggtgggctgccttctgcctggtgctctgcacagatcctggagctctcgtggtcatttatgtgcagtgaagctgctccactcacctacagcttgtccttttccagagaatccctatcatcctcccctcatcccaaggaatgcaacaaaggaaaattaatagtgaatgcttttgccggagacctgtggatacttaatttttatagatactcaataaatatttatttatattcactagcagcaagcaattcacttgtaaactggtatagtggcgggtaacataagcataagcagattcttatgttatttctttgaatattttgcttttctttaaaaatgtaaattttttattcttaaagtaataggaatttattacagaaaaatttgaagaatgaaaaaatattcctaaattgtcaccactgtaatacagtagtggttattatcactttagtatacttagtatattttcttccagtctaattttggtgtgaaaatctttagtagttataataaaagtgcatgtaattgtgttttttcctttttactttagccttaggtaattatgatatcacaaacatatttccatgttgcaatattatcacaaaataattttttactgcattaaattttattatttggccttatatttttattttaacctatttttgattaacacattttagcaaatagaatatctttgtataatatataactttattcaaattactttttgggttttgttgctttggatttttagagtagaatattaaagagtgtcaagaatttcagtaaacttctaatttatctttcagctctgtcgtcaaatctggtaaatcgagtgagtgtaggagtgggaggtgtatagtgtatattaatttgccaactgttgttccactcaggatctcagttatacgtaacttcataaagccatataaaatttgagtgaggcagtaatcttttttacatctagaagtgggccatagaacaccaattgtactggacagtttagaaacttatggtacaaaatgaaggttctgtatttggagcccaaggaagtgcatggcaacatttgcgacgtgcgtgagtgtgtgtgctcttgggagatgggttgtgattttcatcagatgttcaaagagatcctgtgcccactggtatacacacaatgtttgctagttgaatggagtgctacttttgtgagtttgtttattgttgtcattctctccctgcctcccttccaaacccttctcctgcgttcattatatccagaaataaaactcagaaaaatttacttttgggtaagcagtgatttatcacatgcaagtttatagtgattaaaaaaatgaaaactaaacacatatgtgacattgttaattggaaatatgcatgaatttatgttgattttggaagttttcacattaaaatgggtaacttagtgctatactttggtaaaatatttttttaaaaatatgtgaccagggagtggatcattcagtaaattttctattgattcaagttatgaattggatgtggaaatatgaaaatagttacccccttactgtgttatttggaaatgtgtagatttactaactcctttaaatttgaggccttctaagtttttgcacagctaaagcaaagagatattctatgcaaataattgtaaataaaattatttaccaatgttaagaactctccttctttaaaagataaaatcttagtcatttttggttatcaaatgacaggagcaactttttttttttcttcatgtaacaggtgtatgtggatgtgcaatgaccactttgttttgaataatcagtatcctttttttttcttttttcttttttaaggaatgggatgtttctggggagctgaaaggaaattctgggtcttgaaaggagtgtattcaactcaagttggttttgcaggaggctatacttcaaatcctacttataaagaagtctgctcaggtaggaagaatttgctttattgtattactaggagaaacaagggagggcttgtcactactgttgggtgacaggctctttaaaatggaaatatgtttttttaaaaatgtttcttcaatctttattatttgtgtatatatacttgtgagcttctcactttatatgtttagaagatgataatcttcctgtggagtgcaccatttagcttttgctgtggaacaaccactctaaaacatggtggcttaaaacagtcattttattagcttgtaattctgatgatcagcagttgaggctgggctcagctttatggttcttctgttagcctcacctgggatttgctcatgtggctaaggtcaacctgtgggttgcctgggggctagtcagcctaggctgctttactctttggcctggcagttggtgctggctgctggttagcactaactgccagctggggtaatggggatgatggaccatatgtcttcagcacactggcctgagctaattcacatggtggtggatgcagagaacctaagagcagcaagagaggatgaggcccattctctgtttgtgttacgttcacttttataccattggccaaagcaagtcatatgcgctagctagaccagagccaatatgggatggctccccaaaggcaaggatataggaggtatcaagaatcgggaccattatttcaacaatctaccacatgagacagacatttcagatactggttgtgttttctgtaaggaaaaacactgaaagccgtgctataatgcagggatcagcaaactattgacttgactcataggccaaatcccacttgctgcctagcaaactattgacttgacttataggccaaatcccacttgctgcctatctatataagtaaatttttgttgaagcacagctattctcattgttattattatatattatctatgagtgttttcatgctacagttacaagagttgagtgcttgcaaccaactatgtggtctgcaaagcctaaaatatttaccgttgggtgctttacaggaaaaaaatttgctgacctctattctaggctaacagggtaggcagatgccctcatggcaaattctgtctcgaataccagattacctctctggacttgtttctgacctaaaggatttcctttcctttcctgccagctcagatagcatttgaaatgtttttctaaaaaaaattatattcaccattttaagaggtcttaatagggagggagtatctggagttatagtccactattattgatgaaaatggggtgtaaaatgtaaacagttttatctttctaaaataaagtcttaaataagtgtggtttgtggaggatgcgctcagccctccgagggcaccatgaatgatggaggggaaaagctggagtttgggagcttggtgaatagtgagcatgttgatgtgtttgctacaatatgaattctattttgaaataaaaattgagctgtacaacaatgaaaatattataaaaatgtgcatgttcttattttttcttgctctagagaaggattgaaatattctgattcgtatggagaatgtggtgtaacaaacaaatattttaatggttatcctatttttttttaacttctgtttcaaaattaaacgcttatgcatagctataaatagactcaaatgaatcctggagatcacccaggtgtatcctctcaagtcttaggaatggaaatgagtagattccttcctgtaattccagacgtgacttaatggcctaagagaaaaaggttgctaagaaaacctccaagtatctattgctttatacctattatcctcaagcagcaaaatgttaacaatcagttagaatattgtgattccttgtttgctcgaacccttttcagttcagctgtttaccttaataacaacatgataattgccatgtgttaaactcatgctatatgccagacactgtaataagcactttttctgtctttgcttttctctaagcagttccatgaagtatgtcagcttctatcttttacagagggagtgtagaggctcagagaggataaataacttacctaaggtcatacctagcaggaatccctccctcattagctctcagctcaaagtctatgccattgaccatggtgtaagtctcccagctgtcatcatatcccagccattctccattcatccctttgcactttcttccaccaagtcacaaattctctttcatatatgtccctctggtatatttttaattatattagtgtgcttttaaatgattaaggagaatgccaaggaaattcttttgtctttcttatgtttagaaggaaaaagggccaagccagttcatgcaaacagctggtatgttagaggcctctagcaagtggtaaagtatggaaaccacagagactggtaaagaactcgattggatatgaacactacctgctaagttaacagtagcattgggaagcatggttgtcatggaaacttgttcctgattggaaagggatagttatagggtcttacccatacacagaaggagagacgatttctttccctaggcttttttgttgttgttgttctgatcataaaagggaaaaacaaaaaggcagagaggagctatgatagaaaggtccctctggcacagaagtggtacagccttcagatccctgggaataacagggaaggagaacaaataaggtccctcgctagagtaattatggtaaccagctaattaaagatttttgaccaaggagaggggtgggggagacataaagcaggttacactggcgggcctcccctctgaagcctctggtgctcaaagccttgctgaacaagtcagccctggagtggtctgacttaagagaaggaaaataaacaaacaaacaaacaaaaaccccaaggctctggtaagatgcatagtaattgctgaggtccattgtgggagaaatactagtctgtactctagtatctgcttgcaattaagtttgtaaaactttgatcacaatccgtgaatattttgtaaagatttttacttttattttgtcaagaaaagaagcatagagacctggattgtgtgcagattccttctctcataaagcggtatgcttgagcttaaggtaccatgtggtttcttggggcagatgccagaaatataggaggaggggttaacagaatccacagggccagctttaccaccgctctgtgcaacctcttatgtgatgacgcacatcagagcttccacaagcattatctcagcacacaggtgggtgaacacaggccaaggaaccatcggctcaagtttgctacccctgctgtgccagtgggtctgcacagcctcaacaggggagaagtgagcgagagagtgtggatgtgagtgtagaagcagtgtgtgtccagagagggtgtggattcatgtccgaatggtatttctatgtggaaattgataggccagtgactctgaaccccaaatcggagttgtgactaggcatatagaaaagataacatggcttctcatagtagctgagagaggaggtgtccccatcgtgggctcactaatggggctgttcatggtgggcagtctccattgcttggtgccacttgcacccgacatgcgtagagaatacaagggggcggtctcttaggaatttagaataaagtcgcccattgagagtggcagtataaaatcagcctgctctgaatcacagtggagatggacagtcacttggaagagagattggtttctgtgtctgtaggatttcagagtaacctagtggaatgccctgactgtgtaaaaggagcataggtcctcagtaggaggttggtgagctagaacagcctgggagaggggaggtcctggccactctcttgggtgttctgggcagacccacagagcctgataccctggcacttttaagttgtatcactaacctcgtgttctgatccatactctgtaaaactttctaatcttttgtcctcctgtggggattatttacagaaagaaaatgcaatgaaatcaggttagtcaggcagacagttctaattcttatttagaattcaataaaatgcctctctgagatacatatctcagtctattgtgagtttagtctgcacaggtcattctctccaaattgagttaacctcgggctgagttatatgacaaaaacagagttttggtcggacctccatgatcttccaaggcttcagttgcctcctgcatttccctggagatttcctatcccttgcatgtgcccataatttcatttaaacctgttttaaaagtgtatgtaacttttaagtaacctataatcttcccttcctcaggttcattaagcactgaaccaatagtgcacaggctgagaaacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtctctaagagatgtgctgagaagtaattcatgtcttagtggccactgttttgtacctaaaatgatgtccaaagagtcatccatccatttctgtttcctacaagctcagcatctggctggcactagggaacccagaacgtggactggaatagccatgaggagcctaacttgtatataggccttacttgaataaattaaatatgccacttactggaaaggtgccacatgtaaagcattgcaccaggtcctaggggaaggttggttttgatgtaaagaatactagttcctgtcttccagaattttctctatagtcaaatgaaagcttgatctttcacatttgttttaagaagttgggctgacactggttttctctttacacatgcacacacacacacacaccctcaaacagttgttatgcaaaccaactgattaactggcatgctgttgctttactacattgattttagaagtaattgagctattcagattcctgaatactctgatagagaattattcttacattttgtaataacgactgtacagatgaaaatatgaaaagacattctgcaatggataagcattctgggttaatttcagtgcattagcctaatatacaaataccccatttctggcaagaaaacccaggatgttcattcactgggtaatatcttttcatattttgcttacagatgttcagaacaattccatgtttattagtctattcaaaagcttttagaaatctgcacagccaagtggcactgaatccagaagcatgaaaggagctgcacaacttttcctcgtaagatttacacaagcagcacgggaaatctgaggcccagacatttccttatcaacagaatactccggtggattttcaagcaggctgttcagcagaggtttcgagcaggagcccaggtgtgggaagagcggagtgtgggagtcctcgtgtgaccctctgggggtggtgatggaactgactgtatggtctgcaaaacctaaaatatttactgtcaggtgcttatgtgtcctgtcctgagcccgtttcctctcttgtaaaatggagcaatgctgcttgatgaaaccagtcaagttgtggttggattcttatatgtaataaacctgcacattgtgcacatataccctaaaacttaaagtatgataaaaataaaaaaaattgttgcaaatctgagtatttgagaaaatctgggatacacactttctagctcttgggctcgttaaagatgaacatgatggatcatgaagcattgcttggcagggctggggccagcttgtggtaagtatgcctggcacagcacacggaacccgttttcttctcttcttcatctgtgttcttaggaggtcaggtcatgtcacccccttttccaaatgcgtgtgatttttttccttgatgcttgagagctctaactgagcaaggaataataatttccccactaatgtaagacaactcagtatacttttttttttttaagtttgacttaatttctgaagtgtttgggtggaagcgcatgtctatgtatcttacatgagatgaatgatcccattcttcagagtagggatgagttctcttattaacagattttatcaagcaatgtaaaactcattctaaattccttgcagactgcattaaatctctttttagtgcatagtcagtcttattgtactcatttcaatgtcagtcaaggtaaattactaagttattgacatactcctgaaaatgcaagaattctggtgttcagttcttgctacaagcaatttgatcgctttttattcctcttattttaggcgtaaaattggaccttaaacttgtagcaggcaggataaaaacgcttatctctctcaaaccaagaggcagaaagcaggcttcaagagcagagacccttgactcatacccttaggaccaaagatatctgctcacccaaccatcttccccacacccacatccaagcagctatgcaagacagattagttcagtgaatggacccattgcctgaagaaaaagtataggtaatgagaaaacagctggttttgtttattgtaaacctcaatcaccagaaatagcaagcttggcttctctaccatcggcacccctctgaagggttgacatggtggggggggggggacataggtcatggggacgtcaaagcatttgagacctagaagggccttaaccatcttccaatacaacagctttcaaactgggtgaccatggaaccctcaggctttcagaagggttctgcaggagctccagaggtaatgatgtttgaactcggtaagattcaagctgcttggagaggccattcacagctttcagctgtattatatgttgatgtcctgactaataaccttattttgaaaagttattaagaatgttgggaaacctccaagactgctttctttgtcgagtaagggaactgaggctgagagagatgaagtgatttgagagattttattagaagggttgaaaatgtgcttgtcttctcagatcacagtgtgactagaacacccaaaagaagttcgaatcgtacacccattctgctcctctcagtgaggtggacggtcaaggattcagagtaggggtggctttggagtgggaaatgttaagatgtgaagagatcatagttttgtcatttggttcctgtttatcatttctgttaggctggattttttcaccagtattgagtcctggggtttcctgatagatagttcttgtgtctgctagatgctttaagtcctgtctgcgatggccagtagcagagctaagggtgtgacagtaaagagcgcctgcaggagcccaggacttaggactaagaaaggaagtcattgaactggggagtggtatccttgctccctcacctccctccctttcaagcttctgcaaattggcttcctggcctgggctggggactgcctgggcctgcagaatcagggcaagtggactgcaaattgatttgtccacgaagcatgggctgcagaccttacatataataacctagtacgcacctgctccagtttacagtatacaagggtgatggcattgcaataagtaaaacatgcactcagccagtgctattgaattcagagcaatttttcaccatcacataggtccttcatccaccggttctaaaatttgagtgactctatgggggttctctggcagtatctaggcgaaatcatgtggtctctcatactcacgtaggtatgaaccctgtatgctgataggtagttcaaagttgaaaccaaagagacgtgcacattttgctagaggtatcccaagtttgcccagttatttaaatccagcattagacatcagagagggtgaggattttctatagcttcaaataactgaaggctggcaagcagcaaaacatagggccccacaatcctgctgtcctcgaatggtaaaaagaggcatttagtgcctttccttccccttcaggccattggctaaagactccaataatgtcagggtctgttctttgtcattgaagggcaaggggtgagtgaattggatggtttatggactctctaaagactattgcatgtgctacgtgttcttcatatgaccttgatattttaatattctatagttggtttggctgttcaactcacgtctctccttgaacagcttaaatcactgctgaggaacaggtgcagcggtcaaaggtcaacagactgacagactttaagtagttaaatgtgtcaatatttcagcaattttggtggtaaaattcaaatagggcatttaagtagaaaacaaatggaaaggaacaataataaaaacatccttttacccattcaacactagaaataggttattctttcattgttttaggattatattctcaaagacttagaagggagattaagaggaatttgatatagcaagcagtttttaaaacataattgcaaaagcagttgatgaatgtgcccacactgatgttttcaaatcacatctaatggagccataatgtaatatgagaaaataaccttatggggggtcagggggttgagcttctccaggaattttatgggatatgctgggtcttaattacttcataatgactgacaatttttagagccttagaataaaggtttctttttttttcctaagttacattaaaaataaatatctgggtcaattactggcccatccatctgccaagtgaaaattgcaacaagacagaaaaacacggttgctcgtcatgggagtgaagcacccagacgtgagcggagcggcttgggaagaggtcactgttgtttcctggggccgtgcctccgatctgccggggactcctcagcctgggagtcatttacaaaccaccgaggcccctcagctgcgggagaagctttgcttaataaatcctggcctctgaggcgtggaattgtgaagtctctcagggaatgccgagggacagaactaatttcagcgtcttcgttctttgagaatgggaggtagcatcacgtctctgactggagcgttctgatgagggtgaccacctacccacaacgtgttttgaactcttttatttatagttgttgccttcctctttctttcttgacgtttcctcttcctcctgcttcccctctcttctcttttgcttcttctttccttgagttaaggataagttgttttttccactctggtttattgttataaggcttaaaagaagtcacagaaactggtgacttagcacataatacccatcttaggtttagaagagcaattgaaaacataatgttctcaatgggtattacaatagtagtttcttgccatgaccactttgtaatccacaactcattctacctactaatctctgtcacagtcccatgagatagagcagcatcagtgctgccccttacacaggtgccaggggtcagagacacttgcacagttagtcagtgtgccacctggctcattagaggttttgacaatctccgctggtgggattgaaaataaaacagggtttatgtttaagactgtctccttctaagccttcactcatttccagcaaatgcattttcacatgtctttcgtgagcattttaggataatttaaaaatattaagctatgctagagctgtgccaaagttttgaaaatggcttataaaaaataatctagagatctggaagcgtttagatggatgtgatctacagaaacacgggatttccttttctttagccggatggactttacaggtcatctgttccggtgatttgtttgaaacttttattaggcattacaatcttttcttcaggcaaaaattttgcacagaagtctattaaaacagtgtgcaagatgctgtgattgggagagggggcttcccccagcactgtcctcagtattctggccctagagtgctgcctcaaaacctaccaggagcttagtctgtaaagcagttgaggactagggccaagttaactttgggctgaaacacgcagtaacatgagaaggccttccacacctcgctcatcactagcccactgcaaggctgcactttgcatgctcatggaaactcgcaggattattgaggaggctgtgcagagggaaggggccttttaattctctgcctccttagaggtgcaccctggcaggccaggagccccaggcagagatgtttctgtacaggtcccaggttttgcagcaaggtcccagagcatcccgttctcccagtgaaattccgttttcaatttcagcctgattccctgagtgaatttaatgtaaagctgtcccttccccctcggtcccggcaggtaaggagctgctggcgactgtcacaccagtgcccctgtcagcagacctgcttggctctggaaggatgggttgacaaaaagccataggtacctgaacttgtgtgtctttgtgcacaagaaaaaataatctgtcaccttgtttaaggcgtgttcggttgcgtttgatagtttgaaaatgctctggggaacaatcatctgtctggttttgagagtcaggtcgtaaaatggtgaaatcacatactgggggctggagtggggcggtgggcagtgtgggggcattgggaagctgctggtttttttttttaaaaaacaagttttaattttttcatctaataaactgttttttgtttaaagagcagttttaggttcacagcaaaactgagcagaatgtaaagagaattcccatctatcccatccccccaccatgcccgctatcaacatccccacctgagtggtgcatttgttacaccccaggaaccacactgacacgtcctcagcagccatagtttgcgttgagttcactcttgatgttctgacatgtataatgagtgacctgtgtccaccatgaagttattgtacagagtaatttcgctgccctaaaattctctgtgctcagcctattcagcccatcctccccccccaacccctggcaactgctgatcttttcggagtcttcatgtgtttgcctttttcagaatgtcattgagttgaaatcacacagcctatgtccttttcggattggcttctttcagtaatatgcacttaagtttccaccctgtcttttcacggcttggtaggtcatttctttttagcactgaataatattccatggcctggatgtaccccagtttgcttgtctattcccctgccgaagaatatcttggatgtctccaagttttgacaattacggatgaagctgctgtcaacataggaaactggttttaaacgttcagtagagattaatgcaagaactctggagtgggggaggcctggaggcctgggttgaaatgaagttctaccagagaggatttctgctagctgatatcaggcaactgggggcttcatccatcaaaagcacttaacattgaaacttacttttcttttctgagccacataagtaagaagaattcagacggcacctctgtctaggtgggtggctggtgaaaacttccaacagtacttttctctctccagagtgtaagagttcagatttgcatgtgtccattcttccctttctgtggggcagagatacatgtatttctctgtccccccgaggcgaagctatagtctctgaccccctgagtttcagcccagtgggagtgtttcttgtaagatttctcagtttgggaggaccttgggcttcatctcctgccctccttctcctgccccaaatggctaccaaggtgggtccagaagaaactctcagaggtctgtagtttgtttatcttctaggctttttatacatttctttccttcataatagctcagtgaaaaatgttaaaatattttaaaaatatattgtacccagcattttagttatatcaggcaggaagattgcttcagatgttgatgtgccctttcttggccagggcattgcaaggcagggttagtgctcgtagacaaacaaggattttttaggaggtgatgacaccatttccatcaggggtggccaggaatgggcacgtacagacagaagcattcaagtgacttgagaggatccttaggcagcctggaagtaagaggaagatgacaggccctctccgtctccacaaaaaacagtgtaattaaatgtggaatacccttacccccggaacatttgacctcagagaccttgggtctcaatgcattggacactgacagcccatgtattctactctgtgtgtgtccataaaccttcttcatttagtttatttattttttgagatggagtttcgctcttgttgcccaggctggagtgcaatggcgtgacctcggctcactgcaacccccgcctccctggctcaagcgattctcctgcctcagcctctggaggagctgggattataggcacgcaccaccgcgcccaagtagttttttgtatttttagtagagatggggtttcatcacgttggccaggctggtctcaaactcctgatcccaggtgattcatttactttcaattaacggcacctcaatggcctcccatttgactatagatgttaaataagtacagttgtctctccgtgtttggactaactgctcaaggctttgatgagcagcagagtctcatttagaaggagacttgccttggttcaagaattcactctcttacctaggatgtaattctatttttctgacaggacatgcttgatgggactgatgtctccagccaggtcagcgcagcagagaggtgaacaccagcatgtcttgttaagaagcaggagatgagttcatgagatttccacacacacacgttgatggcctttacatatgagcttggagatagaaaataatagctaataggttttagtcgtttccaagtgcatggcataattctaaattctttacatgtgaccacttcttctattttcataacagctgggggatagggagggggtaggctagtgtccctgtttttaaaatgaacaaatccaggcataggcagattatctgacttgtgtaaacccccataattagtaagcggcagagccagaatggacgcagggacggtctatgtctagagtcgttgttttgaactcctatgctgtgtctctctcaaagagaacaagaaagtacaagtcactacaatgaaaagaactccattgtcagtgagacatacaacacccttccaaagtgagaaagacaaaacacccagctaagactcactggctaattggaaagcaggacctgttattatgtaaaggctcctgtcctactaggtgagattttccttgagggtagggactatgtcttttcatctccctattcttgtgacacctggagcaggccttgctctcaataggctcctgatcaatgccgagttgtcacatcccctcatgcgttaaataaggccgtgtctgaggatcccactggaaagtcttggaagactctgggactcttgtaagccctgcacggtgcttcctgattatatgaggagttggagaatatcatgagaaaagtccaaagtctctcctaagttctgaactatagctcccttctcccacgtggcaactcttccctgatggtttaaagagcagaggtcttggcaaaaccaggctttccctcagattgttcagcagagggctgtcagttatctaagacctttttaagaagcagatagacagcgaggtgcggaggctcatgcctgtaatcccagcactttgggaggccaaggcgggcagatcgcttgaggtcaggagtttgagaccagcctggccaacatgtcgaaaccctgtatgtactaaaaatacaaaaactagccgggtgtggtggtgcaagtctgtaatcccagctacttgggaggctgaggcaggagaatcacttgaacctggaaggtggaggttgccgtgagctgagatcttgccactgcactccagcttgggtgacagagactctgtcaaaggaaaaaaaaaaaaaagaggcagttatatatgttcatctgttgcctttgaccttgtcaaatctattgaagttctcaatgccctgaaaacaaatggacttagatctatggccactctctggcaaaactgagggaattttaaactctagcatcttttgggctgtagcaaggtgacaaaattaagtttctggagtgccccagaggctacataaatgcaattttgtcatttctggagtgttctgtaaatatcgagcctataaaacagaatgcagttacaagaagagttaattcacaggttggtgaaaggaacactgctcataattagagtcaggtggtaaaggacatacttcctggtgaagcaggtgtgtagggacccgtgacattctcccatctggagttgtctcctcctctctccctgctcctgtggctgggggtgggattcctaagtcactttccctccctttccccattcccatttcttctgagtacttactaggtgcaaaacatttttctggacatttgggaaagctcagaaaataatatgttgatattcccctccaggaaggtagaccgtcctgggaaacccaggactagggtttcctggggaaacaagggaaagcagtccaggcgtgtgggggagagattcagggtgctttccaccctctcccggacctcagcttccctgcacctggctttgcttttgtaggctggggctgctgctcctctcggcttcttccatggcagtcggtgccacccagctcgctggtgttcctgactcgggctctgcccgcctcaccccctctgtaggctctccctggtgggtgttctgctgttcacagtcctgatttggcacaggccctctgaggacctcaacacagacgctccagagaagaggcctggacctgcgtcactgagaatgcatcagagggagcagttccgggaaagagaaaacaaccaagtcatttcggttggacgggacataaacactgcaagacaaaattgatgcacaataatgatatgatctgtcagaagaagtggcaaagaaagggaagaaatgagcggctgtgtgtgggcgagccattgatgcaggaggctctccttgccatttggtccagttgcagcagaataaaaaaagctccacttctggatgagggatctcacatgacaagtatgcaagagctgtttaataccaccacgcctggccagtgacaggggcacggcatcctggttagtaatgaaagtggagtgagaaagctgcaggagcctgagatggatggaacagggaaggagcaaagtttccacagaggagacagaggaggaggaagcgggggacagaataccccacgactctagcggcacacgtacacaagcgaggcagcacgcagagttgacaggcacagatggactggtcacgtagcctggagttagggcaacagatggacaagtcattgcataaattggctacccagggaccacaaatgcctgctaggaaatccaaggacgtatcatgttgacccagtgacaacatacctgggcagaggtagacacaggtgcccctgatgtgaaagggaaatgaacagcagtttgcattggtgggggggaataaaaagcaaacgagattaataaggaaaggaaggaaattacattgtgtgcgtgtgtgtgtgcttaatgtcttttgtaagaggacttacctttaattcatctttgtaagacctgactttaattatgtcacttctgaatgttgtaatcgtatgactttcagagcagtgggagaggaaaataacatttggatatttgatagatattcaaaatatagctgaaataaattttctaaacactgaatctttagtctaagcacaaagtgaaaaacaataactttcatggaaatagttacttgtaaaatgttgttcagctttcagaatgaagtataaaatacaagatggagttgtcatttaaaaaccaaatagtactaaactaaaacaaaagtaattcttgctagatatatttaggttgctgtaatagtgtacccaaaaaaaaactatagtctgctgtgatggtattgattacctttttatttatggtaaaaatggatgaattgtcatgtctttaagttgctatttactcaatattttaatatacatttagtatatacatttgtgttaattcttttttaaagctttaaaaattaatcacgtaatctttgaaagtcactatgctagggaccggatacagtggtgaacaggataaaattgtttctgtcttcatgaagggtatataatctattacttaaaaaaaaaaaaaaaaagactataaggccagatgtggtggctcatgtctgtgatcccagcattttgggaggctgagatgggaggattgcttgaggccaggagtttgagaccaggctgggcaagaaagcaaggcattcgtttctacaaaaccttttttttaaggactttaatttttagagcaattttaggtttaagcagaaaaagtaagcaggaagtacacagagttccgatgttaccgcctgccacacatacatccattttcttggctattaacatcttagtgtagtacatttgttatcactgatgggccaatactgatatgttattattaactaaagtccatagtttacattcgggttcacttttggtgttgtacatgctgtaggtttgacaattgtataataagtgtatctaccattatagaatcatgcagaatagttcactccctaaagattccctgcgctccacctgttcatctctccaccctcacaaacccctggcaatcactagctttttacctttgatagttccgccttttccagaatgtcaagcagctgtgtgattcgagaatgggtggaagcatacagtaaatagcatgtttagataggtctttttcacttagcaatatgtatttaacggtactccatgtctttctggggcttgatggcttatgtctttttatcactgagtaataatccactgtttggaggtaccataggttattttatctattcagctcttgaaataattgcagttgcttccagtttttggcaattatgaacaaagctgctattaacgtttgtgtacaggtttttatgtgcacataagtttttaactcatttggacaaatatttaagaatgtgattgctggatcatgtggttagcctatgtttagctttgccataaattgtcaaactgtcttccaaagtgactgtaccattttgctaccagcagtgagtgggagttcctgttactttacatccttgccagcatttggtgttgttggtgttttggattttggcaattctgataggtgtatagtggtatctccttattgttttaatttgcaattctttaatgacatatgatgtggagtatgttttcttatgcttatttgctatttttatatcttcttggtgaggtggctattcagatcttttgcccattttttatttgggttgttgttttcttattgatgagatttaagattgttttggcctttatcagatatgtgacttgagaatgtgtcctcccagtctgtggcttgccttttcattctctgaaaaatttctttccccaggcatccattatttgtgaactgtgtgggttgggcactggtggaccagagtagttctgggaaggtgaattgcaggcctccacagccaggctctgttagtcccaatattctcccagaaagtcaggttggactgttgcatgcccgaatgttggcactcacacctttcttgttcacttgcttctattgaccttgttactgggttgtacctatggttttggcctctcattttttgccgtgttggtcattttgtgcttctgatgactttagtagctgactctggccctggtcccttgacttcctgcaagttctgttacctgactgtggccatccaccctcccacatgggtgctgattgtcttgtttgtgtaccggcttggcctttgccagtgacagtttatcctgaccccagcccgaggcctagtgtctagaaaaattatcatattttcagtggttgattataaaaccagcattaggttgggtgtttctcagtttaatggctaaactcaaaatctttattgctgtcacccccaaacgaagttgccttgctgactttcccatttcttccctactggcctcaccattctcccagtaactcagactgtctgtcacagggccatctttgatttatccttcatcacctgtagacagtcagtagccttgttctcagagtgcttcagtgcttaccattcattctattaaaggacttgagttctaccatgataggaaaaaagactacatcattccaggaaggtatgtgtgcacgttcagacaataggttaatgccatatgcatttttctgaaaaccctgtatctccctatatggcagcctctaagagcctttgtggtaccaaaaccgggaatcattctttggctttgtttttaaacactgaaatccttcttcagtcttctctcttttttattcccactgccaccgatgtgaaactggccctggcttcatggctggccccttgaggcttcgtgctggactcaacaccttgggtctttctgaagggaagcctgctggggacaggaatagggaaagagctgagtaggacaataaggtggagagaaccagaaagcctttcaacccatctttagagtgagatcttcacagtgtgatttcgttattgtatttgaagtgaatgctagaatagctgatgcttttagaaatcaaatatagatacagaacacattacaaaactaagatttggtcattttaaaagctttgttatttgctttttcatcctctcctttcctcctattcactcaagtaaataatgatgtgaccacagttttctttacttaaaaatattttttttcacaggcttcagatctgtgtgtctacttgtcatgaaaagtatattttactttaataagctaatgatttatttcaacagaggaagcagagccctccaagtttatatgagattgattactccaaagctttgactagagacctgttcttgtagaagccagtctttttgtgaaagtcaggtgaattttagattgccttctcaaactctacctgtgtgtcataaagtcactgctatcattgttttcccctcatttccagtagcttatgagaactccagctattagcatgtagcatttaacctcctatactattaggtcgtttctttgattgcccagaacaatcttatcattggatgaaactattataaattatatgcacatagttttaaatgattgcaagatatatttgattctaggtcttttcagaagtttagcattgaatctttttcaaaattttctctttttgcaacatttccagctatatttcaacttgtttatcagaacgatggctgcctgggctaaaaccagtgctgccaggcaaagctgctcccagtggagcccaggtgggtgcaacagggagctggctgtcgggcagggctgagctgcttggagagcaggagtgagcaggtgggcatgatgagggagatgctgggggtcccaaggtgaggaaggaaaagagcaaatggccttctggtgcacgtggtcattaaggtgagatgactagtgagaagccttgagtcttgatgaatgggcgagggagacaatcctttatatcaagtcccaggaactaacttgagagcccaatgtggagggcactggaaagtcagttaaacagttagatagtcccacctgctgaggagatggaagcaagggccaaatcgcagggtgggggtcaggttggcctagagccctctatgcgatgagaagcttgaaacccatctctcagtatgtgcagccactggagctggggtacagctggggtcttggtgagtcctaagtgactgttcagattaggtcacaacagactgaggtatttgtctttaattcaggaagcaagagcattgagagctcttgttcacattttacctgcagctgattcaatatcctgtctgactcttcaggtggtgttttaccaaattatgtcctggaagaggccagtccatattccagaagttagaccagatgctaatatgctctgcagctggctggaggagggctgggtcatataccacgtgatggggagagaagagggaggcagaggacacagtccagcctggagcagacatggagtcaaaggctgatcttggctcttggaagatcctggggggagattgaggtaggacaggtgtgtcacaggggcttctgggcagcattcagctctggggtgctcacaaagtgtggtggctgctggaaatagtgacctatgcctctcattagagtatttcagctgaaagggcctttggaatcttctcttctcccagggtaggaaatagaaactcaacaaaggtgatgactcagcattgtcaggcagctagcccatagcagggactagaccagaaccctggccttttcacttttcagagttcttttagaaacagttgaattgggctgtaagtgatctatattaaagtacatattttaaagtgaacagtatacgttttgacataggtagacactgtaaagccctcaccacagtcaagataatgagcagatccattccccaaaaaaagttacctcgcatgccttcatcattcctccccctgccttcctcaccccgcaggcctggtgcccaggcaacctctgatctgcttcctgtcatgacaggtgtgtttgcattttgtagaatttttttctggaatcacacagatttctttttgtgcctggcttctttgattccacctgttttgagatgcatccatgttctcggatcagcagttcactcctttttcctgctgaatgatattctcttgtatggatgaagcatccttttccctgctgatgaacagtcaggttgttttcagtttggggctgttacaaataatgctgccatcaatattcatgtaccagtgtttgtgtgggtgtgtcatttcatttctcttacattaatacctagaaatggaatgaccaggacctgtggtaggtttatgtttaactttttaagaaatttccaaactgttttctggagtagttgtaccattttatattcccatcagcagtgtacgagggttccagtttcttcacttgctcattagcagttggtatggccagtctttttacttctagtgattgtaacaggtgtgtagccgtatcctactgtgtttttcacttgcattttcctgacgaccgaattatattattttgtcatgaacttacttgccatgtgtatgtctttcataaattgtctgttcaaatctcttatgtatgctttttattgggttattttctcattgtaattttgacagctcttgatatattctggaaacaagtcctttatcagacataatgatttgcaaatattttatctgagtctgtggcttgtcttagcattctcttaacagtgttttttgaaaagtagaacttctaaatttcgatgagatccagtctatcggtttttttttttatggatgaaacttttgtgtcatatctaagaactatttgtctaacacaaatattttctcttattttttcagaaattgtatagtttaagatgtacatttaagtctgcaatccattttgattaatttttatatatagtgcaagtcatttgacacgtgtgtaatatagcaaaaggcacatattggatctgtggattaaggtcactttacccaccgatggtgacagaagtcttctaccagtactgtcatattaaaatgcaaaggtcaatcatacattatatatgtacatcactcaataaacccctaaagtacattgcccagttttcataatacatttaatgaaagaataataaggtcattaagggcaatcagtgttttgttatattcctgattatattcttgattatagtttgttgcatttctcgaacgaacatggatggagcaagaagtattcctcttccccctttaatgcgaaccaacatagtctcagactccagtttaaaaccttgtcaacagcagtgattgcacattgtttaccccacccgctcccggttgtagtaattatggtactttagatttcctggagaggacacagtgcttaatcatgtaattatgtctctggacggctatcccaaacaatgtggagcacgggctctgccgttcatgacaacagccaagagagaagtttgtttgggttcttattgtgcagacacagtgggaggggaggctgcagtggctggggagagcaactcgtggagggaaggagttgattttggaaagacaaaatggggttgtgtagggatatgtggctttttttcttcccccagttcttgtccttataattattccaggagtaggagtccttagcaccactgcattgactgtggtatatggctcagtctccacaccacagttatctagggctggggcaagtggatttgtcccggggaattactatgggtcctagtatttagccttccattgtgcttctagcccagaagtgtgcttgctttacaaaagtcaggagagagatacaggaaggagcaccggagttggagtctgacagtcccctacacctgctgggggatcaggaatgagtcacttagtctctcccgacaccaatttcgctatctgccagaaggggaagagtatccttctggtgtacccaagtggattcagtgagaggacatgctctccatgtacataatgggccaaaggtcatgcattttttcattttatgtggaaaaaatgacttgcacgtgttcgtttgggaggcaccatgaaaactggctttaccttctctagggaccttccctaaccccatcccagaccctgaggcggggttgccacattcattccccttgcatatttccctcattgcatgtcctgcgtcacaatgatggctttgctccctgctgtgagagcaggaatttcttcagggccaagacctgtaatttttatttataactctagtgccatttcataagcatttgatgaataaacaactaaatgaatacatatgaagatgagcagagcagtcctggtgttgaaggaattcataacctggtggaggagatggacacgtgtgtgaataattgcagcacaccgttctagctataacaagcagtttattcacttttaaacaaaatgggaacgcttctttctcatctaataaaattgcttctgtgggcactccagacatttgggtagaaagtatgttgctgaaaaatgatttctaagaagagtagaggagatatggggagactacactcttttattccagccattactcatctgcaggctttcactttccatggcacctgaacttctactcccgaggttagggtggggcattcattacatattttcacagcaccatccttctcttttctgacactaatgatttgtttcccatctgcctcttctctccctatcatccagactagcgcctagcacatagtaagacctcaataagttgctgctaattgactaactatacaatcaaacaagttcacaccataaagactttcttaaaaaataaccctggcttcagaaattttctgaagaggggaacgagttctttccccatcatgggatttgaatatgggcctgtggccccaggtttcttttgagcagggctacagtctgattttcttaatagaacacattacaccattaaatggatctccacacacctggaggagctaacctattgaagagaatgatttcctgttatcctcctggaattcaggtacaatttaacttcttgccattaaaacacaacttgatagtggtaaccttttcccacctcttgggacgcttatttttagttttctggagaagatgcagattggaacacaatgactacagatagataaggcatagcccgcaaacccatttgcaggtgcgctgtgtttccttgcacagtcgtttgtctccaggtttgaatgcttctccaacgcctttattggcagttgaaaatagagttctagccaatgtcgatggattgttaccacaaaatgcaatttgctgctgcacgttgtgctcagataatgggcaagagtagaattcatccaaacaattgtgctccaacaattgtgttcaaagaaatgataccacagagtgagccattctcagttttctgaatcatttaagtggtttcattgtaactcatccctttgtcaactattcttcagtgggaaaataaaggcttaaaggaatttcttttcttcaagaaacagaacttatagcagaatcagaaatatgtcatgatatataggcctacttatggaagaaacaacccgtgttaccactgattactcgatcacttctgtagggctgaggcaacactgttaattctttgaattttctggctgcaccaggcataggtttgtgtgaacaacagggaagtgttacctacagagagccggcagggcagagtgtcaaatgcgtgggattcagaggcagaaaatttggacatcagctttgctgctaccgcttactctctcttttggttttttgttgttgttgttgtttgtttgtttttttgttttttgagacagagtctggctctctctcccagcctggagtgcagtgactcgatctcggctcactgcaagctccacctcccggggttcacgccattcccctgcctcagcctcctgagtagctgggaccacatgtgagtgccaccacgcccggctaatgttttgtatttttagtagagacggggtttcaccgtgttagccaggatggtctcgatctcctgacctcgtgatctgcccacctcagcctcccaaagtgctgggattacaggcgtgagccatcgtgcctggcctgctaccgcttactctctctgtgaccgtggaaaaatgatctcatctaccttgaagggtttgttatgagtgtcaaagaagataatgtgcaatggatagcatggtttaaacagtgaaggaaaaaagttttgtagttgctatagaatgaatgttttcttgtatgaactgaaaaacttgagtcaagtttcacatgggagctttggtctttccttaatggaatattatcagaaaaatgtgttttatatatctgtctttgaaagttttacttatataccggattctgttacaaataataaaataaagttctgcttattggtagctatttctgtttcaagttaatgcacagagccacaaaatgccatacaaaagaaaggcaacatgatgtcctttggctgaaggcttcatttctattcgttttccatagaaattatgtgtgtctgcttttgaagaagcatactgaaaaaaaaaaaaaactatcctctactaggtgccttatttgtgtaatagaagttctaatccaagtttagtaatacaaagaaagagagttttgcagatggaagactgccagcttgacagcagtcatgcccaggatgctcataaggactgctagaggagggaggtcaccaggagccagcacagggccactgaaaccacgtcagagcagctggagttccacacgttggtgaggggtgaaggagaggggaattaagtgttatccaggtggatgtacctgaggttctgtgatttcataagcattcataacgagtattgacacaatattcatcattagctcattcacatcagaccctatgaagaatttaggaaagctgtgattccaagatcttcgggcttttcttcaaaagaagagagttatgaagccaggctgaaggcactgcagggtggaatttgtgctgcaggggagaggcacccggacacaatgggagccaggcgccttccccacagcttggctttgccacggcagaaatgctgagctgacaggaagctcattttgttcctggaagagggctttattttatttcaaaccctcagctgcctggtgcacatttttgttctggcaataaataactttaagctcatgtttgagttctttcttctttttttttttttaatattccatagaagaaaaataaaagtttttatatgaataatttttaagactcagtaagaagtaaacaaacagctttttaaaagtgggcaaaagatttgaaaagacatgtcactatatcaatgatacacagatggcatatagcatccagtttacaggaagcaaggggaatagagaaatgctttctgtgatacctaccatggggaagcaagcaggcaaacccagaatttgggatacactaaggacagctgatgtggcttcttaaatatatgagtgtgttttttaaaaaaggggagagggccttctcaattatgtaacatttagagtacatgaccaaatacgatgtgaggactaagggatggaaattgactaggggaaaaataactttaaaaaacttttttagggtgacaataatcaggggaacttgaatatggagtgggaattagatggtgctaatgagtaactgttaattttgttggatgagataatggtattgcagttatgtataaaaatagcatttagcaattatgtataaaaatattgagggctgaaatgatgtgagatttgctttaaaatactacaaaataaaggaaaaaggaagaaagaagaaagattgatggcgtacatgtgttgaaatgttagtaattgttgcatctggagagcgggtggataagtggggtttattttactatttttgcttttgtatatgtttgaaaactttcgtcgtaaaaattcttcataaccatctttctagaaattatgcagattgtaaaatataagtaaatagtgacataatttgaggcatggattactatacatcttatatgcaagaaacacctgcccgtaaattcaattaaaaattgttttatctctacaaaaaattccgatttatcagacagtcaatttgcattacaaagggcactgtttcttttataaaatagtttgctgtagaattccattaaatgatttatgtaatttccatgggtagtctttttttttttttttggagatggacttttgctcttgttgcccaggctggagtacagtggcgcgatcttggctcaccgcaacctcggcctcctgggttcaagtgactctcttgcctcagcctctcaagtagctgggattataggcacgtgctaccacgcccagctaattttgtatttttagtaaagacagagttggtcaggctggtctcgaactctcaacctaaggtgacccgcacacctcgacctcccaaagtgctgggattacaggcgtgagccactgtgcccggccaggtactcttttttaaaaatcctccaatttagcccctttctttcttcagtctcttctattctccaaccatggatgctggctcccttcatgcctccaaaactttatgaaagcttatttcctctatctggagttattcccttcactttgttctttgtaaaagcttattatattagtcaatattctccaggaaaacagaagcaataggatgatctattgatgagttgatcgatctagaggttaatgtattataaagaattggctcaggattggctcatatgattatggaggctggtgagttccaagatctaagctggagaacaagagagctgatggcatagttccagtccaaatgccagcagcctttagatccaggaagagctgatgttttagttagagttcaaaggcaggaaaaaaatcagtgtctcagctcaatccttcaagccggaggagtcctttctactcaagtgttttgttctattcaggccttcaacttactgggtgaggaccatccacatcaaggagggctgtccgctttaccgggtctacggattcaaatgctaatgtcatccagaaacaccctcacagggacacccagaataatatttagccaaatgtcttggcacagtcaagttgacacataaaattaaccctcactcttactcgcgctttaagactaccctcaaacgaattctacaggaaagcgtccaaatgtcgatactatgtagatttatgtgtttattttttttattctacgctgtacatttcttgagggagagaaatttttgtcacattcatctttcaatcactagacactagcctaggacctggcataaaacaggtatcaagtaaatatctcttaagtgaatgaatgaatggatgaataacagcatctgtagcaaatttaggagaaactgcacaagttagaaggtatcatgttttaatattctaaatttaaatatgactagtaagagggtgggttttaagactggtataagcaatcatgaagagtgatggtttgtgaaaaagtagaccgtgtaacagcagcaaaataaagttagtaagataattctgaaaacaaaagctattcacatgcatatttgagactacagatatgataaaattagcattcagtaggaactatttgaattttgttttagtctaagttatagtgagttgtttaatctgttagcatttaagtcgattagcatttaaaataaaaatggtattcttccaacttattctaccctaccttaaaacctgctccccagaattccacattattttacctgctccttctagtagcatccatatcttgaaataacacatttatacctctattccttactttattcacttagacattagttacttctaccccctagtagttgtgcaactatggataagttatctgattttgctgtgctgtaatttcatcttttgtaaaatggggaaaatagttttctatcccacaatattcttttaggattaaatgaattactgttcataaagtacttggtatgtaataagagtcatgtaagttttataatcatgagaacagtgataattattaatatcacaattatcagtgatagaaagttagctttcttatgcaacctcccaccatctcacttcttctcattctttctctataattgtatcaaaacttttcagtaaatcaacactgtttaccttatgctatgtttatgttatgttattgtggctctgtgaatgtgttctcaactgaagtcgataaatacactgttagggctacttttcaggcaacacaaactattccaattacttcaagcagaacctgagaaagagaattggaggcttacattatgatcctcgagccaacagtgggatttggcagcttcctatctgcggatgaggcagcagctatcctaagaggtctacctgagcctagagagaggcagctgcgttataggaggtgaggataggagagagttgtaccctgcaggggcctggtgaaggaagcctctgggaaccaggaagggagaagccccttcttcctcatgtgtccctccggcgccctctactgacaggggttagcatcaaggcatctggcaaaggacgcaatttacaaggcccagtgctattatcacagagcagagaaagaagggtaggtttggagcagagttaataactggaactcctgttacattcaaacttctaacatgctagtgtagttaaattccagacagtatgtaaaaggcttgggtatgtatggtgggccaggggagcaggtccattgttttcaaatatttgaaaaacagctgcctgagggagggaagacatcattagtatgtgtttctcagagggaccaagaccagggacagttatgggaaagcagatgttggcatcccatgagggttttggatgcttcactccaaatgtcaccattatcctgacactaagagtgatgaagctgaggctagggtgatcctcagtcattttgcggaagttcagctgggataggaggcagaagtgggtgattcccaaggtccattccaatctggagaagttatggacttttcagacatacctgtgttacctaaagtgagttgtgctgtatatatagaggtcagcctacccatttatttatgtatccatgtgttatccatatgcctgattatccatctctctacccatccatccatgtatctactcatccgcccatttatccatgtatccactcatccatctgtacacccacccactcacccatccaccatcatccattcagccatctgtccatccactcatctaaccattcatccatccatccacccatccacccactcacctgttcaaccaagcaaccatccatctacccacccattcagccaaccaaccgtctatccgtccatccaaccattcgtctatcttcttttgagttgctttaaaactcagtaaagttatttcactcaattaaactaatattatttggaacagtgtttattggttggcttccaaggactatatatgatattaatattggaattaatcaaggacatgacgtgcaaatgcattattttcatcagtttagatatgagaataattcttatttgctgcctttcatattccaggtgtccttttttctgaaaatttctcataatgtgccaaagaagataagagtaatgtgagcaaagttactgaataaaaccacatatgaccaaagcattgaaatgagaaaacagaacatgttttcatccccgtgattgcaagataattccatacgatcaagtttgaagtttcagaaatcttaaggaacagctctctaagcagaagagcttaaatgattatctgggtcttctatgactccccgtgttttatttccttagtccaagccttgtgtaagggttcacagtatgattttactattttgtagatgcatcttcttttctgacacatgggaattttaaagaattggagttgtgaaacagaaatgaaagcacaagaagcatttcctctgtacagcctctttattgttcattggtgaaataagtagcaaagagtccaattctctttctcaggttctgcttgaagtaattggaacagtcatagtaaaaagcaagagatggaactaggattcacacctgagtctgtgcccttcaccactatgcactggcatctcccaatggattaggaaatgtgtaagtacaaggagatgccatgagaaacttgcagtcggtcgactctgtcacttataagctgtgtgacacaaaacaggaaacctcagtacaatccatgaaaaaagcagggcccagagattaacatggattcctcaacatcacacagacaaagagttgcacatctagggttggaaatgacgcctcttgacccacaatctggaactcgtttgtttttaacctacttttttagttttgttccatagaaaatcattaattgctcatgaaaagtgaaatcgcactgctgaaaacctgtcctctggtactgggggtttaagttccttctgttgctccaacactggctggtgtttacacactggtgcctgggcaggcctctcgctccgtgtctgggcttcctggtggtcactgcagcggtcgttactgtgggggaaacaggcgacacatgtagggtgacctccgtggtggtggctactctgtttctttatagacaagttacctttctctaatcagcagtccacagcagtggctccctgactgtgcctcctggagcagctgtttggggctcagtggccgagcacatggtcgcagtaagtgcacgccacccagcgagagttggttaatcatatataatccacccaacagtgggctgccttgtaattgttacagggccctttcagtttcttgcaatttcctttgtctcagcagttttggttgcatcctgaaaactgtcaggctttcttgtttctgtaaggacctgacaattccggcctcacaatgcagcttaaattggaccagctgctgcctcaatggagcagtctgcccatctccaaggcattaagcccaaaattatttcgaaaattgaagcctttgacttgctctggattaatgtgattaagcagggcttgctttaatttgtagccatctcgtcctttattaataacatctcatcatttggagcagcatgcgtgtctgcaagacaacagaaagttaggttgattgcagtttctaagagaagtctttaatgtttcaggagcaactgatatgcagcttcaattgtgggggcagatttagatctgcttgttattcttaattttttatgtaaaactaataagcaaatgaatcctccttccctcctccactttgaccccacctccccgaggtctacatatgatttatcgttccctttaagtaataaagaaaggatctttttttcatctgaattgtgtcagctggtgaaatctggaagaaatatccttcagggttaagaaaggtagaattaaatggatttgattttttttctctgtgtaattgaatgtgtattaccattaagataattataaataatctgttagcttttctaaataagaaagtatatacctcattacttgagacctagattttaataataacagcagtggattatagtggaaggaattaggacgtgttttaaaaatgtccttaataatttttaagctcaatgacattattcttataaaatttatcctggcaaacttaagacagtaataatctaagtctcgtatctttttctccttacaataatttagctaatgaaagtacatgtccaggtatttttctgaggttaaatctgatcttccttctttattatcagagccaaagaacacagctctaggagtcagtaaccctggagctactccactttctctcaccaaagcgctgtgttttcttgggaaggtcactcaccctgtttatgcctctttccatatttctaagattaggaaattgaggaggaaactttctaaaatcccttctagttctattctgtatttccaacttctgatgtttcctacccccatttacaaagtgtgtttcactgggtctggttccaatacagtcgtcttgctttttctctgtatggagtaggtagtataagtggcaaaatgtactgatatttgggtcaaatcagattatttctggaagtcaaagagcctcaaataacccaatgtcattgtatatacttaattgcttatcatctttcttaaaaataaatggctatctaatttacggttctttggctacttattagcttataattttttgtattcagatctctttataataagtatgggaggtaatgcatatgctcattagcttgatttagcccttcaacaatgtatacatatttgaaaagttcatgttgtatatcataaatatatacaatttttatttatcaataaaaacaaattaagaaaaacaactctttacataggcaataaaaatacctatgaaggaattgtaggagtagtacctgttattacagcaggggcaagttgtaaacctctttccattttttcccttcattttgcccaatattttgatatctcctgtaatgtcgatgctcgctgtcttgttaaacactttattatcacttgaggcatttatttatttattctacagatatcattttcagaaatgatttgtggtggttcttctggactgagaagagcctgggtttcacagctgggtacagcaggggtggggttgccacttggtctgagtagaaggaattctggagtaccttcgggtctctgtctgggccatctgctgcataaatccctttacaacacaagaggcagcatacttgctcttgacctggttctgtcactgtggaattggaccacctgccatcacaagtagatccagcaaatgtaccgtggctcgcacatgcacaggttgacttcttgttcatgtaacaaccaaaaacacacttcggtgggtggctttcctcacgtggcaattcagggggccatacagctttccttctgtggctctgctatctcccataaccccattgaaatctacatccagcccatcagatggacggagagcacatggagtgggcacacctatggcctgtaggccttggctcagctatggtgcacctcacgtctgctcacattcttgggagacctcacctgcatggccacactaactgtgagagaacctaggaaatggaatttttagagatgagagatagagctctacctccctgtggtgacatggtaactcctagaagaaagggcagaaatggttagtatttgtgagtacagccctttactgaacttcagaagttttagacagtcttttaaagttgatttcaaaggacctgggcatctctacattcccgtcagactaatttgacttgtggcttggtctttcaaagatttttggagctgtaagtcttactggcaccatgtaggtggtagtcaggacagttctgctagtctcattgagcatgcctagtaactggaatagatttttgccttacagtagaattgaaaaaaaattgccccgtgatggttatttttacaaaggtcatttaggtcattgattatctgggcatcatgcagttgttttcttgttgtttcctaccataatttttaccaggctctgctactaaatggctgcatgatcttgcgtatctgctggagcctctgtctcttcattagtaaaagtagggaatgtaattcttaccttgttgggtggggtgatgattaaagcgtgcattgcgtgtcttccatgtagccactcagcataactttgttaaggaaattaattaatacagagtagctgactctccagacatatgtaatgggtgaaaatagggtggagtttggacattgattttagaaacacattctcagagttttaagaaatcagcaatatcaaagctaattccctttgacaactcaactttgtctaagagataacaactccctttggcatctcatctttggggcagcgttttctgatcctacaagtttgagtttgattgtcatcctcccaccctaccccccacacgccttctctgtatgactggtttacgtctctgactctcccgttatatcaaaaacttttttccccatatgcatccccacccctcgcaaggttgaaatgcacaaaattgccatttaagtagttaaaaaatggttgagtattaacagtttcatttggttgaagctaatacctagaaggcacaagatattttgtgagctattgagcaacgtctgacacctgaatgtagcgtccatgctgctcttcttttgagtcctgtgctatgtttagcatccattatgccatcactgacttcatataggccatgaatatgtatatatgtatgatgtaatcctgagtgtgcttctggagctatttcaaatatctatgactcagtgtgcattaaatgtggcaaatctgtttcttggatattctgttgaatttacctctaaagacaactaggcctgatattttccttttggaaaacatgtttttaacttacaatccattttctaaaatagttattaaagatagtgcagccttgctttttcttctttctgggcgaactttgggaagttatatttttctaagaaatttttgacgtgaagtttttgcagtgtttttcttatctttttaggctttactgaatctgtagttatggcccccttttatttgtgatataatttatttgtgctttctttttttttctgatcaatttttttgccttcgtgaacctttctataaagtgttctatgcttcattaacttttgcccccctcttttagttccatccttcaaataccttcgtatagttgtcattctctttttaacttattttgttgatattttttactttttgctcctttctaataattaattcaattcaagttataaatttctattgctgtatcccaatcgttttgatagtagcagctccattataattcattttaaagattttaacattgtaattgtgatttttcctgtttgagttatttaaagttacctttttgatagtgatgtctaatagtcttaagctagacaacttaaaaaatatttgtaaccctcatacactgctggtatgaagggaaaatcgtgtagtcactttggaaaccagtgtggcagttccttaaaaggttaaacatagggttagtctatgactcagcaattctactcttaggtatatacccaagagtcatgacaacctgtgtccatacaaaagcctgtacacaaatatttatagcagcattatttgactattcataatagccataaagtggaaacaacccaaacgcgcatcagcgtgtgaatgggtaaataaaataaggtatacacgtacaacagcgtgaactactaatgcacacaacaacatggtcgatattgaaaatgtgctacatgaaagaatccactcgcaaaaaaccatagagtgtatgattctatttatttgaaacgtccagaatagggaaagctgtagagacagaaataagacacattagtcattagcttggacgggggagatggtgggtttgggaatgatagctaaagtgtatggagtctctttttggagtgataaaaatgttttaaaattgattgtggtaatgattacccaactgtgaatatactaaaaaccactgagttatatttaaataggtggattgtatagtatgtgaatttcatctcagtaaagctggttgttaccagagaaaaaagcattttctaccaaaatcaccaataaattatgatagctctaaactacttactttaaatttgtttgtgctgattcttactctctctcacctctccctctctgccattctcctggacttctccccatcgttggaaatgtcgaataacaaagtttggattatttatcaaaaaggattgatttaatgaaaatgaatggagaaggctgacatgaacataattttccagttcccaccctcataggtaatcatctataaacccactgggatggcacagccttgacaatgcggcggtgcttactaacaagcacacccgacctagacagtatgattttgcaaaagcagaatcctgaaacaatgcaagtgcagtgaacataggagccagtacaccgcatataacacaacttagaaaaatgctatcgataagaaatggtctttcagagacgatttccggcatgtgctacaggggaaaatggtatcaaatctacacaatgaccgggttctatggagtggctcctctgtggggaattttactttattctctttgccagaaaccttgaccccaccctgtctgtgaagtagcagcctgctttgtaaaggggcgctgatcaagacgaaggctattatcgagctgggatccaaacatctgaagcttatcaccaagcacaatagtgacggcttcttagccacgtttctaattatatttttttccctgctttttagataaagggacaaagaaatacggggcttactttgcaggtttttcaggctgctctgaagtgttctttcgaaggtggagggttatagttttgtgtaatagcagtgctgggaacagggtgggttcttccagactctccccccacgtacaatagtgtgtggatggcagagatgcattgggagctgaaataattcatttgtcctttctaatgaatagtaataatttataatttgtactaatcaaaaacctttcatccacaaaagccaacaagttttataaacattctcctctcaccagcctctacagtaagtgcctgacaaaggtaggatcgtccataatttgcagaagggccaagatagagaacacagtgcagaaatcattactaatttatctgcagcttggaatttatatttggaaagtcactttgaacttattttcatcaagctgttttgattgcccagaaatataatttatactgacctccataatggatatctgccaagatgaaagctacaaaagtcattgatccagatgttttctgttatctgcaaacctagcaaagccatatttgccagcatagtcgacattgtggggacaggtgtccattctgtgtccccttggtgtccagccctattatctctgtagcctccggtgacagagcagccatagtggcactgtgcttgatgcaaagataccattaccttctcgtctgttctctgatcagtgagtggtggcgatatgagctgagcataaagcaggaagagtggggatgcccttgtattcagtatacctccagaccttatcactaccaagtgtccaacacagggctgctaagtaatcttgaaaatataccttccactcttatcagtgcaccttcttgacaccaaatctgtattcttgatcctggaattcagaattctccatcaaaaacattgaaaagcaggttacttcatcagctctcctctatatactgtgttgaggaaaagatttgcatgtaattagcctccttccacctccctccagaaaaaccccccaaatttagagaccagtcctaacccttagaaaatgcatagtgttgcagactgcttttgaagattaaagagatgaaaattccattcttaacttcaagagcttccttaaacctggtccaaaagactttcctaaaagcccagccagttcagatgataggtgcagacacatcatattgcatatattcacattacacacacacacacacacacacacacacacacactctcacccttctctttgctggggaaaggtttgttgcagaagttaccattccaatacaccatgcaagatgcattcagacgttctcttagatttcagtatcacacggtggatcctgcattttgtcatataaaaattgcacatcatttttagctgccttcagaaccctcttcatatttattaggagtattgtgctcctatccagcagctaaagctgcttcgtgttgtccagttagggtgaactatagaagaaatgtcctatctactgcttttcttttttaaaaaaatttttatttccttaagttttgggggaacaggtggtatttggttacatgagtgcattctttagtggtgatttgtgagattttgttgcacccatcacccaagcactatacactgaaccgaatttgtagtattttatctctcacccccttcctcctctttccccctgagtccccaaaagtccattttgtcattcttatgcctttgcatcctcatagcttagctcccacttatgagtgagaacatacaatgtttttttttccattcctgagttactccacttagaataagtctccagtctcatccaggttgctgtgaatgccattaattgattccttttttggttgagtagtattctatctcatatatatatatatatatatatatatatatatatacacatatacacacacacacacacacacacacatatatattacagtttctttatctactcattgattgatgggcatttggattggttctgcattttacaattgtgaattgtgctgctataaacatgcatgtgcaagtatcttttttgtattatgacttcttttcctcttggtagatagccagtagtgggattgctggatcaaatggtagttctacttttagtttgttaaggaatctccacactgttttccatagtggttgtactagtttacattcctgccactgcttttctgcttttcttgagggataattggttaattaggaaaactgactgaagagagaatgaatcattattattattacttttttttgagacagagttttactcttgttcccgggatggagtgcaatggcacaatctcggctcactgcaacctccacctcccaggttcaagcaattctcctgcctcagcctcccgaatagctgggactataggcgcccgccaccacacccggctaatttttttttggatttttactagatactggggtttcaccatgttagccaggctggactcaaactcctcacctcaagtgaaccacttgccttggcctcccaaagtgctgggattacaggcatgagccaacatgcccggcacggaatgaatcattttttgaaaaggtttacagaaacctttaaaaaagaaaacttaaataaatgtacgttattgtgccaaacattggattcatgtccattatctctcctttgacctagagtcccctccctacttggagtggctcctcatcttccttctttagcacagtgtggaggtaggagtgaagattctggagctacattatggaggtctgggttctgactccgcccctcagtggtggtgtgatggtggctgtgccatgtaacctctctgtgcctaactgtcctcatctgtaaaatggatataatgaaaatagctcttattggcttgatgggagaattagttgagttagtatatgtaaaccacttatagttgtgcctcatccagaacaagcactgtttgccactattattatcaaatgatctctagttttgcatcttcaaaatctagtgagaatttaaagacattcgtgtagcaacttgaacaaagaatttatctagattttcatgacttcctccccaatctttttttctttaaaaaaaaaaaaaagctggaaaaatacacataacataaaaattactaacagccatttttaagtgtattgttcagcagtatggagcccattcccttcgtcgtgcagtcatcaccaccatccactcctcgagctctcttcatcttgtaaaaccaaaactctgtgaccattcaccaccaattctgcatccgccttctccgagcccttgacagccacccttcccaatcttacggagtagtcttgcctgcatttaatttgacagtatttttaacaactttcttttattaagctttctaaagcatttcccttattttttattttttggttttgttattttcatttgacacctaaaaatggtacctatttatggagtacagggtgatgtttccatacatgtatacaatgtgtaatgatcaaatcagagtaattagcatatccatcacctcagacgtttatcatttctttgtgttgggaaccttcaaaagctgctcttctagctgtctgaaaatatacaataaatgattgttaattatagtcagtctgtagggttctggaatactggaacttattccccccatctcaatgtattttgtacctgttaaccagtctctccctatatccccttccccccgctccttccccgcctctggtaaccactctactctctacttctataagatcaactttttcagcttccacgtatgagagagaacatgcggtatttatcttcctatgcctggattgtttcagttcataaaatgtcatctaagcttatctatgttatcttaaatgacagttttgttctttttttaaaacaaaattaaatattaattttaatagaaacaaagctgtatttcttcttctgcttttatttctgtatgtgtgacatttaattaaaatttctaattagaagataaagtgcaattggcctaaaccagtttgggaacagtcacaactaattgggtaagggtacccctcagctggagggagcttcttggtgcaggcatgtcagagggagctatggggttctgatactgtgggcactgggcaccgtgtctgccagcaggaatggtgtggcttatttaatctaagccatcctgtccattctaggatcttcttcctgtgttacggtgctcgtcattttcaacatctgaagcactcttacctctacctgtgtgtgtctaagtagttcccgtttttcaacattgatatggtttgactgtatccccacccagatctcatcttgaattcccatgtgttgtgggagggacctggtgggaggtaattgaatcatgggggcaggtctttctggtgctgttctcatgatagtgaataagtctcacgagatctcatggttataaaaaggggagtttccctgcacaagcactcctctctttgcctgctgccgccgccatccatgtaagatgtgacttgctcctccttgcctcccactgtgattttgaggcttccccagccatgtggaactgtaagtaggataaacctctttattttgtaagttgcccagtcttgggtatgtctttaccagcagcatgaaaacagactaatacaaacatccagttagatatactgtctccattaaaccaaagcacttgtctgtgcccctcccatggcacctaacactttctatcctgtgttttcagtgtttgggtgagttctccaagagcaggctcagtgtatcacatgtctttggatgtctcctatcattggcttcaagccaagattgaaggctcacatgtattgaattcctggcctgtccggctgggacagagagaatgagtagagaaactaagtatcagcacactttatagttaaagcctgtgtgtacgcacatgtgtgtgcacacacgtgtataatgtaatctttatagcgtacctttttggcgtttttattataactgctgtgctgacaaggaagtcgagactcagagaggttaagcgattcgtccaaatcaaatattctagctacagtgccaatgcccttggcacagtttcccagcacttcattgttgaaacgtttggtgtgttcctgagggcatgtcttggggctcctacattaattactgaccatcatcagagatctactagtcaaggctaaaagattcccaatatcaatcaaattacagccgagtctgcatctatacgaagtcattggtagcaataatttagtagttaccattagctccaatgtttatggggagaaagcatgaaattatggaatcaaacctactgggccctgaatgacctgaattaagcaaataatttggcctcattgaggcttagttttctcatctttgaaatgtaaaacagacatcataatacatggagttcccatgaagatttaatacgcaattaatgcatatgaaagcatttcatgagctacaaaagtgttacaccaatctaaggtatcatcatcatcccacgcttacagagtaaccaggaatctcaagtcaggaaaagtccagtgcagagttcggaataacacagaacaagctacctaagtccagaagtggggcctctggtgtttgttactgagagaacccctttgagacacacaccgttctcatgcgttggacttactattagtgtcttggtctggtgaatttttgctcagggctttgtttccctcataagttaaaataacgacaggcaaaggcacgtagtctagctgaatgctctccatttttgtttcagacctggatatcctacaggtgtgaagttgccaagaataagggagacccaggggtcaaggggaccatggtagagcattagagtcaccctttcctctgtaaagttgtccctgcgttctcaagctgtgtcactgaactttgagaatacccttctccagcagtaattggttcatcctggagttgccatttggttgtttttttgccctcctagactgtgagctctttgaggtcgggacctgtcttaatcctgttttggctgcatcccagagagtgctcagagctcatgctagggtttagtaaataattagtgaatgaatccctcctgtggttgtgatgttggattacgagccccatacaaaagtgaaaatgaggctggaattatagttggtttggtcaccattttgattgtactgatatttgattgaatcagactactgtttttcaggctttaaaaaaattatagtcgccctaagcggcctttttagacatttctctcttgtctcccccagtccccttccattaaatttaataccacagatatactatataccactagttactgtggccctttagaagccgtagccattttcatatgtaagatatttttgtcccccaagaactgatttttgcccccttgaagtgacaccacccttattgagaaatcataatttatagaatcaggtggtttggtgctgtgcagatattctaaagagttcctatttgatatgtacatagtcgattataaagttcttaagcctcagttgcttgttgtgttggcatgcttttaagataaagctgttggactgattttttttggggggctgtggtgtaaaataactgatgcttttggcactgtctaggaggcaaggccaagactttcctcagaccagcaacagtgtttcagtgtgggtctgagttataaacaaatctgaagttcttagttccattttttaaaaaaaatttagactaaaaatgtacttacatttattattaatagtttagttagagccatgcttcctgagcaatcctgccacatccttcctatgtgagctatttgtaaataatgtactatccaagttgggagaatatgttaccaccatatacacttaaaaagcaactataatgtggctaatgtgcagaatgaataggcaattttcattgtctttggatgacgtgaagtagctctctggcaaaaatggtgcaagcagccacggtgtttgaagtggtgagcttcaataggagtgccatttctttttttttttccttttttctttttgaattattttactttatcttatttttttgaaatggagtctcgctctgtcgccaggctggagtgcagtggcatgatctcggctcactgcaacctctgcctcccaggttcaagccattctcctgcctcagtctctggagtagctgggtttacaggtgcccgccaccatgcctggctaatttttgtatttttagtagagacggatttcaccatgttggccaggatggtcttgatatcttgacctcataatctgtccacctcggtctcccagagtgctgggattacaggcatgagccactgcacccagccttctttttaatttttgtgtgtacatagtaggtacatttatggggtatacgagatgataggcatattatcttgtgtatcaagatagtgggtatatatatttatggggtacatgagctgttttgatacaggatgcagtgtgtaggaatcacatcatggagaatggggtctgcatcccctcgagcatttatcctttgtgttacagacaatccatttattttcttttagttattttgaaatgtacagttaaattattgactatagtcaccctgttgtgctatcaaatggtatggagtgccttttctcatccatcgcatggagagtttagaacagtttttgaagaatatgaaaacatattggacttgatttcaaagaccccttctattatcatgctcgtagggcctctctagttgtcttttaactctgaggtggaacacagacacttttaggaaaacgtacgcttgacaacttacccagagaaacctgtctttgcttggagagccgtccatgttgttctgtttgtactaacatagatcctaaacatttgaagtcttctggcatctcattgtgaagttctgcgatgccatggttgatcattattagtatatggagttataagatttgattaccactggtaagttcccaaagtgctttgtgctttcccctttatgtctgttattgctcttaaccatcttctaagattgataggacagatattagtatgcccattttatagatgagcagcctgtggctaagagaagttaagtggcctctctagcagattatgccctcaaatgtagaaaaactcaatgtggttcttcagactccaaagtcagtgccatttacttgcccgtagtaaatgccttcagccttcttaaaagccatcgtggaggagtgagcaggtcccaagaagcactgcctggactgtgagtaggaggaggcagaagttgacttaataaaggcatggatttctagcaattaggacatcccaatagtggcatgaactactttgagaattagagagtgccctgtcttgaaatggtcatctggaggttggagtgggctaaactatatagtatgccatttggctagatgacctttcaggtcccttacaattctgagactttgttgaaaaaaaaaaatgttctgtccatttcctcctttgtggtttagccacatacatcagatgcccaagttcgtggttcctttcccagctttgcatcagaagcacccatggggctttgtgagaatgcatatgccaggcctgcccccagctctcctgtatcggaattccattggtggggtggagggggaggcgtgagagtatgtttcagagttccacaaggatttctaagttgttaaattgtgaaccactcttcttgtgtagcccactgacaacaaggcacacacagacctctttttaaacttggtggtataattcagtagcatcaaggaatcatagtttctcagtgtgcaatacccttgttaatattaaaaggccatttaataaactgcattggttctcttggctgcagggataccatggtccctgcttgacagattggttttgcccatatcttatcatccctgcctgtttcgcagcagagtgggagtttggtgccagtctagaaaatgggcacaggtccttttgtacccttcttattctggaaaatccagctcaaagggttagcattgggtgcgaaggccagcctctgaaatcagcaggttggatacagaaactagggagtggctcactgctatcctagttacctacttctacgtactggttttctttgtaccagttagaaacctccagtgcacaaagaattaacggttgccattgactgctttcttgaagacttttcttgatccagtactgagctgtgtttatggcactcctctgagagcataatctctgaaggatatgtctgtataaaatatacagcagaggatcataaattctccatcgtgtctccccatggcgggccaacaacaacaaaaaattcacaattgctccaccagtattttttttctacttttcaatcaataggatgctttttaaagcttatgtttctcgtcggacactttaagtgacgaatgagacaaaagaaaaaaaaaagccaagataaaatgacagtatagacactcctcaaatcctataatgaactccacagggcatccaattttgatgtattaggattttttttttataatgagtacattgttggaaatcacattttctatccgcaggagctggagatgaaaccgagctgacatcttacctctttgtagttaattagcaagagaaaagtagtgttttgaatctcgtgtgggaaaaggggaggtattattcacccaccctcgcccctttctcccttcaaacacctggatcattctgtgtgctctttgatttggtttaacggtttggataagtctggctggcagggaaaggatgagggaggttgaagaatggttattatttaatgaaaaaaaattactgtgtctccctctcccctccatcttgcttataggataaataaactaagtcaagtctttttattttaaagatcagtttcttacctggactcggactctaggcagttcccgtggcacaagggttgtttgttgtcaccatcgttacattagtcaccgtggaatcctcagtgctcagcaccgtgcatggagcttagcaggcatttgatcagtatttattaatgaataaataaaatggtgctggcccatacagtaaagtattctagtcgcattagctgtgtctaatacctttctctgcatagtagccacatccactttaggatttgtagtgaggtttccgtagaattcagtggttagggacagagggttggagtccagtgtgcatgtgggattccatctagggactggtcattggcaggtgaatggagctggggtccatacagatgccccgtccggatgaaggataagtgagtggtgggcagatgcagcacgagggctcctccggcccgtacgtctttattaacatcacatcacatgcccagtcctggggcctacagaggagagccactgtcactaagcacatacttgtaagcactgagcactcacaggttgcaccgcatgggactgatcccaagtagaataagatggggcggcagggccgggtgtggaaggaaacaccactttttgcatctcctctccctgcccttgctgaactctgcctgctccctccaccgtcggtcctcttcacagccacccgctgggggaccccaggggaggtgactcagtggaggagccctgctctgacaaagtcagtcccacagaatcgcagtggccgggctctctccctgcacagcgcctcttcctggggtccccagctcagagaagcctcctggaggaagcaagactcgaggggaccctgaaagcaggcagggcttggactgtgggtagcctgggacactgtggactggggacagcaggacctggggtgaccctgagggcagagagggcttggtgggcgagccctacaggctggggacagcaggagccggtggtgggtgtgaggggttagcctggcctggggagggtgggggaaaccaggttgctgtcataccagtgatggagggccctagtggccagccaagggctcctgtaggccccagggaaggggacagagatgacaggtgtggagaagcagcaaggaggagggcttgttggcctctggctaggcttggggttgtctccgtccctcgtgagctctgagccttggctttcctctcagtaaaatggacataggagcatttaccccaatggccaagggtggctgcaatgctgacatgagtctatggatctagaggctttgcagggcacaggacactgtctgaaggcagagtctgaggttcctgtccctataggattgcatcaggggtgcgccatccctatgatgggccagctaagcagctcccatggtggccaggtgcgtgggtaagctcatgagccactttgtggctttgcaacaacaaagatgagctactgcttccatttggattcctgctcttgctttggatgccctccccgccccacaagtcatctgccgtgaccgcttcctccgtgtgcgtctgacgtcccggtatgcgtgtgactgctcaggcgtgactgcttagcgcccaccaatgctctcctccagacatctgcatctctgagcatcttagcctgggcctcagtccagcctcccccacttgatatttgaatgattttggacgagcactgtgttttggatagcactgtggtgactgttactagggaatcatctggacagcgaagaaaggtccgacgtgtctctggttccccaacctcttcctcagctgtactgcaggtctccgtaaagggttcctttcctgtttccttcctcccctcctgcttcctccccttccctctcctccctccctttccttccccttctcttcctccttgccctctggggctcctgtgagtctcctgatgactggggcagcaggtgctgggacacaggagagcacaggctgagagctggctactcagggatctgtggcgctctagaccagtggttcacaacctttccttaacactaagaatcatcttgggccaggcatggtggctcatgcctgtaatctcaacacttcgaaaggccgaggtgggaggatcacctgaggttaggagtttgagaccagcctggccaacatggcgaaaccccatctctactaaaaatacaaaaaccacccaggcatggtggcatgcacctataatctcagctacttaggaggctgaggcagaattgcttgaacctgggaggtggaggttccagtgaaccgagattgcaccactgcactccagcctgggcaagagagtgagactcctctatctctaaataaataaataaataatttttaaaaagaatcattttgggaaacttttagacatagattccctgaccaaggacattgggaaccaagtcacagtagcagtcaaatgatactagcaacgctgccatgaagaaaggtgataccggctgagttattctgcctgtgctgggccagactgctcaaatgcctcccgtggagttttgagctaatcatcaggacagtcccctgaggtgggtgctatcagtgtccccattttgcagttaaggaagttaaagcccatagaggaagaagctttgccaaagtcacacagctgctaagtgaccagggtggcaactcgggcactctggctcccaaaccgagttcttgagctctcctctccatgctcctttggtctgggtggtgcccagccatctgtctagataggtatcctgctgactgcaatgtggcagtctatggctggtagggacgtgggggaacagtgtgaccgacctccttgcacagggctgtcattgcactgcgggctacagcagagcccagttcacactggagggccacccactcagctgggctgttttctgaggaaccagttgtttgtcctcccctaaccttctccacagcagcacagagtccaggaaccctgagcaccgggaccagggccggcttgggaggggtgggggcgggggctttgtgcacaggtcttgcctgtgggcctcatttctgtgtctctggtatgagaaaaacctggattgaatagaaagaccttccctgaaactgggaggttgctgagagaccaaagaatgacttggacaagtccagcttggcgatagatgagtttattaggacttacatagcaggcactcctgggcggcaggacagatctagagatccctgctgctcccgtctctaaactgcctttaagctaatttcctggctctttgcctactgtgtttgggcaatgagactgcttgtcttgctacgttctcagataagttccggggcattgggttctcagggacgcctgctcctcagctgggcaccatggcctcagctccacctgacttcaaggctcaagcagtggacacacacctttaaggaacctgctgggggaccgtcgcactgcgctgcctctctcatttcccatttcttgtccccacgaagcctctccggaaggcacaggctctgctctcgttcttactccttccttctcacacagggacctggggatctacacagaccacgtgggcctagactgctggcccagtgacccttggaggcccccttggtccttctagatgagccccacctgggaccccacgcaggccgagctgctcttggttctgacggctctgctcggcctccctcccaaatctcgtctacataagacctgcttccctgctggcgaagcaccaccatttctatggagaacttggggtgtcattctcaactccagtctgagttgccatcatgttccatgatgctggcagcgtgtcccagcctgtggtcacttggcaccccctggagaggtggacttgtactctggatctgcagcccaggcagcagtgggagcctctcctccagctcagccccggtgcctctgccctctcccaggtctcatggactctggtggacaaaggttcttgtcagaggaagtcgttgacagggtgccatgggaaacggcctctccagggaggcaagattccagcctcagctcttgctcctgtagcccctctttcggaggtgtctttctgcctggattaaacacttgctcattaaacctggcttaataagaaactagaaaagaaaaagaattagaaaaattctgattctagactgggtaatcgctttgagaaatgcgatttttcccttttgccacttcatcaaaagagtgagaatctgggcctttctagggtgtggatgaaggctgagctgcagtctccagcagaggaagctcagtgcccagaccagtagtacacacaactgagacttctagaatgaatgaagaatgaatgaatggataaattggagtgaggcacttacagagataaaattcagtttgataagaaggaggcgtccttaaatcttgtgttttctcctagagttgagtcctaatgggggcggcatccttgtacggaaacacgaaaggttaatagcaataacaatagaaacctcgtgtttgtgtatggagagccttacgcttcccaaatactttcccacagatgacctcatttaatctttgttttgtcacagagatattttattcccatctaaaaaagtaggacacccgggatcacagtcaaaaaggtattaaactctgtgttggaatgatggtttaagctacttcttgtgacttctattccaattttccccatgtcatcacggctgattagagaataattatgataatacaactgagaataatataagatgtagagacttaagtcccatgtgccaggcactaatcacccagtttgcaggtgaagaaactgtgcatagagtggttgggtagataaaggcccccccagcatgggtgtgggtcccgaggaaaggcatggctcatttgccagggagctgtggtgtggacctgctttgcctcctctcccagaccccgccaaggtcatgcacctgcccagcagcagagccaggaggccaaccctgacaatctgactcctcaccactacctgctggcatctcaccacagctcaccggctctctcttctgttcttatgtactgcgtgggccagttccctgctctcttgttcttgtcccagcagcccaacagtagcaaaatctaattatcctaacctggaagaatcaaaggtgacattttctccacggataggaagctgtgctggaggactgtaaacattggttgacttatctcggggttctctttaaaggcacctagttccatggatgacttagcttccatgtagctagatgaccccagaatgcctgattttcctggccccaggtcatgcttgtatgtctcttcttggattggatgcttcgtctaatccaaggaatggctgcctttaatcaacccctctccatttgttcatcttcctctggggctgtggggtaaggcagtggagggagatgcttagagaggacatcatccttttcattttttctttcaagatatttttgaacagcaacgttaaagcccccgtaatgctgctgtgaattgttaacaagcatgtttgcacgtcacatctatcatgctatgtgcgcgatgttatgtgaagacacggcttgaagtatttttaagatctggcctttcatctctggaagcacaagaaagtatttgcagattggtctctggaatgaaattagcctagcacgttggctggttcctgtaaagtgtgggcatttctgtaagtggttctgagtcccttaatccttttgatcatttgcactgtgtatttttacacaggttcttttactttggagaaataaagtaaagaaacttaaaggtgagtttggcaagggcatcactgtgctgtttgtcaaggcaaatgaatcttgaatttgaatggtagtagtttcttttaaacaaccaagcttctttaaacctctccacaaataacgtcagtggcagattatgtctgaaagtgtttgctggcgagtggaaatctttcctgaccccatattgctgtcatgaaagaagagcctaatcccataaaatattcttgacagcctcgtgtcagttaccacacagctgtgatttcttatctgggctacagcctgtgtgacatttgttgtcacttcatggcttcaggtttctccattcagaagctcaggtcatagtaggaggttgagcttcatccccggttgaaacctggttcgcgtatgactgaatcctcttacgtcctcactgttgtgtgaaaaaactcatagggagaccttgatttcctcatctgtttaatggggaccatatgtctctggcaaaatcgttgtgagcaatgtttgtatgtctgtgttcacagtagcattgtttgcagtggtaaaaaggtagaggcaacccacatgttcgttgatggatgaatggataaacaaacaaaatacacccaatggaatattattcagccctaaaaaggaagaaaattcagacacatgcaacaacatgggtgaaccttgaggacattacgccgagttaagtaagacagtcacaaaaagacaaatagtggattccacttataggaagtccctagagaagtaaaatccacagagacaagaaagtggaaagggggttgccagggcccagtgggagcgggcaaggggagttgatatttaatgggtacggaatatcagttttgcgagatgaaaagagttctggagccggatgattagtgatgattgcaaaacattgtgaatgtacttaatctgatggtaaattttatgttatgttcattttatcaaaataggaaaaaaatccatgagcattaaatggcatcaagtagataagtggctaccatatcattgttgttcactaaatcataaagtaacagctttgaccatgtgtgggatagtaaaatatgtggtattttaatggttctatgaaacttcatcttatgagtataccatgtttgtttccctttgtttggcttgtgtatttcttataagtattctaccattgtaataatgacagagtgaattttttgtgcatgtatatatcttttctattagttgaagttatacctttgagatggatttcctggatcacttaatcaaggtaaatgagcgtctttgtggctcttgctacatacacccgtggggtttcagaaaagatttagtgattttaccctgtcactagccaagtaagggcaccatttcattgtatcctcaacagcactaagatgcttctaagcaattttattaaatgtgataagagataatatgttagtgtttgaatatgcatttatttgctttcattttgatcactaaaaatgttggcattttgcatgtctcaatttacatgtatttcttcacataggaagaaatacatgtaaattgagaagaaatagcctgtttacgtcttttgcttatattttagtgtggtttcaatgtttttcatgccaaatatgtctgtcatgttgataacatattaccatttttaatattcagagatttttaatgcttatgtagttgaatcacttatttaaacatttcaaattacaaaataatatgttctactagagcaaaagtggttttacaatcacattattatacctactgtatctttttcccaaactctccactgtcattcttttcatatcttttagcataaaatctgtttagatgctaacttgaatgactatagtatttgaattaaaattatatggactagccaattaataataaaatattaatataataataacccagtataaaaggacatgccaattagagcaaagaagaaattaaaattgctaataaccatgaaatttgtgttttacttcactaataatataaattcatcctaaataaaacaatagaatcctatcttccagctatgaattgctaaggattaaaaatgttgtaatggtgactgagactggccctcaaaaacgctgccaatggaaagagaaaactgggtcaactttactgaaaagcagtttggagctaggcatcaagaaatttaaaaatgtttagaaacattgatttagaaattccatttatataactaaggcttgaggcagcttcagaagcatggaaaaatatttacatttatggataaaaatatatttcagtctaattgcccaatgacaaggaatgattgaataagtagttggacaaccatctgatggggagttatgtattcattataaatggtgttttctaaaagttttagtgacatggggaagtattcccaatatagtggtaagagagaaaagcatgctgtaatgaatgcagtggaagaaatttgtgtgtgtgtgtgtgtgtgtgtgtgtgtgcacgcgtgcatgcacacatctggtaggcacccaggaagagattgataaaatttattgatagtgcttatgtggcagtagtataggtgatttgtattttcttttttctttcttttttttttctttgagatggagtctcaccctgttgccaaggctggagtgcagtggtgcgatctcggcttactgcaacctccacctctcaggttcaagtgattctcctgcctcagcgtcccgagtagctgggattacagacacccaccaccacgcctggctaatttttgtctttttagtggagacggggttacaccatgttggccaggctggtcttgaactcctgacctcaagtgatccgcctgccttggcctcccaaagtgctgggattacaggcatccaccaccacacccagctaatttttttgttcagtagagatggggtttcaccagattggccaggctactcgaactcctgacctcaggtgatgcaccctcctcggcctctcaaagttctaggattacagtgaactgccgtgcccagcttgccaaattctttactacacataaggtgactgaaaacagatagataaaaaatttatatagcctagtgatcttagtatggagggatctcttatttgccatgctctaagactataaaagaaagaaggacatgaatttcacaggtacaagcagtactgcaaatacccacccctgatccaccaaacctccaggaccaccactgagaacaggcctacttacagaggatcctgcaagtagacatatgtcaccatcattgtttaccacagagaagaattaggctgggaaaacacttaccaccctgctgggtatttaaatctgacccttgtcccagtgttaacagcacagcacgtatgtccctccttaactcactgatctcatgtgaacgagtgatcagcctgttttttacaggtttctctccctggcaccatctcactgtggtgcagctgagctcactacatatagcatggagtgatgataaaaataaattggctctttccctttgcagagtttcagttcttgagcgctatgtcagggtggatccataaggtttcctgagtgagcttagaaacctgaaaacccacgtttgttttttcatgaacttaaaacaatttattagagcacaatgtagaagtcatcgcagcaagctccctggaagagaactgtatgcttttatggaaaaagaaccagtaacagagccttgagagagactcttagctaaagtctaatcctccttccattcttccttcacagggtagagtttcagcttttgtctgttgttttttttgtgaacaaaaaacttgcaataaatggatgttgtcagtaaatttcggttgtacgttttgttttttccaagaaaaaactggccatgcagaagtcgtccgagtggtgtaccagccagaacacatgagttttgaggaactgctcaaggtcttctgggagaatcacgacccgacccaaggtagagtgatgagtgagccagtatttaattatcttactaattacagctgggataattagtgtttgagctgcatggaagagatgaaccttgaaatcacacaggagctcaagaatatgattgcagacatttattgacggaggagaggaggggctggggagaaaaagggtgagagaataaaggcacagccacattcggcgcccctgccccccttacagctgtcaggggtgggaaaattcccacagaggaagacgccagacaatagcgatccgttcacctttgattattgcattattcctccttaatgcagtcttttgtctacaaaattaaagtgtctttccagcagctccaaagattcctgatttatggtttctttatttctctgagtttagcctttctcgtcttttgacgttatcaggttggatttttttaaaaaaatgtatgtggtgataaagaagaacataaaggtaaaatgcagtattcactaggtccacaaagcttgctcatttaaatatttcatttgttctctttggaatttgttatgtggagatattaatatatttgggctataaacaatggtggttggaaattttatttgaatgcatacacaagtgaaatattccatgttggcaaatatcattgtaatattcaataatgaagcaatttcaagattgcatcccagcagccttgcaggccctgctttgccagtgtgatgatctgatattatgcagcttatgaactgaaaagtcctatgcaatagatgtggtttttcacaaaccctcttcatttggcagtcagtctatttcaccaaagtattttctctttggtgtcagatttttgtgtagtggatatgcagtgttatttcttgatgagtgaagtttttctccaaatgtaaattgtgcttcatggtggaatcttcatatgcctgtagcagcacaggttggtgggtcctgagtgctggttctaagaaccatcccattctagggctttttgccagagggcaaaggtcagagatgaggcaagagcagcaaagtgacaaactcgagcagggtgaggcaggttcaggatccacgcagatctatcagggcagatgggggcctagaggtctgggcctaggaaggaggccgggggcacgatttccatgaccacaaagtctggtttgacatgggggaatgggtacctggtggaagagggatgaggtatggggcagggtagggaaagaaccggtaggacaagaacactctaatcagaaggttcacgtgtcaccctagcttgggatatgggacatcacttcatgtgggaaggcaggtctgtgggcctagattgctttggttctgcaggaagctctgcagtgaggatcataaatcagggtggtgacagccagtcgctccttctggtaagtcatcaatccagatggagcagacgttcagccatttgactgtcaaagtcaagggtcagaggaagatgataagagctccaaaattatcagtgaagacatgtatcagaggcccaggcaaggcctgaaggcatgtaggtgacaggtcgggtctgtgtcctttaatgtggccaactgcaatgccacgtcctgatagaatctccttaggcttaggcctggcagaattgtaaagaaggccaagtctgtcgtcaacttctctctccataccgctcttaaatgctttcatttgatcacatcttcattgattaattgggttgctaataccggcccctgaacctcggggggaatactactatgatgagggtttgggctgggagaactcacctctctgttcatcatttggccttctatgggctctgtgtttgtaatggtggcgtctctggggttaaaaaagattttccagatcttcacatcataggtggtaatatggagaccaaaacaaggcaagggcatggctaaggttgtagcgtgatccagtctccccagctgaattcagagaaccactcatcaacaccagggcaaccctgactgccccaggacccctccaatctgtggtccccacccttctgcctctcttatggaccatctctttccataggtcagtggcctccccacaggtgaggaagaggtaaggaagggcaggggatgatggttagttaagggtagggcgagagatcctccgtcaggaacctctactcagctggctttgtttttcttaagctagttttttagtttctattacatgtaacagtaacaaaaatccttactaatccacccattcaatccaaacaatcttatgcccattatatttgccaggtgcccttttattttttgtttttgttttttattttattatttttttgagactgagtcttaatcctttgctcaagctggagtgcagtggcgtgatcgcgtctcactgaaccctccacctcccaggtgcaagcagttcccctgcctcagcctcctgagtagctgggattacaggtgcatgccaccatacctggctaatttttcatgtttataatagagttggggtttcaccatgttggccaggctggtcttgaacttatgacctcaagtgatccaccctccttggcctcccaaagtgctgggattgcaggcgtgagccactgcgcctagccaccaggtgtactaaatcactaaggcatctgggatacgcacgagtatccggcctcttggttaatgcacatggaaaatatattcctacaggaagaaaataattaattccaatatgctgagatcaagtgagcatacagataaatgcgcataagaccacaggctaaatgttaacatgaaatcattaaaacaagtatgtgttagcacttgaacattaaaggcaaaaaacaaacaataaccaacccttaagttcagaataactctggtatcaatggagttgatattcctggggaaccctgaaggtccaaaaacagtgacacatgtcaagtgtcatttttccaaggtcagaatttgaagcctgctcctcgaaggatggaccagaggcaggggagagccaggctacaaatgaacttggctatcactcactcaccacatctgaccacagctgcctaaatctctacttgaggtcacatggcaacctgtcacgtttcacagtaaaagttggtcttgaaaagaaagccgccactagagaagatgagggtggtgaagatatgtaagactgactgttcttactcagaaaatggacattttgaaagagagcagcaggttggatttggtggtgattctgatctgtgaggccgtagtccactccaggttcttttcagaaacaaaagtgattactaaaactactcgagcaatgctcttgcctgtgccagaattgcttatcaacaaaaagacaaaacttgtgtagaagttgaaaagtcattgacatttgatgtgaagatgcgcccaggaaacatgatttccacagaaatgtgactcaagagaaatgtattttaattagcatgttgaaagattttagtacctttttgtaaagtcattaaggacttgaaggggccttaaatttttttggttataattcactgcattttataggagaagcagtatctacagtgatatttgcaaatgtggagattcttgctgatgtcaatggtcttactgtagtagaaacagcaagaatgtaagcttagagtcccctttcagttaaatcagatcttcatggcataggctaaacagagaacattcagcatgttctttcctgcttcaaggtgctgaagcagctctcatagtatctgccctaatggacatctagatgaagtccccatgtgttttcttcctttttttttttttttttttttccggatggagtcttgctctgttgcctaggctggagtaccgtggtgcgatcttggctcactgcatcctctgcttcacaggttcaagtgattctcctgcctcagcctcctgagtagcttggattacaggcatccgccaccacacccagctaatttttgtatttttcatagagatggggtttcaccatgttggtcagcctggtctcaaactcctgacctcatgattcgcccacctcggcctccccaagtgctgggattacaggccacaaggcatgaaccactgtgcctagccttctgccattttggagggagcaaagctggtaagtgagagattggaaggtgtaggctttttaaggtataggtgaggcccgagacctgttattccacagccactagacagtgagtctgaagaggatgccactccacggattagcctaaggaggaatgacagacatgctagcatcattactcatgtggtcagtaagtggaatagtcttttcttttaatttaccaattaccacagaacctctacttttgctgaaacatttgaatcccactgtttaagccaataggttctattctggccttctttcttactcatgggatgaagatagttcctttaggcttctgaggatagactggcaggtgtacattcctggccatggggtacccagactcccactgtctccaggcaacgtggtgggtgcctgagatttaggagttttgagttctggtccctggttggccccttcccaaccacatgattttggccaggacacttacccaacctgaacctccatttttctcatctacagaaaaagggataataatgtctatactgccgacttaatggtctgatgtaggaattaaataaaatagtgtgaaaataacatgaaaatggtataggtgccatgccagtgccaggtattgttgttacgtctttttcaacacaacaatacaattccatcagattttaattttacatttattcttacatctgtgttgcccttgattctttgtctgggtaagtatttaccctccatctactaaagtgtgggttttctacccaccgagattcttgtgtctcttgcattggttggaaagagttcagcattgtttatgttgtcttctgggaccttgctggtgctgacagtggtgatgaggctggtggatccttgctcaaaagcctccttaaggcttcttctcacagagtaatctaaagaactggatcaggttcccagcatttcatggctggtctgtatcctcctaactagaatgacctgtgcatgaataacacaattcagacctcctagtcctgcgtaggactcggggcacagactgagtgcctcgagccaagccacaggtacaccaggcagagggtcttcagttttgtgtgacttcacccactaaatctgatttctcagttgcaacccatcttgctgtcctcagtcctggagcaagggagagcaatatttactaagcacctcttaggggccagtcttagcgatagatgtttcataatcctaattgcatttaaatctgaccataaccctgtgaagtaaggatcattgtctttgcttagcagaagaggagcaatgaggttccaaaagactcataatcttgcttaatgttagtggcggtatttggatgcagctctgtctaaagctcaggtctattttcttttccatacactagaggaatccaagcttcctgactaggaagacctcttctaaggatgcacattttttttttttttttgagacatggtcttgctctgtcacctaggctggagtgcagtggcacaattggcttactgcaacttctgcctcccaagctcaagacatcctcccacctcagcctcctgagtagctaggatgacaggtgcacgccaccatgcccaacttattttttgtatttttggtagagatggatttcgccatgttgctcaggctggtctggaactcctgggctcaagcaatccacctgcctcagccttccaaagttctgggatgacagaggtggccactgcgcccagctggggtgcacatttttatggatcctccagtgataacaattgggcttttagtacatttaaaaaagcaaatatattaaaatgctaccatggatttaattatactttaaattgcatgcctatcatattcaccacttccacatcatgtacttctggaaaagggaactattgtacacataatgcattctccaggctctagatcttgcctgctgcacagttggatgcgtggagcttttgtggcaactccaagccttcccagaggactgtggtctggaaactgctccggtatactccttggggagcagtggcctttgcagaggcctctggctgagagtgctggttgaccccaatattagggttcccccacctgtgtagtttaagaattttagctggtgtgcagccacccataaagacaaaatccctgagacaccttagagctaagtatggccacatgtctaaattctgactatgggggccttagtagaagtgacagcgtgcagcttctgggtttgtggccttagaggaaggggcattctcttccacttcctcccttcccacaagttagtgtggggctgaagtggtggaccatcacgaagcccagggatggagcctgacccttgtgctgctagagctgtgagactaaggagccagagtcaccatcccaggctggatctttaggcaagaactcttgtttaaagtactgctattgtggttcattgaagccttcttattctcattttctacagcagctgaacctatgtcttgactaacacagccttcaactataagctggtgatgaactcccagttacccttctgaaagccttaattgcagtgttcccttaattaaaacgtctttaatcaaacctgttgttaagagtgtggaccctggggtcagagatgtcatggctgtgaaccagatcggcccggcactcgctgtgcggacaggcctcatttctctctatccacttgaccacgtaggtcctccagtagtctactaactggcctgtctcaccctttctcattccctgctccataatgccctgttaaaaacacaaaaccagctgtggccccctctggcttaaagcactttgccggttgcccgatttctttgggatgagatccggactctttacagtggccagtgtggcctgggattacctgattggcacttgcctttccaactttggctcataccacagttctccccagactatgccccatccatgctcactgtgcttcagttactgtcgccttcatctgttccattcctggaagacttgagctctttcttgcctcgcacactgttcctactgcttagcctgtccatagctcttggtctgccaccaacatcaggcaagactgcaagtctttggaacctcattgcttctcttctgctaagcaaagtcagtgatgcctacttcatagggttatagtcaggattaaatggaattaggattataaaacatctgccactaagactggcccctaaggggtgcttagtaaatgttgctcttccttgctccaggatcgaggagagcaagaactatgtgactggctccttctcctttaagtctcagctgaagatatcgtcctcagaaaggtcttccctgcccaccctaattaaagtagcagtcccagccctcacccccatgaacttctgtactatcattctctccttgcttcctaactcatcatgaggtaaaatcacatgtttaattgtttattgcttattctctgactcctctagaaggtgggctttgtattaaatgttttctcattgaactagtgagtgaacctctgtttctgcatctgtaatagtttgtgccttctcagtgtcggggcgcacacgggcgcggagcctgccgtgcagagcgtggcgcctggtgcggaataagcgctggctctaatagctgtcgtgctcatgccgcctgtggaagggccgtttccatcaccagctgctgtttgtttgtcttgttctttcgtgaatcccagtatttgtctgcttgttctctatcatttttcctcagctcatgttctgattacccctgatggcttcctattcttggttcacaccctttatcctcaatcagctcctcttcacccctttccacctgcagcacagctcccagttgtcctcagaaggcttggtctggtttgccccccgtgggctgcaccgtctatgctgttgggtttcctggggccccagggccacacatcctggccttaccgtgagctggggattctgtggggctcctcagcctgtgcttggaactagagagcctgcaaggactcttctctacttggtgtccttgggctgcatgggcttccctgccagacgtgtgcagtcaccacaaagccctgctccaggcgagttttttccaggtggtcccagggaatcgggtgggataggtccactccgtgttcaggaggttggctcccgagcctctttccaggtgcactgtggagaagcaggtcccctgtgctgtctactgggaaacattcattgaagggagacaaatcctattttccttctgttccccatcaacttggcaataaaatactgtcgttcgtatatttgaacttgccagattaatatctgaacttccttgtgctgaccccttgaagttagttttttaaaataagtcaccagttttgaaggactatccttttttagaccatatacaaggaatctatcatctgcaaataattagacagtgggaatgatattgtattgctaatgagcagatgtgcagactcggattggaagaacagctgcacacatataaaatgcaaaagctacccaaacccagcattatgaattctgaaagggatttcattcttttaagaatttcagaaacagagaaaaatgaaacaaaagaatttaactgatatttttattaattgttctttcagtcacactttcccttctatcacattatcatacgtgttcatagtatctttgctgtttgcaaaagtgttatttgcacttttaaatccttctgtcatataatactataaagcttctatttaacatttttcctttgcctttctagtgttacaagggtttggtgtctgcactctgagtgacagactcttactgaaggtctttcctgagctgtgcacaatgctaagtgctcatgtgtacgtgatcccatttgctccttaaagcaacctatgaaccttagacccattttgtagaggaacagaaaggcccagtgaggtgaagtgatttggcacaagccacttactacattgcttgacggaggtggaattcggacttcagggctaaaatcgaagcctgatgttctttctgttgggtagcacatggccccacagtgctacacaattctatcagaaagcagaaaacatgacccactggaaacagcagcacattatccgatgattttaaactctttgtgatgtccattacaattttataatcctattaaggatttgcaagatgaagaagtccaaataatcaggcttttgaaaacttttagccaggaagagtttcacatatcttagatagtaatggttaggtcatttagaatttgaataaattgctgaaatggtatgaaatcactaaaaagaaatgaagtcagaagaattactagacttcacataaaagagtactgaattaggtcacagaaaaatcagagctggtaacactggcaggaactaggatttctaggttccaggaatggcaggctgagttattcagaccaaattgcccactgaaagcagctccaaatgttgaataaaatacaactatatatataaagcatcacatcaaagggctgacagaactatgaggaattaaccaggttaaaatggaaggcaacacaggaacccagacaggtaagcagaggattagatatatctttattctgagcaaacttgttaatcccagaaaatgcgagctttgagagccttattaaggacgtagagggagtgaccaacacaattccagcacttgacccagtggacataagatgctgtaccccacacctgggggggcgccttcttctcaatcacacaaggaacatattccaggccataaaaggctcagtatgtttcaaagggattaaaatcatgtagctttttttttctcttaccataatgcaagtattcagaaaatcgtcttatgttagaaaatttaaaaatttctggccaggcattatggctcacgtctgtaataccagcgttttgggaggccaaggagggaggatcacttgaatccaggagttcaggaccagtctgggtgacatagtgaggtctccatctctacaagaaatttcaaaaaaactagctgggcatggtggcacatccctgtagtcccagctactcaggagtttgaggtgggaggggtgcttgtgcccaggaggttgaggctgcagtgagccatgattgtgccactgcacaccagcctgggcaacagagcaagagcttgcctgaaaaaaacaaatctgaatatcctagttatcaaagataaatcatgatggaaattgtaaaatactttgaatcaaatgataattaaaatactgtatgttaaaatcgatagggcataggtaaagcagttctcagagggacatatagagccttaaattcatatattagaagagaaaagaagctgagctaagcgtccatctcaagaacttagaaaatcagcaacaaattcaacccaaacagtataaaataaataatgaagggcagaaagaaatgaaatgggaagcaaacaaacagaagatcaaaaaagccaagagtcgatatttcacaatggctacaaaattgataaagctctgggaagttgttcaaggaaaaagtgagaagacacaaatatacaacattaggaataaaaagtgggatatcactacagatgtgggagattttacagaaaccaggaagatatgataagcaactttgtgtcaataaatttgaaaagttagatacattctttaaaaatatagtttaataaaactgaataaagacaccactggcttcatcagtgagttctcccaacatttaaggaagaaataattgcagtttttcataatgttttcaagagattagagagagatgcagtccatcttatgatccttgcatagtcttgataccaaaacttaactatgtaagaaaagaaaattgtaggacaatcttacttatgactatatttgcagaaatcctacgcaaactattagcaaactgaatttaatagtatataagaaaataatacatcatgaccaattttagtttcctccaacgaacacaagcttagtttagcactttagtattagcccatgtaattaaccaccttagcaggtattttaaaaacatgtatgattattgaaatagatgcttaaaaagtattgaatacaattcagtattcataaatgatttaaaaacacatataaaagatgactttcttattctgataaggagtacatgcaaaagcctatagcaagcattgtatttaataatgatgcattgagaaactacagagaatgccattgcaatttctaatcagcattggagtgggggtcctagctcatgcagtaagtcaaggaaagaatacgtgtatgctgattgaaaaatccactagatacctatttatctttccccagccggacaccattcctcttctcccttgaagtggtcatgtgactgagttctggccagtggaatgaggaagaagtgacatatgctgcttccagacctggctcagaaaaacctgctgcatgatctgtgaacttctctctctgtattcagtctgcctgctgaatgctaatgccgagggaaacctttgaagcaacatattgaaggtggtgaagcttctgtcagcctaggcccctgaagagttcatgaagtagaactgttaccatctcctttttattaactgctttgcatgattatgaaagaaacttctattatgtccacccactggaatttcagggtttacttatttaccaggaactggtaccttgaagtggagtgctaccaaaaaatctaaaaaaaaaaaaacaaaaaacaaacaaacaaaaaaaaacatggcattggcttagtagttaggcagctggaagatctaatattgggtcttgtttatggttggtaaacacaccaattctctccaaattgttttatgaattcagtgcaaatccaaatgagatcccaacagttttgttgttgttgtcgtcagtgttgttgtttttgtggatcttaaaagctaatctcgacatttatagggaaatgcaaaagtccaagaaaagcaaagatacttgcataagaacaagaggatgagaggacttattcttccagatatcgagtcattataaagctacagctgttaagacatggtgtatctgatgtagggacaaatgaatagagagttcagaaacagacccactcatgtcaaagtatgacaaatgacacagttggcatttcatagtactggggaaataatggcttcttaatcaatagtgataagataattttcttataggaagaaagttaattggatttctgcctcacaccatacacaaaaatcaattccaagtagattgaatacataaatgtcaaaggcaaacgtacgaaatttcaagtagataattttcatgaccttgggtttcggaagcatttcctaaacaagacacaaaagcactaaccgtaaaggaaaaatatttgacaaatttaactatatcaaaatctgacaactttggttcatcaaaaagcatcataaagaaaatgccaagaacagaaaaaaagaaaaataaaaaataacaaattgccaagaacagagagattatatttgataaaggattagtattcagaatatataaaaaatagacttaaatgtatgtgcagtatttttttttagaaaagacagactgctgagagaaaaaatgggcaaaggacttgaattgtggcaaagaaacataaaatgataattaacgttattaatcaggaaaatgcaaattaagatcaagtgagattccattacacaccaagcagactgacaaaaagtgaaaatctgacattagcagactttaatgaattggcaagcatttagagctccaggaattcttgtgcagtcatgtggttttgtaaattggtacgactactctggaaaaatagttcagcatgtagttaagttgaagacatgcaaacactctacagcaacaattctatttctaggtatgtactcaagagaaactcatgcatatgtataagagaatacatgtcaagaatgttctttacagccccaggctggtaatgttcattaagggtagaatgtataaatccattgtggtgcattcatacaatgggatattatgaagccatgaaaatgaagaaaatggaaggacctcatgatcataattgtaagtgaaagattcaaactgtagtataattgcatttatattaattttaaaaataggctgtattagtctattcccatgctgctaataaagacataccggagactgggtaatatataaagaaaaagaggtgtaatggaccccaagttccacatggctggggagccttcacaattatgaccaaaggcgaaggaggagcaaaggcacatcttattacatggcagcaggcaagagagtgtgtgtaggggaactgacctttataaaaccatcagatctcatgagacttattcactgtcatgagaacagcatgggaaagacctgccccccgtgattcagttacctcccaccaggtttttcccatgacacgtggggattattggagctacagctcaagatgagatttgggaggggacacagtcaaaccatatcacaggccaaactaaactaggtttattctgaatgtgtccgtgtgctaaagaaattattgcaaaaaccaggtgtggtacaaccagagagagggaaggcattgtcatcaatagagacacatggaagactctcaagggtacttggctgtactctctttcttgacattagtggtggtgatgtgagtattcactttataatcactaattataaatagagtaatagtagacacttaactgtgcgtatctattttatgtacctttgtacatttatgtcttatgtacttttctgtaattaaatctggaaactacaaaggtataatatgtcgattgctacttctgctaatatgaacactatccatgatggactagctttgtaaatgtgtgtgcacatgtgtgcttggtactgatttcaatgtaagcatgttgtaaatctcatatagtggggcactttggctgtaaaactttaagatttggacttgcaatgatgacctaaaaattttactattttgaacgttttctaatattttcattatttggccaaacttgggattttagaacataaacagacatggagtcccaaaagacattctaggacgcataataagtaaaaagattttctttggccaccataaatagaatttcccttttacacaaacaaaattcacactatgataacttttgacctttcatgaagaaatcaccacatcttgtcaaaataatttatgactatagaagtaatgtgtactccttactgaaaatcaggatctttcatttttctttttgcttttagatatggaataaatatgtggcacctctgttaaaaagcaacactatttcatctcccttgagatgcactgcgtgaaaaaatgcaaagaacattgtgcaggtgatagatagtgaccgtattgtgtggctgtcttccttttagaagagagccacataatatctttcatacatccctatattccaccttttttttttttacttaaattatatatatttacaaatcggaataatagtggttaagatcatggactttggagttagatggttccagatgcagcactggccttcaacaggcaaccagcctctctctgagtgtcagtttccctttgagggaatgtcagtttcaccgtggcactgggagagggcatggatatgggtttactaatatcctccaagtatttgcagaattgggtgaataacgtagtaaagcacagtgcctggacatagtgagaactataggattgttagctactttgatgatccctctctctctctctctctctctctctctctctctctctctctccttcctcctcctcttctccccctccctctctcccttcctccctttagatgaaaggagggctgtccattcatttattcagtgttttaaattaaaaatgagctgtcagttaaaatggacaggattaagttctcagataaagtgagatggttatattcatagggcttgtctcaaacacctaaggtaaaggcaaggtgcaccaggaggtgtcacctggataataagaagtgccatctttcactgtgaaggatagaggctcatccacctaggggaggacttcgggacaccatggcatgttttttcacagagaccctactttccagcagaaggtaggaggccaccccgaagcagcacctgggtgagctctcccagcaatgccagcatccctggtggtcttcctgtgccactgcagcatgcaggtagcctttggtgcagcagactgtaaggcaggatccgttttctcttagcagcagtctatagaagagaagaatgtggaggtcatgctagtaggagtcactctgttttcaaccaacatggacagtcctgctaatgagattgctcccgcaaagctccctaagatagagatagcgatttcagaccctgaggcgttgttcctgacttgtcctgatgttcactgtcagccggtaactcctgggacctcgtaaagtgatcacctagcaacaactcttagcataaacttccctttaaagttctcatgttcagacacatttatcacgtctgcaatcaggatggataaaacagagttggtacccaaagatgagctgaggcttaggaggccctctgagcagaggagaagtcatcatcttatgcttcattatagatgaagcgtttctgttttcctctgcttcctctggctctgccgagagggagagaaacctcagagcagtcttagggttgtttgtccctttaaaatcttctttggagaaagtggatggagaaatctcaagcagttggtagatgtcaggaggtcagttctcatcaagaatgccccaaagcccagtcctcattaatcagtttatagagtactatggaagcattttaagcacaaggtgttgtttctgagccagtaattctctttccactcaacactgaaagtccactgcttgctttcctggtacatcaagacagccaaatagtgtcaataatttttcctcatagtttttcaaaagccaagtggagggcacagtgaactttgcaacacttgttgcatctgtgggaaagggggctctgggtcattgcttggtgattatgctcactcagggttccagaaaatactgtagctcatgggagtctgatctttccacgcatctctggtccccaccgtgacttgtcaagatacctatgtggttacacgcccaacccaccagcttcaggacccaccaggccccttgtcagaccttgtcctgcctcttcacagtcctcagaacgttccaagcttgttcttatttctgggccttgggctgggatgccccctccccagcaggtaccctacatccagaagcactttgttccattgtcctcgattattttgctgtaacttctcatgcatccattttggaaggagaaagggctttggtgtcggggccatcaaagtttaaatcgcaggatggccatttacctgctatgtgacctcaggtgggtcactgaatgtctctgatccataatttcctttttgtcaaagagggttaagaatatcttctccacagggctcatgtgaggatgaaacaagaaatgatggcaaagacctcgcacagggaagtacagtgtcaggctcgtgactactcttacccctccctccctcgtcctggttattccttgagacaagggattatgacctaattcttctgtagcctctagagtgtggaggctacagttgacacacacgaattctttctgctggagagaacatatttatttgcagaaagaggaaagacatataggagttattctatcatcaataacatttttctgtcctatctcaaaatataattttggttaattttgccctctggagaacagcattataaagcctgtttagatcaatttatgacagtcaaatatttcgtttgttttgtgattcaatgggtagacaagcagggccacttcttgtattcccagccgctcctggatgttggttctttcttctaggttttcagtctgttgagtttccagtcatctttcccagtgaagcatctttctcatctgggcttcacgcttgagggtaccatgctcatcctcttgagaagcgggcatcagggctttgacacagatgcttcctgggttacagctgcttttgcaagcagtagcagttccttccaagtccctgaaggcaccgcactgctccgcagtcctcacctttgttctaccttcacccttggcgcccacctgctgccaagacaagtcacttccttgatccagcctttgagacataggccccttccccactgatcacgtgaacttacccactccctttctgaaaccttgcattttttttaacctgcacagattttcccttaacacctctaattcttgcttatgcctgctggtctctgtttcccctgattatattaggaatgtgactagctgaaacatgctactgggtccaattcctgaatcccagtgcctggttcattttcaccacaacatggtggcctacaggggatctgtggcaaccctgcggctgtttcactctggggcactgtcacactcagatagaaactgactatcatccacccttcagctgctgagactggcagaaaatgctctttgctgactttaagttgcaggctagatgggtaggtgactttagtcataggtgcaggactcctgctatgtgccaagcaccgtgccaggaatttacacagacattgtctcatttcctcatccaccaagggagggatgatgaaaccttccatacaggtatctccttaggacccaaggaaataatatgtatcatagtgcattacatgtgacaattggagtagatcgttgtttaagtatttcatgtaaaagtatgtattcatagaacatctagtatgatccaagacctgtgataaatctacctgagttcaaagatacttgttgtaattaaaacaggcaaatcaaaacagatacatttcatgcttgtttaaagaaaatgctgtaaacagaaaattaaaacaagcacttagcaacacatcaggcacagggaccatatgaaaagtgtcaaaatgtctcagcattgtgcccagtttgagactggcactgtcgcctagtgaccgggtaaccctccctgttttctgctttcctaggtatgcgccaggggaacgaccatggcactcagtaccgctcggccatctacccgacctctgccaagcaaatggaggcagccctgagctccaaagagaactaccaaaaggtagggattgctgggctcctagcccctggcttaggccaccatgactagggccaggttctgattttagagggcagtctgctgcttttcaactggaattgtgttttatttgcacatctcttagaaatttctgtcagcctctaggagtggagccattgtgtctaatacgtgtgctaaatgaggttttaagagtaggcctgggccagggccagtggctcatgcctgtaatcccagtactttggggggccgaagcagaaggatacttgaggccaggagttcgagaccagcctgggcaacatgaagaaaccccatctctacaaaaaatacaaaaataagccaggcatggtggcctgcacctacagtcccagctacctgggagggtgaggtgggagtatcgtttgaacctgggaggtcaaggctgcagtgacctgtgattgcaccactgcacttcagcctgggtgacagagcaagaccctgtctcaatgtaaaaaaataaagagtaggcccttatgtgtttgcctttgaatcactcatctagatgaagacacagcctgttaaaataagtctttttccttctctctttatttctgtctctgtctgaaactctctctttttttcttccctctgtattagttttacagggctattgtaacaaacagtcacagcctggttagtttaaacagcagatatttattttctcacaattctggaggctggaagtccaagatcaaggtgtcggcagggctggttccttctgagtgctgtgagggaagggaaggatctgttccaggcctctctccttggcttctagatggctgtcttctccatgtttatattcacatcagcctagttttatgtgcgtgtgtttctttgtccaagcttcttgtttttaaacagtctctagtcatattggcttagtgctaaccctcatgacctcgtttaacttaattacctctgtaaagacccgttctccaaggaaggtcacattccgaggttttaggactccaacatatcatttggagggagacacgattcaacccgtaacactttctcataacagtaaattgaattatgataaaagtagttctcggaaatatatacatgatatcacaaaataattattttcagagttgtgtacccttttttaaaatcctccaatagagatttagttgttttaaaaacaagttgacttgctttagtttttagaactttgtgatagtacttgtattttatttatcattatattttctgatgtggatttgcatttgacagtagagctagaagctactataaagctaatctatgttagaattatgtaaaaagtcaggtatgcaacagcccccaggaatgagtgcagagacgaggaggctgtaactagagtgtccactggtgagcaagtagaaggacgggtgactcaaggtcagttcgactatgatgagcggagaggcctgagggaggcgctgacagagcccattccttccttggcccctcccacctccctcccagggtgatgtctgcttggctggtcatggtaggcagcctgtgggatggcccccagtgctctctgcccatatgtaattcatctccttgaatatgggctgcatttagcaactcacttctaatgaatgacagcagtgatgggagcactctgagactaggtcattaaaagattgtggctcgtattgtgaaaactctctgttaccgcgtgagagatggtaggggaagccagttgccacgtcatgaagcagccctgtgcagaggcttacatgacaaggacaaaagcctgccaagaactatgtgagtgagcttcgaatcccctcaaccccagtcaagccttcagatgagactgcagccctgcctgacagtttgattacagcgtcatgaaggacttcaagccagaggcacacagccaagctgtgccacagaagctgtgagataataaatgtatatactttgaagctgctaagttttagagtaatttaagtatacttgtatttccattctaaaaaccttttacctatatattctttctcttatccctttttcgtaatggcttttgtaacagtggtgggctaacctgggcatttatggtggtggttacacatgcagtctctagcatgaaattttctcaattcacatgtcatctgtgcagtttattatcaagtacctgccacttagaaagccataagttctatttgactcaagcagacctatgaggatgagggagaccccattatccccattttccagatgctcaaagacagagagcaatgaccttagaataaatgaaattaaagagaagtaagactggatgcagggagatgagttgggcagctattataggattccgggccagaagtaatggaagctttgtctaggatggtggaagtatgggtgggagggagggatatttaggaagtacaaagaccagaacttggaacttcactggaagtggagagtcaataagagggacaggtccaggtccaggtcatggctggtgattttttgtacaagtgtacagagaagcagaggcagatttgtggggaaggtaagttaagttgtgaaagtgcagagtctaaggtgcccatgacatgggcatccaaggggctgtttggaggagccatgggctgtttctgccttgcagggaggattgttaggactgctaactgggctaatgcttgtgaaacacagggcctagcacatggtaaatacctcataaacaggaacccttattattattgggagttgtcaacttatatttgctaaatgaaaccccagttgctgataagattacttgggaaaagtaatgagataaaagcagaagaggcagggcacagtgactcacgcctctaatcccagcactttgggaggctgaagtgggcggatcatgaggtcaggagttcgagaccagcctgactaacatggtgaaactcggtctctactaaaaatacaaaaattagccaggcgtggttacacgcacctgtaatccgagctactgaggaggctgaggcaggagaaatgcttgaacccaggaagcaaaggttgcactgagctgagattgcattactaaactccagcctgggcaacagagtgagactccatctcaaaaaaaaaaaaaaaaaaaaatgcagaagagagggcttagtacccgaggaactgattcctccacttgagcggtgggaggggaactgtccaaccaggcaggacactacactgggcaccacaggaaccaaccccaaccaagaacttaaaaagtggttcaattgtttcatcccactgtatttaattataaaggcagtatttataactactactaaaagtcacatatgataatgccatctataaactcccttatgtaatgattcgtagttctctagggtaccaagagtaataccaagcgactctggaagcatattaactgccctccagaatactgaaatatgatgatatcctggtgtttgcaatgaagattttcagttcaaggccagtgccttccgtgtgatggtgaagaggcttatcaccgaattttccagtttctatgccattgtagtttctaccctcagttttgaggggaacccacgttgattttagataaatgatatccataggaggtaaaatttaggtattatataattaattaatgagctgctataattatcctttcattatttttgtagtttttgtagaggttaatcttgtaggcagttgtgctgaccagatgttttctgggtgttctgaacccaagcacatgggaattaaatacgtgtgtgtgtgtgtgtgtgtgtgtgtgtgtgtgtgtgtgtgtctgtgtctgtctgtctgcatgtctgcatgtctatgtgtctgtttggcttttaaaagtagggtctattttttaaataaagattgggactcctgtgcctttagtatcccgatagccattgctgctcacattactgcatataaactgcttaatcaccaactcaggggacaaatgctgtcatatctcttttatggttttgcataaataaaactgaccctagattccactgggagatgagttgaaagttcagtgttttcgtaccagctaattgactgaaacccagagtttcagactagaccagtgcttcctttcagcaccactcgcctttccgccatgatgctgtggtctcttttgcactgtccagtggagggcctctggccacatgtggctgttgagcacttgaaatagtggctcactggctcagttcctcagtggctagtgtgactgaggaactgaatcttttaattaatttacatttatatttaagtggccacatgtggctggtggctaccatttagagagcatagcagttcattaaggggtgagcttgtgcgtgtgtttgcatgcccatgtgcattgtagaggggtggagcatgtcagtctggatccctggccctctgctctcactatggcttatcccaagagcgggacggccatggaacatgggacggccatggaacgtgggttcctgcccatcagagtgctgcaccgggagctgctctcaccttttcctgcctggagaccacagcatgagggtcaagttttttccttttcaggaaccaaagtgtctctttgtgtaccccatcctggtgagcaatagagctaagtggacatccatgcctaggtgaccactgtgatttttatcttagcttagcttagcctgggtcccacagaaagcagagcccaagccagaggcttgtgtgtgaggattcactgagatgtgtggttccagggagcaggaataaggggcagagagactggggaggaaaagaaggaagaccccatacaagttagcccctgccactggtaactggttgtttgagatttatgaaatgactaggcattcgggagaagatgaggaagcatgtttccattgaatgccatcagtcataggttgattctgcacttctgagctgcacgtgtgtgagctcagggtactgtgtgccagggcaggaggcaagagacaagaggcacatggcgttgagtgtaagattgggcaatgcaggtgcataaaagctgcacaaagtgaatgggggcccttgcagaactgggtactgtggctggcctagcaagaggcagatggggccacagggatctaaagtgatgcattagtgtcctctgggtccactgtctccaaagggtccttctcactccgatccagggaaggcagctgactgcaatggctcaggaatgatttgccacgatggagtgactttctggcacctctgatagaggtgagaaagaaaaacacagttcaattttagcagagtgcatcctgctgcagtcatatggtgatataatatgtacttttatataggttatataccataattatgtataatacgtatatctatataatatatagctatataataataatagtaatactgttagaacagcaacaacagtaccaacagagtacttactaaatgctaatcaagcagttttaagtcatgtatagatcttaggtgtttatctgtatacatatatttgtttagctgtagatgtgtatctctctatgtctttatataaagttaaatgcattcatgtatttatgaggcccttttaagttttgaaacttgaatgaatttctgactgtttattcagttgatataactgataatacaaacattgcaaaatcagcaatttgcaatgcctgtgagaggtgatgttatcagctttgataccgtaaagaggttgatcagtgctttagcctttaccttaaaaagttatgtggtttctaatacattcacaaaatggggaaaattgccgatctaaccaactgctttattcactgagggaaggagagcagggagctgaagaggtgacccccggactgggctttcctgtgttttatatctagggtaagcttgaacaagctcctgaaaccacagaggtgtttaaggtagggagggtcatttcttaacactcctcgattatggtctagaactctgtactgtagtcagaaacatttagtttgatttctaaaagtggggaaattctgcccatgactcattctgttcattttacatacactgctttcctcttcagaaggcttggtgtttctggccccatcactacattcgggacatttgtcttctttgagcgctgctgggacccctatacactaactgtaatgttgacttaggttactaatttaatagtcttcttcactagcctgctcccagtgaccccctagtacccagcttcttcagcagcttctttatatgtgaagtttggagtgacagtattgcttaccacagagcagccatttgaacataaaattagctgattttatcacagggaccaattgttgagctaattagatgtgcagtactgctgaggagccagaaaccaaaagtgattttccattgaaactgtggttttctgcaaagttggctgggttgtggataccagcctcaccagcgactgtcagagttttggctgaagaagtttgctcatttctaatcagattaaaagaggcaggaaagacttaaggaggaggatggagtcttaaggagtgaaacttgaacttcacgctgggtttgctgaccttgaacatgctggattctgcttacagaatttgacagctgcttcatatctttggtgagcaaccctaaccctaatacaactttgcataaaatggaggggggtgtttttgccttcaaggagaagacttgataatcttttcttagcctcattaaaaaaaaaattttcctcaaatctttggtggaattatttgcttatagcactaattgcaagacatcatctaatgtattattgtttttggattgtcaaatatggacaatttatctcccaagtgagcccatcatgagaaacatttcccagtatcctaaactgaatgtggcctccggtagagtgagggtggttcacgtgtaattcttccatcctgagaatgtgactccagctcatttaggaattaaatcttttcccactgagaaattatgtttcttgaaatgtgaaagacagcaaatctaaagagcattctcctggccatatgacctggctccttctgccagctcttcaagtcttcaagaaagcacaatgctttctctgggtatttctctcgcgaaaaagagagaagaaaagcagcgttttcctttgtatatattttacaatatattaagttctaataaggataaaatgtttctggagtcattgttaaattacccactgtgtttcaaatataaaacagtgttttaaaggctgtatctatccgtctctcagtgtttgtccacccttccatccatccacccacctgtccctatcatcagtatatagctacaatctttaaatatttgccataattttatcttaaacttcaactatctagcaatttattatctctcatctctgcgtttgtttataattaatacagggtcattttaaagaaaagttcccaaagtgaaaggtaaaaaaacagtatgcatgtacaaatgggttccagctagcattttcaaaaataaaggttcagttttgattatttaattttcttcctgcttagattgcagccagatatttagtgactccctaagctcttcagttaagccctgacaaattgtggtttgactggtgtgtgtgttttgttgcggggaggcggggaggaagaagacagtgtcactaccaaataacctacttggctgggcacggtggctcacgcctgtaatcccagcactttgggaagccaaggcaggtggatcataaggtcaggacatcgagactatcctggctaacaaggtgaaaccccgtctctactaaaaatacaaaaagttagtcaggcgtggtggtgggcgcctgtagtcccagctactcatgaggctgaggcaggagaatggcgtgaacctgggaggcggagcttgcagtgagctgagattgcgccactgcactccagcctgggctccgtctcaacaactagaacaacaacaacaacaacaaaaaaacctactcacctgcgctaccaatgcagtcattgctgcttttctttagcatagtttgaataccatctctatggtaattttttttttttttttttttttttttagtatcagtgacactctgagtgtaaatgacactcaaatttagggtctagaactaccctctggactccagatccccataacaaactgtctacttgttatcgccacttgtgtgtcaacgtaatgctttctaaaatgaaagtttgattattgccaccccctgtaaacaagtcccatggcttcctcctccctcctccctcccccctccccactcattgacacccttccccatcgggtcatcatttaacttgcctaactaagcaagatcctcagaagtcatccctgcctcatgcctttccctcgccttttccctccaatgaatcagattaacagattctacctccaaaagacatccccactgtgctcgcttctttcattttctctcacgttcactctcatgatttaagccaccattatctgttcctggacaactgaacttcttacctctccatgattatgaccacccgcacaggcagcagagtgatattcctcagtgtacctcgggtcatttcccttccctgtgtcagcatcttccacggcatctctactgtatgtggaatgaaatctgaactcctttgcatggtctaccaggtccttcaaagtcatgtcaccatcttcccatgagacatctgtaacttctaatcagagagcctaattatcacagtatatctaagatgtagcctataattcttaaagttcagaacctttgaataaggctcaagaactttccagagaactggggactcactatgagaaccacagggactcaggaaatcttactgttgtgcagtgaacctcataaaggatggttttatacttctttgtatttcaaagttgatcccttcatggactcactgttgccacagagagaccaaattcagaggctgtggacatgctgcctggttgaggctatgctgtatattaaaaggaaggattaaccatcttgttcttgaccctaaaccctatcctgcaaactctcttgacaccgaagttgctattatgatcgtacaacattatttggtaggattaagtcagtgggtgatagatgaaactgccttcctctcactactttgccaaatctctgacttttttgtccctgtgttaatatcctatagctactataacaaattaccacaaactggatggcttaaaagcaacagggatttattctctcatggttccagagggcagaagcccaaagtcaatttccctggacccaaatcagggtactagctgggctctgctcccccaggggctccagggaagaatccctccccggatcttccagcgtctggtgggtgccaccatgcatggcctgtggctgcatcactcaagtctctgcctctgtggccacctgcctcatcctcttctgggcatctgatctcgtcctgcatctctctaataaggacactgacagttgcatttagggcccacccaaacaatcaagaatactcccgcatctcaaccccccttatttagttacatctgtgaaatctgtgccatataaaataacattcacaggttttaggggattggaacatggacattttggggagaccatttttcagatgaccacaggccccataatctggtctccaacctgccagtgtcatgtgtccaccccaaaatgggagactgaaactgggggctcttcctcgggctgcttaggagaggtgggcgttgttcactaggtgggagcgcatctggcttgccctgaaccccagaacacactcaggtttcccagcgagatgggatttgatttcctctctcgggggtctttatctagttttgaagagaggtgaaaatttgcaaaagtttatcccctttcatacatctctaccttcaaaacagacccaattttactgctatactacttctgaaataaagtggcataccaaaaataacagtagaaaaaaataaatcctaagagctagaaggatatttgggagagaaaaaaatgtgtgtgtgtgtgtgtgtgtgtgtgtgtgtgtgatcaaaaagcatttggatgtttggcaagagtggtctagcactctcttagtcacttactctctttgagccctgacttaatttgctctgataccaatttttaaatgatctaagtgtggataacaaaatttcccaataggttcattataagaattaaatgtgatacacacacacacacacacacacacacacaagctggcatgcagtagtgacccaatatacattattgaagctgagccccttcagttttatgatccagaaaatagttttaattataccaacccaaatgagagaaattaaatatactcaatgaatatttagccatgctataaccatgataatataactgaaccagataattccccagcaagaggtatatacagatcctttgtgttttcttttcaacatctataggctgaaaatggctttttctccttattctcccgtcccatgttcctcagtaaattaattaccttatcaaatattaattatgtacagattcattgccagacttgcattacagttgctttaaacaaagctatctgaggcaaagtcttgtgaagtttgtggtaataaactgtcccacatacagtcacagaagctcacatgtgacaaatgctcttttctgcagagaatctcctaggaactcgtctcccattttctacattaagtaagcttataggaggcttccattcacctgtgtgtccccagtgcctggtgctgtgcttggtacctagtgattgtcaacaaatatctgttgacctgaactgaagtgatacagcatataaagaagcccgttttgttgccccttgttatggaccgaatatctgtgtccccccaaattcatatgttgaagcctctacccccagtgtgatggtgtttggacatggggcctttgggaggtgatcagggttagatgaggtcctgagctggagctcccgtgatgggactgctgtccttatacgaagagacaccagggagcaggctcttgagcactctattgctgtgtttcttgctgcacacagaagtcatgtgaacacaaatagaactgcctgcaagccctgagaagaggacttggaataaacctaccttgccagaaccttgatcttggacttctcagcccccagaactgtaagaaatagaagcctgttattgaagccacgtagtctgttactttgttatggcagcccgagctgacaagagagccctgttttgtgtgctgcactccatggagcgggggcagagcactggcttggaggagaacaactggctggagccctggctctgcctgtagtgaccgtgaccttggagaggtctctatggcccattcttcttttgtaaaatggggaaattaagaacagtggaatgttgtacggcttttcggtgctttctcctgtattttgctgggtaaacttcacagtcacacacaggctagggcaggatctgttctctgacttgcctatgaggaaactgaagctcagaagtgttcattcacattcccaacatgacccccatagtaaatgtagagagctagagtcatttgacactgaattccataagcttttcacccatgctgtgtggcgatacatgctaatctgtcaggcattttacgaatacagtcatccttcggtatccaatggggattgcttccaggaccctctgaagataccaaaatctgatgatgcttaatcccttatataaaatgacatttacatataacctatgcacatcctcttgtgtactttaaataatctctagattacttatacctaatacaatgcacatactattaatatattaaaatagttatgctgtattcttaaaatttgtattgttgtattgtttttattcatttatttataataattttgatctgtggttggatgaatccaagcacgcagaatgcaaggatacggagggccgactgtatcagggtttaatgggtgactgcagaggtaaggctgtctacagtgacttcatcctgcctttctagagatcctcaaatttccaaccatagttacaatataggatcagcatatcttcctttctgtcatgaattgagaaaatgtcatggttatctgtttctttgttcccagggaaatgggtaagttgcatgctagaagcatcccttctcggtctgttgtattctctatgctgcaatgtttaaaacccatctgagtaccgaaagactgttgttttcaccaacactgaaacatcatttatttgcattggaaaaccctaaatagacatgggtaaatgtcagttgatatgttatggtttggggattacatagctcttcgtctttaaaaaattttttttatctgtgcttttgtttaaagcatgaagttatgatttaaaatgcccatggaaaaaccctgaataattcattgacttaccttagtcaaaaagaaaaatcccccctccccaccgtatgcctagcaatagggataaaattcttcttagtccctttctgtagctttgaggttaaaattatgggtgttattatgaactctaaataagaacctgtgaaataaatattttaaaagtgcccatttctgggaggcaggcacccatatttctgtgtatgcagccacgtagacagctagatcttaggcataatggtttagttgcatgtgggtgattattttcatttccacttattactgtgtgctagactccctgtgtatgagtacagattgccctttcttgcactgtatttagaaatctctgtattacccttgggcatttgttcattaatagggggtggggaaaggaaaagcttgtaataatgggctttacatattaaactgtgtgcatccgcatttgggccaaatggaaaatctggtttgtatgactgccctctgctggctgtaggcctttgctgcagtggcaggatatgagtccctgggtggagcccctgtgcagatgccggtatcagtcttttattcacttgcactgagttccatccaagtacatcagaaacagcctaagattctacctactgcccaggttgatggtggaagacagcattcttgtgaggatcaaggagacattttgattttagtagaagtacagtagaagtatagacacaaaataatcctggccaacatagggtgatgtttgaatgaatgaattcacatttctccacgggccacactcctactcatctttcagtggcaacaggggaatgtttagtggctcccatatgtgatgtccagaccccttgtggaatgcaagatgattttacggtgtatccagatgaatcttttaaatctcagttatgtgtttataatatatattaagaaaactgcagtgaatgtttgaagcccacaatttcctgaaggtgatggctgaggtgaagagcaggaaatggaacctacacacacagctgcattccttgcagagatgcctcttccgcaagtctttgggcggagaaaaaccacagggaggtccccgatgacttgggcagcagtggctctgtacttgctttgtgtatgaccttgggttgttgacctgtctaagcctaggttttcttatttgctaaacaggataatagtggctacttcttaggcagttataaggatgatatggtgtatatgtaaagtgtctgtcacagaacaggggcctgggcaatgccagatgcttctttttcagctccccatcccccaggacgcttctcagagccggcccccctccatgttcgcatcacgcttggcttgcatctcgtttcctctgacccttatgagagttgccacgtttcttctccaccccaccccccccacgctgagtgggaccttcccttgctttgcatctgtggcaacattccatgagcacttcacacaaggcaggcactctgtgaatgtcaggtgaattaaacccaagtgcaaaatacttgtaagcagcattttcccattctccaacacattcagagaatttcacctatcagattaggacagggcctatacgtttttctccccctacccgccattcgtgtggtctgataacagcagcagcattaagttcccgtccattggctgcaagcagggaggaaaaaaggccccagcgcctactgcctgctttcctgcctgcgttaatatcatctcttatcttaccaactaacatataggggtgtgtgtgtgtgtgtgtatttatgtgtgtgtgtgtgtgtgtgtgtgtctgggtatatatacacacacatttatattcgttaatttccgtggaaaagaaagggatggcagcagaaacattttaaacacagcatttcagctagggtagggtctactttaaagacaacaaaagggcctttgttgttctggcaggtagatggataagcctggccctggttcagcctctataaagtggctccggagtgataggatcagagaaactaccgggggcgggggggaggtgcagggacgcttttatttctgtggcgccaagagtgaagcagggtttgccgtttcctacaggggcagtgcgtttgcgtttcaaattcccgttgattgtgtcgcagcccgcgtggtcccgagctccccggcctgcgcctgcacggccgcgggacgcccgcttgcatttccgccaccgaggcaatgttcatttaacgcttccagagatcagagctttcatgtttgccacgaaagccagagagccgggagcacctcaggagcggagatgaaaggccatttgtgtttgtgcatgtgtatttagcgcttaaagggcaggaaaaagaaagaaaatagatggtcccgctttgcacttacttcaaaatgtgccttactccctctggtgggaccatttaactccagcgcgccacccctcccccgctctcgccgctcccgtctgccccgctgcctcggcccacgtgatggctgttcgggccccgccgagccatcttcccgttgctatggcagccggcgcggcgagcccgcccattggctgcaagcgaggaggaataaaaggctctcgtgtcctaggtctagtgccctgcgccatggccccgtgcaggtagaggcctgggcatggtgcgttgcaggacgggccgggcgcagggaccgccccccgcaccgtgcgccccacccagctgtccagaaacggtcagggtcaatgtcatcagcttctccatggaatgggaagcaggtgaaggacaaaagcaaggctcataagggaaagtgagccaccttttccttcacccttaacacctcccagctctgttttttttttttttttttttttttgtagtgtttgaatttgaaatccggccctgtgaccctttctactcacagacactgcacgtgaggcctgagcctaagtttagctgtcagattccatttaccttggccatgccccgtggctccaaagccgcgaggacagcactccattgcgacgtctactcccgagcctgaatgtttcgaaaattatcttcgtcttgctgggttcgctgctgaactggggaggcgattggaattaccatctggcctcagagctgcgggtgactcttgtcctgaccccgtggcctagtgaacagatgaccccggcgcctgatcttgtacctggtcaaacaggtgtggagaagtcttggaggggaactgcagctacctgcctcgggctctcttcggctggcgacttgggttccctgctgagtgagaaagagagccagccacacccagagccttcaatccccagagggagggcacccactgcgatttggctgtggttggtcacctgccttccccaacataggaccagtcagcagatttgggagtgcagaaagcactttcacaaacattctctcctctgcttctcataaggagcctgggaggctgtcactctaatcgctgccctccaggagaagcagctggtaacttgagaccacatgatacgtacatgggggagcccaggatgcacactcccgctccctgattccaagctctgtgcatgctctttccattctgtcactgggccaggtagattccctctggacatgtcacaccctcacagatttataaatagggaatgggctctaggaggaagatcgctcctccctttcttctcattccgtatcttgccaatatcacattaaaagaatatgtcactagtgtttaatttgtcaagatcaggggctaatggttgaggattttttgtggttccttctgctggcagaaacacatttgcaaacacaaaatcttttaataaaatagcaagatttagtaagaaagaaaaatactgtgagaaaaaaataggacctgattggaggaacattattatgccagagacacttggttgacttaaacactaatatattatttttatacatattcacacaaagggtgctgtgtggtttcaggaatccacagagcctaacacccaagcacatgtgatagaaaaaaaaaattttaatccttttttttttttcattttcatttctgtttggcttctttacaaagtcgtcattgaaaattgctgtatggttatttttccctcttgtgttacagaccaaactcagtgtctgatgtacagtggaataagtgaggaaagagacaatattgggcaaaccagtgaaattaggctcttgtttacatgagtagcccttactgagattcagctttttgttgctctgtgtagccttttgatgtagattccagagttgtaacttacatgataaattacaagtctgtatttattcatacattagagataggttatttttacctttgtgtgtgtgtatacacatttgcttggaatcggtgaatttctaggccacattgaggcaattgaacgctctttataagcagttaattgtctagacccaacgtttgctgcaaacacagtctggggcaaaatgggaattaacatttttacaaagacaggcatagaaattctaatccagcgaattgtttcctttctctggtagcagggctgagtcctacctggccacaaggctgccattcacctgtgtagcccagaaaacaatggtaaagaccaccagagataagaccagctaatccatgccttgtaatagtcaggtttcgcaattcacatcacctgtctgcaaaggtaaactcacaaacccctcctgagatatgtgtacagtcaaatgggatcactgctgtcgctaggccagcagctctagaagcctatgttacttttttttttttttctgagacggagtctcactctgtcacccaggctggagtgcagtggtgcgatctcggctcactgcaagctccacctcgtgggttcacgccattctcctgcctcagcctcccgagtagctgggactacaggcgcccgccaccacgcctggctaattttttttatttttagtagagacggcatttcactgtgttagccaggatgatctggatctcctgacctcgtgatccaccagcctcggcctcccaaagtgctgggattacaggcgtgagccaccacgcccggccaagcctatgtcgcttttaagatgaatccaaaaagactgtgtgctactaggctacagaaagcagcattaagtctgatatacatcaatccatgttcaagcagattcctctctgtctctggaagttggttaatttttctggtcctgatattggatattgtcacattttccttgatagtgtcatccggtgaatgatttttcatcttgaaccttatactcctcctctctcggcagctggtgcttccctgttcttcctcagccatgctggggctcactgcagcctcctctgctcaactcgcctgggtgcagccatcttcaagaaaacattattaaagcaatattattagtatgcagcaaggtgccttctttctgctaaatcagtttgtaaagtggtcctcacaaatgcacacattctttgttatgacagcagggcttcgtgtttctgatgcaagactaataagacttggaagtagggaggtaaactgggtggcccaggaaagcaggggttaggggagttgatagaagatatgagaaatgaacctaaggggtgatcaaagagcagccaaagaaaaaaatatccttaagtgggagaaaaaggcaaataggacgtgtgaggaattaggcaggagtaggaaagaaaactgtgaaccactgtatgcacacttgtgtgaaagaggaacctaggaaagtgagccccgagaaagcaatactagcagaaagcaaaaggtgctcaagaatcattgtgttgtttatgttgagtgaaataaggcaggcacagaaagaaaaataccgcatgatctcacttatatgtggaatctgaagaagttgaaatcctaaagcagggaatagaaaggccagaggccagggtggagtggggaagggaggaggagttgttggtcaaagggtgcagagtttcagatccacaggaggaatagggtttgagatctgttgcacagcagggtgactgtagtcaataatgtagtgtatatttcagaataactaagagcacatttaacacgtctcaccataaaaaaacaataggtaagtgaagggttggctttgctaactggcttcatttgattattctacattgtatgcatatattaaaacatcatgcactccataaagatatacagttaggatttgtcaatcaaaaataataataaaaaatttaaagaagaattgtatagaaagaaaaacctttcaggattgagaaaactctgtgaagaagtcacatagaaattctccaagaagtgccacctgtgtactgaaagcccctttaatggacttttgtggtgctttggtgattcatacaacttcagacaaataatttcctaacctgcaaaactgagctagcaacccttgccctgatcactctctttgggggtgtttttgaggctctagggagctgatgtgcgggcaaaggttataatccagaaaatgctctacaaatttaagtaaggttttggcagaattgggttgtggggagcaagtgccaggcaagtttccagtccttgccaaactgcattttctaagtgatgaaagatctggcattttattcttttccattttttaattcactgggtttgttcccttgttcttatgaaccttgactgcagagataagttgacagtggctgacagatgaaaattttcattgatctcctctctggtccctgcctttcctagccccttggctttggaatgaaaactgtaagtcagggacacccacgaagcgatgatgttggagttgcagtttgtaaaactcttacgttaccatctctttatctgagcatggagacaggccctttctgtaacttttctggctaaataacttttcttcagaaggcaactcatgtttgaaattagacttgaccttgtttcatgagtttccaaaacttatgattcaggtccacattggctgcttttgaattggatctatttagatgtcaacatgtacagcacaagtacaatgaattcagtgtctgtcctgttcttcgtggtcaggatttttgtgtttgttttattccctgttaagcaaggggttttctttctttctttttttttttttttttttttattcctctgagacggaatctcgttctgtcgcccaggctggagtgcagtgatgcgatcttggctcactgcaagctccgcctcccaggttcacgccattctcctgcctcagcctcccgactaggtggggctacaggtgcctgccaccacgcccggctaattttttgtatttttagtagagatggggtttcaccgtgttagccaggctggtctcaatctcctgacctcgtgatccccccgcctcggcctcccaaaatgctgggattacaggcgtgagccaccacgcccggcagcaaggggttttcaatacaggctgtctgatgactaacgagagggaacataaggaccctatggtctgcccttctaggctgttctcaggccctaccccacccaggcctctgctctccctcttcttaaaatcttcatggatccccaaggcagctgccctagctgccttgtgtgtgtctacaatgatagagctatcagcactgccatttcctggcccgtgtggtatgagaatatgagtagccaataatgctgtcacagcctgggaaagagacggcaaaggggaagaggcagccgcttgagaccacggagccacagccgcccattcccagcagagctcggagaccacagtgacacacctgcccattcccagcagagcttggtgccattctcaggtctcccaagctgaccccaggtgtccgtgcttttatgggttaataccaccagggtattgaagtagattttgacaatcaaaaaaaaaatgtatatccgaattccacgtatggtggcaagtctatgggccatcaaattaggagttattatctatctatctatctgagacaaagttttcctctgtcacccaggctggagtgcagtggcgtgatcttggctcactgcaaccttcgcctcccgggttcaagtgattctcgtccttcagcctccagaatagctgggattataggcatgtgccaccacgcccagctagtttttgtatttttggtagagacagggcctcgccatgttggccaggcttgttttgagttcctggcctcaagtgatccgcctgcctcagcctcccaaagtgctgggattccaggcatgagccactgtgtcccgccagattggaagttattatacccactttataaagtggcgaggatggcatgttttgattcaattcaaaaggtatttaccaagtacctccgtattcaagggaggggatgtggaagcaacctatatacaaacttaaaacctgcaaaggcatcagcaaagagcatctcacatcagcttctctgttcacttggtccctacttgtcttcacagaaagaacagttcttgtgtggtaatcaaaatggtatttctttgagaaaaaagatgcccctgataagaaagacaacaaatactttgatgtggaaacagcctccaacatgaagtaagatttccaactgatcagatccttaatttagatgtcaagtgagaggttgactatttgtagggctctgtggattccagactcccactcagacctactgaattagggtccttaggggtggggccaggaaatatgaaatgtttaaaactcctgtattaggcagttctcgcgttgccataaatacctgagactgagtaatttataaagaaaagagatttaattggctcatgattctgcaggctttacaggaagcctgctggcatctgctcggctcctagggaggcctcaggaagtttctgatcatggaggaaggtgaagggggaacaggcacatcacatggtgaaagcaggagcaagggagagagagttggggggaggtgccacacgttttgaaagaccagatctcctgtgcacttagagtgaaagccgacttatcaccaaagaatggtccaagccattcatgaagcatctgccttcatgatccaaacaccttccactaggccccacctccaggactggagatgacatttcaacatgagatttgggcagggacatatatttaaaccatatcaactctctaagtgattttcatacagcgctgggcttggacatctcaaggtagtggattagtacttagtcttgggcatcagacaaacttaggtacctgtttgagcctggataggtaacttaacctctcagcctgtttcctaatctataaaatgtagctaatcatatgaacctcggaggttgatggtgtgacgtaagtgagatgacatgtgccaagctcccgactcgcaatgttctgtctgcagctgtatccgcaatgggcatgaatgggcagatgatttgcccaaggcgtgtgaacattaaacagtcagctgttgatgaggaaggcatggctcgggacagtgccagctaagatacatctagaaccccattttccatcagtgcatttcctcctgtgacataagctgtgcctcttgtgtgctaggctcccagcccaaggttaggggctttggggaagcttaactgtgaggtcctcatctaggagcgtctttccactgccgtctaagctgtgtgtgtcagctgggttcaaagagttaaaaatatctggttagtaatcagctgtgcaaaagcaacacttttcattcttaagttctgttcttcagtgtgttgagatttttccgctcatttgtttccatgggtctcacaagcatggccttgagcagcagttctcagactttttgacctcgggacctctttgcacccaaaaattattgaggaccccaatgagcttttgtttgatatttaccagattaaaaattaaaactgagaaattaaaaaaacccgaacacacattcattccatcagccatcgagtgttgatgtcatcacactccgtgtagcttccagaaaacttcacctgcacccatgagagaataagagtgaacagggaaatatatcttagcatgatgataagaataattttgaccttgtggatcctggaaaagattctggagttccccgggggcctctgagccgcacggaactgctgatcttgattgcacaggttacccaaccctgttcgtctgcctcacagagaagcacagaagtcaaatctgaggccgttgtatcactgagcagcacagctggggcagggtcttagggaaggcctccgagtccagcgcagttccctggccttacagacgaggaacctgagccccaaagaggtaaagcaatgctcccaagctcacacagcgtgggtgccaagctcagttaataacccagagcttctgcccagtgggcttgcccctgcatcccagttgagtgacttagggaccaggctccggtgaaagacagcttggttccaatcccagctctgccactgtgtgacttcgggcaagtgtcttaacttctctggcctgagcgttctcatacataaaatgtgaataataaaaaatagctgcttcataggcttgctgggaaaattaaatgagataacgtgtggaaaggaactggcatcttgcataagcattacacacacacacacacacacacacacacacacacattttagcttcccagctaattcttagagggatacatttgtaatattttagcagtcactacttctagaaatcatgaccagcttttctccatctcttggtctcaattgttccttttcccagcaaccttcaggcttgctcagcagcatcgcaggggaaagggattccagaatccatggtgagaacaccgtctctatctgccttcacaacagactgaaggcagagctaagatcggatgtaattagtttacatgtcagacccaacaatccatgctgtacgtcatgcaggagtgatcagtgttttcagggtggaatgcaatctcataatgaagcggtgaatagtattattgcagttgaataacctgcagcatgatgtatggtgattagaatttgtttctggcatatggttttctttttcttgtttttcccccaaagtggaatgtctgcttctgtagcaccgtccatttgcaaactgcgttccccaaccactctttaattgtctcctacatcagttcatgggagagcttagtgagggtaggtaacccagtgctccttattcaacaaatgtaaatgtagcgctttacatttgtaaagggtgctggggggtccctggtgacctgcacacacaagtcaatagatttctgctgaaaaaattttaatattaaaacatcatacataaatttgaagacttcatatgcaaacagcaacaaaaccaaaaaataacaaaggacagagattttaaaataatctcttataaataactagttttatctacccaaccaaataaaataatcagcactccgtatgctacctcagatcctgttcagacatatgtgggtatcaataatgaatgaatcaattgattcatcctcagtcttgctgagtgtctttctgggagataccacttgtggctcttgtttacccaaagatcactttgaagatagaacattctatagtcccagatagcatcttcttgcctggaactgacataagatccatatctctaagccacaggactggagcttctccctcttgctaaggaagttgcatgtatcacccaaaagatactggctttgaggtgagaagacctggattctcatatcgtcctttgtactaacagcagtgtgatcgaggcaagtgccttgactctctggtcttccttcaccccatctgtacggtgatctctcagcagctgttcacctctaatggtggactatagagtggtggctgaatccctccaccatcaggcaatcaaagccagccatttccaccgaggcaggtggatcacaaggtcaggagttgaagaccagcctggccaagatggtgaaaccccgtctctactaaaaatacaaaaattagacaggcgtggtggtgggctcctgaagtcccagctactggggaggctgaggcaggagaatcgcttgaacctgggaggcggagattgcatcaatccgagattgcgccactgacactccagcctgggtgacagagggagactccgtctcaaaaaaaaaaaaaaaaaaaaaaaaaaagccagccatttccaatggccttgacataaggattatgttgcattaagtaaggatcattaaggatctgaatgagctaactaccatgagtttgaatgaatctagagcttgatctcaggtttgcatgtcagggatagcttcgttcaccaacacattctccattactgtgtgaggtggtgtacaagacctcaggttcactcttgggcctgggaatgactacagtggacatatttattcttccttagtgtgtcaggtgtctatcacagcataacaaactaccccaatcatggtggtttaagacaaaaataattgttcttgtgattctgtgggttggctgcattgttctgtcgattttgcctggactcattcatgggacagcattcggtttggcgggtcacctggaggcagggctcagttgggaagatggggctgtctggatctctctctctttccatggtctttccccctcaaggttagcctggcctgggttggctctagagatggtgacgccatgctgaaccccaattccaagagcttatcaagcctctgcttcctatgctgatgttccttggctaaaacaagtcatatgttcaagcccaaagttaatgtgaggatggggactgcccctcttagtgtagataccaggaggtgtgatttgtcgaggctgttagtgtaatggtcttcccaccttagcctcagtttccatgtcggttagatgggaataggttactaagcatgtaaggagggccagcctgagtttgaggtattttccatgtcacatccatttctaactgagtgtgtgatcataggattcacattcctcatgaatgaagaagtcttgtaccaagcgatccaagggtccaccattatcaccacctgacttcagcacacacatacacagacacacacttctgtttcatcttccacacaatgtaaaaatcaaatatgattggaagaatcttcaaagtggtagaggactataccaatgggatatattattacaaataataattatgaagaattctaatgtattttccaaaaacttatgagatgctaaacatctctgttacatattgcacatttaaaaataattacattatgagaagtgcgttattcgggtttctgtttcttttctggtgttttaagctcactctaaaaaggcctggcaaatcaagatgtgtttgcatgaaactaaaggcactaggaggagactaaaaggtcaaatctaccttttaggagcagcctgcattccaaatggaggcatttcagcttactcaagtctttatttagtctaaccacttggcaacctactttatttagtttaatctcctggcaacctactctaaccacttggaaacctacagcctacctacagaatcatagttcagccatccattcctaccttcctagtgtttttgtttatttgcttggctcattgtattgtgtttatgtgtacatgtttgtgagggcagctcaactgtgacctcttgtgcagtgttccaaatttacaaagttccctaaggataccaggccatccctggccctcttttctcttatatatgggcaaaggctgagtgacttggggtcctgacctcagtaaatgcagtcttatcctcacccattgctttgcttattcactgaacctagtcctgaaaatatgggagtatagattcagaatcagctctcacctctgtgtggatgactttgcgctcagcatgcatttcatagccctgctcatggcttataaggtcctctctaacatggctgctggttccccactctcctaagtgtaaacaccctcccccactctagggactgtgcatcccatcctgcatccactgcaccctagccttcataactcacatgctgatatggaaataaacgaagaccaccaaatggaaacaagcaaagcctcttgaatcagagcttgctacatccagagggccagccactagcccttgcgttcggcagagactgaaaggcaagcggaagagagaaagctccagagtggaaaagagggaaagcttcaagtatgtcctgattggaggctgttggcctggggaagttgcagacaggctaacaagatgcggggaatcttgtgtaatagattaggggtacctatttagctttcttgggttagtcctagaatttcaagccaggacaaaagttagggaaactgtcagggaaattaatcaagtccttgccatttggggctgattgctaaaggggttgttgtttggcttcctgaactggtgactctaaacagtaggttggctccctgggctggttgctgcaggttgtgggtgaaggttctgtttttatatagtcagactagtgtccatttgtatcttcagcctctcaccattcccccaactgaaggtgctgctgttacttgttccctgtcctcacagaccctctttccacaccccatcattctggctgaagccccctccaatgtgttttcacagcacctgcactttgatcacaacacatgtcccctttattttagtcattactggttcgttttcccttttggtccaaacactccttgagggcaggggttctgtcttgttcatcactgtatcttccctagtcccttgcaccgtgtctggctccagtcagcttatagtaaataccgattaaacaaatgattgatgaataccaaatacagcctgataaatctccctctttccactccctggtctgcatttctccctgccttacggatatctgcaactggatattccacttgcatctcaaaattatcatgtctaaaaccaaacatttgatctttctcccaagccattccttcttgtgatgtcctgatttgtaaagtcccaccatgctcacaaacactctgccttgccccctgcagctatcagtgggtccccatcatcttcatctcttgcatttctgtcccatttctttttattcccacctcagcctttgttctggtttggactctgacctcagcctgccgcctggtcactgggttccagtctcagtcaccctctcgaatccatcctccacgccatcccaaagttccactttgcttatgcttctgtcttatgggaaacccttctgtggcctcgcatgtctcagcctagccttcagagctctcaaccgtatgaaataatcccgtccatagtgttcattactccttgccacacacttgacttttcaatcccgttaccctagttgtttctaggacatggcagttcctcccctcctttctgctgcctttaccacctccgcagcttaaacaatgactgaacattcccttgtctccagtggcagttatagatactacgctgtgctgtagtgatcgatgcagatgtcttctttcccttactgaactaagctcattgaaacatccaccctagctggtctttgccatttatagagtaggcacatggtaaatatctgttgagtaaatgaatgatgcagctggtcattgcatctagaataaccctcacgttaaggtgggttcatccttagatggatttgggattgatgaattcaaacgtgcagttaagagtttgcttgtaaatcctgagaccatatagacagagtagcagcataattgtgtgtctgaaccatcagtgtttactcagcccttccttttgtagttctagtaaattgctttgtatttgaatccgtgctagggccttctccgcggagatttttttttcttgaggcctacaccggcagcatggccaaatgcctatttcccaacttatatccagaaattattgcctttttttttttttttttttttttttggacagagtcttgctcttgctctgtcgcccaggctggagagtgcagtggcgtgatctcggctcactgcaacctctgcctcctgtgttcaagcagttctcctgcctcagccttccaagtagccgggactacaagcgtgcgccaccgtgcccggctaatttttgtatttttagtagagacggggtttcaccgtgttggccaggatggtcttgatctcttgacctcgtgatccgcctgcctcggcctcccaaagtgctgggattacaggtgtgagccaccatgcctggccctggcttttctttagtagaagttcagttcatactaccaaggcatctaaaatatttatctccttactcattaaaactcggcagttacccgtcttactggaaagagggatacgtttgcctaattggggatccaatttttttgggtgagcagcagatctctggggcaggaaggcgggtaggcatgtgtaagttgtgatggagcccccagccccctaggcctcatccacctcagttcggtctccagctccagcgactcataggaacaccacagatgcacgaaaagcagccgggtcactccttatggaaggcgtgccagccgggcacagcaggtcccatccgtccttctagggcggccagtaaagagcctttctggtaataaatgtaatgaacatgtgatcattctgctgactgcagcctgctaacaagcttacgattaggatcaccgagattctccaagtgcccgagtgtctcagcctattacatggaggtgacacgctgtcataccaccctgggaaatgcaggatggctcctggcagcacagnnnnnnnnnnnnnnnnnnnntaaaacattcagagcatgccagccccgtgtagaacaccagcctaagagactggaataaaaagaatgccgacaaaatttgaataatcatatgcgatacatctattcattctaaaacatgattagataatgcaaattatacatgataatcataaattaaaacaattacaaataagacagaatacatttattgtttaaattgttgaagtttatatttagaaattgctctgggtagcatcaacattgactctgctggaggattcacctttgctgtcatagatgcaaaccaaccatttcaaacagttttaatggcaatctgtgcttccaatgcagtgaactgggtttctgctccgccgtgctcttccccattctctgtggttttatcatcctcggcctgcacacgtaccgttgcctttgcctagaatatcttttccttttttgtttattcttcagggtttaatgaaaaccctgactcttctgtgaggccaccccacttccctttggtattgcttttctcctctgcttccgcatggcatcttgcacatttgctaacgtgcactcatgaccttgaacatcccttgagcacaggtctctgttcccctctgggagcctcccctggctcatgcctcaatgatgaggaagaccctgtctgagttgcttttgtggccttcgtcccctctgtgcctagtacggggcctggcgctcctcgattggaaagcaagaaatatttatttaatgaaatgtcactaacacaagctgaggctcttttaggtctaagaaaacggccatctccccgttgctgttttggcccctctagtcctgtgtccttgatgtctgtgaacggccactcctgagttctgtctgtgaggctcactgctgctagcatgttggagcccaagggcattgaggggccttcccctgtcacccccttttgttacagacacacattccagagaggtgaaccctcgctaaaggttacagtttgccttccagctaccgctgaagcttgtggcttggttaaacaggcctccctgagtagaaatgatggactcttctgagttgagagacctcggattgtacttgaaactttccattctccagctgggccatttggggcacttcctgttcttgtgtgaaatcattagccacaatctggagacctacgagtggaatttggtctgcagtcttcgtttctttctttaaagtttgaattctgatgcttctcacaaagacacctgctttgcagatagctctggtccccaccgtccatccccgcagttactgcatctttgagaaactttctgttttatactcacagcgcttcacagcttgcactagccatgttccaagtcttcggccgctgcatgcagccagcagttagagtgcgggactggacagcgccggccggatgcttctgccttcgctcattgacggttcttgctggcttccgaaggcatttagatctgacactgtggatgaaaaggccctataaagcccttcctactctgacatccagtgaatctactattaagatggattttagagttaagtgagtccaggacgaccatcgatgtctcaccgaattggaactcactggtcagcagccgtaatgtttgaattggaaccagaaaatagctctcaaatttgcagagtcagctttgccgggcttcaggctgagtgggctcatagctggttggccctgtatctctggcctgggcaccgtggctccttgccaaggccggcaacccttgatggtggcagcacggagcagaccgagcccccagccgacttacccccgaggcctcgcgcctcccccttcacagcattgcgccttccctcttccagttcccagggtcgcttcaggctgtcccagccctctgcctagtcagctgtcagggaggggaagtggcaagtccaaggccgccagagggcttcctactgcctgccctgcctgtggcatttcttaaggtgacaaagagtgtgtttttaaaccaccctccagaactcttactccccatgaattctctgcagctgctcccccagaattgactggaaagagaacctcgtttaagctgcctatgcagcagaatgctgtgagtcagacgacgtcctgccaagtgcaacctgagatgcttcagtggaagcttgttcctcggtggtgacaccttgtctccacgctcatccattcgagtgaaaattcatctctttccctcccaaaaacatcatgtaatgaatgatggttgtttttgctctgaaggagacttttttttttttttttttttttttttttagacggagtctcgctctgttgccgggctggaatgcagtggcgtgatcttggctcactgcaacctctgcctcttgggttcaagcgattctcctgctccagcctcccaggcatctgggaccacaggcatgcgccaccacgcctagctaatttttgtatttttggtagagatggggtttcaccatgttgaccaggatggtctcggtctcttgacctcatgatccacccgcttcagcctcccaaagtgctgggattataggcgtgagccactgtgcccggccgaaagtgacttatatttgcatagattatctctgtaaaaagtgaaaggtttctgtgaacgtctggtacttataaaatatctttgtagggcaggatgggagatgattaaactacttcctcatttagacagtgccacctgtaagaagacttgtggtgtggattcaaagatggttatccacagtgagatgaatagaaggcagtacttctcaaactttcatgttcaccgaagtcacctggggatcttggtaaaatgcagattcggatacagcaggtctggatgaacccagactgcttttcctaataaactcccagaagaggcgcaggttttaaggctatgaggtgcttctctggaccctggctgtccgacggccacatttaatgagaagagaacccagctgtgtggttgttgactgcgatgaggatcgcactgacttagaaagttatgactttaatgttccttagtcgaatcactaagatttctatataaaacagcagaaaatatgggagtttggagaagagagaaatgagctggatgaaatagcttcctagctcctgattgatcattgggcatcagctattttgtgtgctggtgccgatgagcaggggaacacgtcgtgaacagagttgtgtcatagctggacgagaaggagatgttgtagggttcagttcgtgtagtgaatttttcctgaatccttaaattctcatatataaaaacatatagatatgaagacattacaataatatagaaaagactgtgtatgtatgtgtgtatgtgtaccctatgagaaatgtttttgctggtatgcgaaggggaaaatctagtgtttggaaagagttctccactgtgctttgggactacaagttcagcttggggcagggcagcagagttgaagaggaggcagggagggcagaatgaagccatcgtccctgtgcagcatatcgggtgttacttttatgttggtgaaagaatgatccgaggagccagcttatcagtgtggagaagattgcagctgcaatttgctggttagtctctgttcttttaacgctttcctgaagtgccattttgtctcggtaaaatgctccctgaaaatactcaaatatttttagttgtagagtacaaatcagattgagctgcacatttccctggtgagcaaaagtgatgagtttgtgttcattaactcgaggccatctggtgcagacacgctgccgtctgtgaatcaaacgtgcatcaaactccagggatcagaacgcgtgccagagccagtgttttggagagtcaacaacaaccgggggagaaagaggccctggctatatttttcttttaaaaaatcggctctgtcttgcaacatatcagagcatcccgtgctgcccagctgatgagcccacttgcaatctctccattgcccatctgaactgtctttgcggtgtgctctgaactgtttttgaggtgtgtctctgtggttgaagtcatcttgcctgataccatcttcgtttgggtagggggagaggtggagagagcattccagtccctttctctgcatttttctgtaaccacaggcctgagccacagacaggcgtgtgcacacacacacattctcactgtgagacaaagaattgtgaggcaaagcaatgctcaaggtagttgacatgttgcagaacattcttgggagaactgccttctgcaaataaccaatttcttgaggagacagtgcttcttgcagtcttgccaataaaaagccactcagcagcagctagctttctgtttcgcgcactcaccaaaatatatatacatgaaagaaattgctacgctgatctggtactgaagaccaccagggccgtccgtggcgtgtacggaggagggacctgggagggtctgggagtctccttggaggttcctcccacttcggcatccgtgagtcctgtatttggtaccggaggcccggaggcccgtgtatctgtgttagcagttggtcccctgcagagcacgacacctgacgtttctgtaacgagatgcaattttctgggtagcctctgtaccgtctttctagctatgccttttcctttaggtacccaagcatgttcactggaagaagagaacacagactgggctgcagacggagggaagatgagtatagggactctccttgtctgtccctgtacctgcccactgccacctgtctacgtcctgagatacccagcagaggacagggttccacttggaaaattcttttgaatctcacacaagacagtaataaacatagagggagaaataacaagacattttaccatgtcttgtgtcatgtaggaaactttacatttcagaaaatatgaagacaaaaagatgaaggaaagggctttaaggatacaaaggaccttattatggaaggaaagcagtgttgtcaagagagctaaaatgaacttttctttttccagtgggttaacttttaaaagtgcatgttatttagtgccctgcattgcagtgtatcttattataaccttaccagccccagctccttcactgttttcagtgtttgctaatatggtaatcatgaaatagcactttatttttgaatctttggttagcattagagtttaagtttatcatttgctttttgtttgtaagccctgaatgaaggtttacttgcacttaggaaagcccactgtccagtatgtagacaagttagctcactgaaggtcttactaagccattagttgaattacaatgcatttgctacagcctggatctctaaattgatggaatccacattgttggcaagattcaagggtagcacacaccctgaacacacaaatgcgaggacacaacagcaagaatgagtaagcgagagaatcaggtgagtttctaaggagctttctggaggaacagaactttgttttactttttgattatgcaatttatgtttatagtggaaaacaggtaagacaataatagtacctttgctaatcatattttaaaacattttggtatgtatgcttctattcctttctctatgggaataaataccttaaacaatagaatcagtatattcgtgaaatatcggtcagtaaaatcagattagaatgattacaaatgcatcggtgaaggtattatcagtgaaaatatttgtaacctgcattttcgctgcatattcatttcatgaatatcttttcataccagttatgtaatatgtgtgtgtgtgtgtgtgtatatatatatatatatatatatatataccagttatataataaaatgttattttattgttatcactatgtagtctcattgaatggatataccatagcttatttaacggctttagtgttgtttgacatttgggttgcttccaacatttcctgctcataaatgctgccgtgatgagcatacttacagctgaatcttttcttgcatccatggttagttccctagaataagttcccagaagaggaatggctacatatatgcatgtgcaaactttatggcttttgatttgtgtcagtagcataatgtattttcttcactggcatttagcatacttttaacctgtggtagcccataactctttactgtgtcagggccgggttccgtgcacctcctttatcagcctacaacactacgatgcccccagcctttccagtgccgcctcttcctgcccagcccagttcctggcccagaggccatggcagtttgcatggaagtgctgagtattgtttcatgtttgcaaagagaggacagctgtggatgaatggagaggaaataggagaaagtcattgtcagagactcgggatttttgatggaagctttatcgccgatagatatgacatttgccgagtaggccatcacttctttgattgtcactttccaaaccaaagcaaatgaagtcatcaaaaagaacgatgtgtcggagggcatttcaaaattctggagatttctgagacacgtgtaaggaacagaaaacctggcttgggtggcatgctgtgtcaaaggaaaagaactgcagtgaggttggaggagtgggctcacctgatggatgcatttcttcagtacatacatggcaggggaaggcctgtccctctgtggggtcaggcagtcagggtggctcttttaaagtggtagcttctgaatgtcctggctgctgggatcctagtagctttcctgggtgcccttggaaagcagaggattggtggtggtcctgggtgagggtctgcagatgcaggtggtggccaggggtctagccaggaagatatgccatatcagggaggcccagccctcaggggactgaggtttagagtggagacttggagattccttggaggtctagagataaggagtgactttgttccataggcaccgggctcctggagtctgagccataggaaactggtattcagtactagagctaggattgaagaaggggtctgttcacaaggaattcagtagcagcccaggtcctacgtggtaccacagtcagagtggaaccagcagcccagactgctgtgccatcgacctgaaggcccttcatgtatctggggagctgggactaagtggtctgtgctgtgagggttgggcagccacagcaccaggggtctggacattcactgctggtaacggtagttggcagccttctttcttgtcttttctctagatcaagcttagaacattctatgttgttttccgtatggttactcagtggcacagatcttacaggaaaggcagaccttgaaaaaagtttgttttcttctttttgttgtaaaaaaagacagatacagaaagcaatattaagcaaatgtgtggctttgtgattttatgtaagccaaacaaccttgttactgcataactttgctagtccccctaagagcctctcctccatctgccccaccccagttacagctttacagctcctcacccttcccaattcttgtaacagccacttccatgcatttctttacggatttgtcacccaggtgtgtgctgtggactgaatgctatgtcccactcaaattcctttgttgaaattttcacccacaaggtgatgggattagtaggtgatgatgatgacctttgaaaggtgatttggttgtgagagtggagccctgataaataggatgagtgccgttgtaaagagaccctttgcccattctgctgtgtgaggacactgtaagaaaggaggcagtccctcaccagacatagaatctaccttgattctggacttcctagcctccagaactgtgagaaataaattcgtgttgttcataagccacccagtccatggtatgttgttacggcagcccgaacagatcaacacagcgtgcacgttccttgctgctgtttttgagccttgcccattaaaaaaaaaaaaaaaaaaaaaaatatgtgtctttgaagtctcctttaaaacacgcagcttgccctctcttccttcttttttcctgtgggtttttaatctgcagatccccataagctggcatgcttcagcagttcctctgtcttttgtatttcctgaacattggcagctgcatccagaggtgtggaccagacccaagtctatctctttaacaaagtagtgatgcttttcatcggcaaacctacaccatgtggtttttgctccttttcacgttaacagccaatgatgcttaaggcacaaatccattgctttactgagagttgcaaaatcgtattatttcaactctatgaatttgttttcatttattaattgggataattttctaagaaggagcttccatgtcattttccatttgggtactcagtggcacaggtcttacaggaaagtcagaataaatgcttaatgctttctctcgacccacttttcagacattgacttggtttcctgtcttccttaagactgaaccaattaggtcgttttcaataatattatgaactcatggatttacacacatttgatgggtttcagtccattgcaattactatctttattgaaactcttattttcctatctttgaccagctggagctccttcacattggctctggggtccttttaccatgacttcaggagctttcctatcttctttaccatctggtataggctcacgttgtctatttcctgccccagacctggattccaccatttctccaagaaatctgctttcttttaatcagaaaaaagtatttcaagaccagctggggcagcatggatgcttattgctattggtttggtcattatttctagttttttcagtggacacaccatacaatgtgtagtgcgtatgttggggagggaggggtgttatcaaatactgtgagttcaaactgatatttcagactcaaattcagaactgtatagttttcactcaactacttttatattgcatttgtatctcctttcttccaaaccaagaatcttggtacttttttttgaaatggagttttactcttgttgtccaggctagagtgcagtggtgctatcttggctcactgcaacctctgcttcctgggtccaagcaattctcttgcctcagtctcctgagtagctgggattacaggtgtgcaccaccatgcccagctaatttttgtattattatcattagtggagacggggtttcaccatgttggccaggctggtctcaaattcctgcccccgggtgatctgtccaccttggcctcccaaagtgctgggattgcaggtgtgagccaccatgcctggcgatgtgagccaccactcctggcaaatcttggttcttaaagatacagaattagaatatcccgtaattattacaatagtcccaataacaataataagagcgctataccatcagtgatgattactgaaaacagttaaacattttttaatccctctattctcttgtttccccccaatttttgtggctatgtcatatttgcattatcagatcatataacctaggggtccccaacccccggttctggcctatggcctgttaggaacctggttgcacagaaggaggtgagctggcattaccacctcagctccgcctcctgtcagatcagcggcagcattagattcttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccagcattagattcttataggagcaggaaccctattgtgaactgcacgtgtgagggatctaggttgtacactccttatgagaatataactgacgcctgatgatctgaagtgaaacagtttgatcccaaaaacattcccttatccccccatcccgatccccaccccaggtctatggaaaaattgtccatggattgatagtgtgaagcatgtgatgtgctttttcaacgtgtagttttgatttcttttaatttcagggaagttgtcttcagttatgtactttaacagtgttctgtccccttgacttgcttttctttatcaggagcagactcctcttctccattgattggatcttctttgcccatcctcagtatttgtctctttctctgagttccttcttaccttttttcttttcttcttgattttaaaaaaagataccttttgcacctcccatttcctttacacagcttttgttttatatactggtttttatgttccttctagtttagttttcatctctgacattatgttttaatattatttcaggtcttatatcactttttaaaggcctttagttcattttaaagtaatatgctgcatattttatagttttttggtccatctttttggcatgcattcattatctgtagggattttcctctccttctccacctcctcctcttcctccttctcctcctcttcgttttctttctaatccttcttcagctttgtatgaaatttgaccagagtatttactgccacagagaggctccttcttttcactccttccactgctgccaccaagcttttgtcccccaagaggaggatggtctcagatggaggatggtctcagatggaggacgatctcagatggaggatggtctcagatggaggacggtctcagacagaggcccttttgcaaagtttgccttttctcgtgaacagtggtcttgagtttgagggaggaggagtaggtcatgtggactttctaaccttacagcactgttccatcttctgttgcatcccacagtgttaaaactgtgcagctggccctctgagatgtcctgtttctgttcccctcctccacttttacctggccaacctccttcctttatctctgttatttctatctgctcaattttgattccactcccagcagtgaggccctggacatgttcattgagagtccctggggacagtgcagctccagcctcttcacccaggcctcgtaacacaggcccttgcgtgtgctgctgctgctggagtgagccaagctgcttgagtgagccaagctgctctcagtgttagccactgttgtcaaaatggctgtctgtgtcttccagggaatgcttgttggatattttggtgttttgtgcccaggtccaccagatgccctattgcttccctctgttttctctagcagagatgcccccttcctcaaaaaagaacaaaaaacaaacaaaaaacatgccttgtggttgttggtggtttcattcatggacttgtaatttggagttcttggggataccttgtcacctagttttgttgtaaatgttgtctgtgagttgttgcttatgcatttagtgcatctgtgtgatttttctgggagacattggaaggatctcattgtagctgccatcatcccagagccccccagcaagattttaagctgatgggagacagggccccttgccgaacgtctgacggcacttcacatattgttctgtgtgcaacatggattcgataaatgtttgtagcatacacgaaactgtctaactctgggtttgaactccagccccaaagcaggcacaattctgggcttttggtattacatcctttttgcagtttatttggaagatattcatttgggcgacagggatgtactgtctgggtcagatctgggaggagtccaccctctagtgggggagagtggctctctgctgcctgtgtatggagataatgagtttcaaatgtggaactggctttggagttcatgcctgccactccaaaaaggcaagaccagagtggaacatacttgggcaagcctgtgactcccagtacctttatctcttaaagggatttatacagcagtcacttgtctgcttctttgcctaggtccctaattaaagcagttttcaacccgataaacagcctcaccttggctgatagagttggacaactccttggtggcccgtttccatgccctctcaggctctgtagctccagggttaagttcctgccttcagcagggccacccactgaaacatttaatgaggagaggagtattgtttcttggagacataattaccagagacacttaatgccacctttcccaagataacaggccttttgaaatgcagtgtgttggggaagatttagccaagctcagtgactgccttagcagttatgagtcatattaataatgcctacatctgcctccaccaaaaggctctagggtctgtctccgaagtttattaaactcttccttgggagacttgtgcttgggacttagggttctaagtcttttctttcattatttttggctgtaactcacttttacgtggttgtggccctgggcaaaattttgaaataggtaacttccctttgcattctcccagtactataagactcatacgtcctgggttttaggggtgcaagccagtccttgcattttaccaggattcttgaaggctgcaaactcgggatgtaaacacaagccattactgggagagcatacttgagacattggaggcctcttaagatgcttgccttctcaggagctcctgtctcccaaaaacacaacacaacaaagcaaaacacagaaagcacttctaatgaaagacttttatttaaatgtaaggaggcacctacttaaagtaactcttaagaaaatcacttaataaatatatatgacttttgtaatgtaaaaaatgtcttcctaacttatttgttttaaaatttcaactttttgacatcgtactgtcatcctttaaagttttgtgggttttcttagttttgaactttttcttccttaccgttgtcttccccctcatttcctggaaagggaaatcgtttccttctcatgatctgcgaggcttccttccctcctctctcttgtcgttgtttcattttgttttcgtcttttggccccaaggaagcagacgaagaatcctggagtgagagagacccgggttcccattccaactttcccctcacttgctgtgagactttggcaagttcgttggcttgtctgagcctcagttttcctccttgtaaaatggatataaaaatctctgcaccactgagttgcagcagtattaatgtcatactttatacagcatgcctagtgcctgccccagtgcagatgctcaggaaatatcgtccttacttaggagcactcctgtcaatgaaaacaggacctcttgccaaagagaaatattttgtgattagtgcttgctcctgtccctgcccccatgagcaagtgtcctccctttctcctcctgcattgttgaggacacgtttcttgatacaaatttaactacagccactaaatcagaaattcccacccaaagtcataccataagcaaaaaaaaaaaaaaaaaaaaaagtgggcttgtatatttaaggctgtgggtggtggaactgggcatgggaggggaggccactgagacatctctttgctccatcccctttctgagtttcctaggcctccactgttttctctccaagcagtccccctagagtccagggtccacagggagacccgttgtccctgctcccccaccaatttctcccaagagaaaggaggtctcagatgaggacccttttgcaaattgttgctctggaggctgaaaaatcaagctcgagctgcctgctggtcctgatttccttcctggccgttagtccctgcctttttcctctttgtcggttttcaaacgcaactgcccgcgccaccgggagctgcccctgacttcctccttccctcctggccccagctctcctgctcttgttcctgcccctgcctccatccctaatacactcaactgcttaaatgtcatttgtgaaacaacagaaggacgtgctgtttttgcagcatcttggggaacaatttttttgattcatttggtgttaagaacactcataagaaatgtattcagtgaccctcgccagcctcagtcactggtgtggttcccatttggtggttggtgagcaaaacattttccccccagaaatgtccactcttctagcactttcagcctttctccgtaggttcctttgtcttcaggtccttgggtacttgaagccctgcagttgctagttcattttccagctgggagagcgatcctgatccagctccttctcaggcctttgaaccaagttctttggcaactggccagggagggaatatggccatgtcaggcgtgcttttccggcccatgagataaaaggaatggctggaaacactattccttccgtgactcacagggccaacctggcatgtgcaaggaacccgtcagactgggtggggacctcccgtccaaatttacctgcgcagacacagcacctcttggaggagctaggaagtgggagttcccttagcacgtgatccatatcttccctccaggccctaccgtgcctgtcttgtagcatgacgatgtatattctcaccttagtagtccccttagcctgtaaagctctttagggcaggatctacatctgcgtaaccttcagggcccccagtgctgagaactgtgcctcacaggtcctaaatgtttactgaaaggaagaacacacaggggtgggaggatcacttgaacccaggagtttgagaccaacctgggcaaccaagcaagatgcagtcaccacacacacacacacacacacacacacacacacacacacacacacacacacacactagctggttgttgtggtgcgcacccacctgtagtcccagctactcaggaggctgaggtgggaggatgacttgagtctgggaggttgaggctgcagtgagcttgatggcaccactgcagtccagcctgggctacaaagtaagaccctgtaacaacaaaacaacaaaacaaaaaacaaaagaagaacacatgtatttacctaactgagggtgggagtaggggtcagagagaactgtttcctttctctagacctt

SEQ ID NO: 533 - DNA, 1243 bp, Homo sapiens
agaacttcgtcccgagagaacctcaggaactcgccgggccacaccccctgtccagggaaggaacacgcccccggtgacagccggtacggccccgggtttgggcaacctcgattacgggcggcctccagccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccgtcccgaggatgggcaactcggcctcgaacatcgtcagcccccaggaggccttgccgggccggaaggaacagacccctgtagcggccaaacatcatgtcaatggcaacagaacagtcgaacctttcccagagggaacacagatggctgtatttggaatgggatgtttctggggagctgaaaggaaattctgggtcttgaaaggagtgtattcaactcaagttggttttgcaggaggctatacttcaaatcctacttataaagaagtctgctcagaaaaaactggccatgcagaagtcgtccgagtggtgtaccagccagaacacatgagttttgaggaactgctcaaggtcttctgggagaatcacgacccgacccaaggtatgcgccaggggaacgaccatggcactcagtaccgctcggccatctacccgacctctgccaagcaaatggaggcagccctgagctccaaagagaactaccaaaaggtacccaagcatgttcactggaagaagagaacacagactgggctgcagacggagggaagatgagtatagggactctccttgtctgtccctgtacctgcccactgccacctgtctacgtcctgagatacccagcagaggacagggttccacttggaaaattcttttgaatctcacacaagacagtaataaacatagagggagaaataacaagacattttaccatgtcttgtgtcatgtaggaaactttacatttcagaaaatatgaagacaaaaagatgaaggaaagggctttaaggatacaaaggaccttattatggaaggaaagcagtgttgtcaagagagctaaaatgaacttttctttttccagtgggttaacttttaaaagtgcatgttatttagtgccctgcattgcagtgtatcttatta

SEQ ID NO: 534 - protein, 214 aa, Homo sapiens
RRPPGPPFGWRPPMLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVPKHVHWKKRTQTGLQTEGR

SEQ ID NO: 535 - DNA, 34073 bp, Mus musculus
  misc_feature (1)...(34073): n = A,T,C or G
tccttgttacattttgaactgctgacgtgttgggtcctgttttacttcagaggtttgaaagcaatgattggctgggagtgtggccgtatgggagagctcttgcctggcaggtgcaaaaccctgtgctgaatgcccagtaccacaaaaaccaatcaatcaatcaggcaatcaatcaattaatcaacaggaccacgtttgtctagtatcattttgatgagttaccacctgacttcagtttcaggtcctctttttgttttaagatttatttatttattttatgtatatgagtacactgtagctgtacagatggttgtgagccttcatgtggttattgggaattgaatttttagaacctcttctcactctggtcaacctgatcagctctgcttgctctgacccaaagatttatttattattatgtgtaagtacactgtagctgtcttcagacattccagaaaagggtatccgatctcattacaggtggttgtgagccaccatgtggttgctgggatttgaactcaggaagagcagtcaatgctcttaccgactgagctatctagccagcccagttttaggccatcttaagtcttctcaaattttaaccagattgggtgtgaaccattaacacgctgtctgtgccacccttgagccagcagacaagaaaaaaggctgggtccgttgtggtccttaacatgtgttatatggaaggtggtatctgtggggctgcgggaggagagctaggagcaagatggctcagaggataacatactttctgagcaagcctagctacctggagtcccaactccaggtagagtggaaagatagttgattccacaaagttgtcctttaacctctgtggcatgccaatgtccttacccaacacaacacacaccaccaccaccaccaataaactgtggggtaaaaaccatttactcactcagacataccaaccctaggtctctgtgggtgaatgcagaacatggtttttacccaatcctataaggagatctggggcaccaagagaatccctgctgttcgagagtgaacattaatttcttacctcaaataagttcttacctcaaataagccttctggagctacaggtctagcctgttgattgcacacgcccctccccagctctacctccagttctagggccagtgggatcctcagacagaagagaacaggaactcaccacgtagatcagggctggctttgaactcagatatccacagtgctggcagtaaaggagtttgcaccacatttggctaaaattaattaaaaaaaaatcaaaacactgaacatgggcttgggatatagctcatttggtagtatattcctcaggaccacataaaccagtcatggtagtacacacctgtaataccaataactcccaggcagttgaggcatgaagaccaggaattcaaagccattccttggagtttgaaatgattctgagctacataaaactacctcaagaaaaatgctgggcacagaaactcacacctgttaccccagcactcaggtggtatcttagtcagggtttctattcctgcacaaacattatgaccaagaagcagttggggaagaaaggattcatttaacttacatttccacattgctgttgatcaccaaaggtggtcaggactggaactcaagcaggtcaggaagcaggagctgatatagaggccatggaggaatgttacttactaagccagtaagtttcctctggcttgctcagcctgctctctcgctctctctctctctctctctctctctctctctctctctttttttttgagacagggtttctctgtgtagcccaggctgtcctggaactcactcttgtagagcaggctggccttgaactcagaaatctgcctgcctctgcctcccaagtgctgggattaaaggcgtgcgccaccactgcccggcttcagcctgctctcttatagaacccaagactaccagcccagggatggtcccacccacaaggggtccttcccccttgatcactaattgaaaaaattgtcccacagctggatctcatggaggcacttcaaagctgaagctcctttctctgtgataactccagctgtgtcaagttgacacaaaactagccaggtggcttgtcaagagttcaagaccagtctgggttactatcctagttatggttactattgatgaaacaccataaccaaagcaaattagggaggaaagggcttatttccgcttacatttcctggtaacagtccatcactgaaggaagtcagagcaggaattcgaacagggcagaaacctagaggcaggagctgatgtagaggccgtggaggggtgctgcttactggcttgctccccatggcttgctcagcttgctttctcatagaatccaggaccaccagccccggtatttcactactcacaatgggctgggcccttcctcatcaatcactaattaagaaaatgcctacagctggatcttattggggcattttcccaactgagcttccctcctttcagagaattcgagtttgtgtcaagttgacataaaactagccagcacagctactcagtgggttccagaccagcatgagctacagagtcaaaccctgcttcaaaaagcagggggagggggagcatttttagatttattttatgtgtttgagtgttttgtctgcatgtatgtatgtatgtgtaccatatgtgtgcctggttgcctcacaggtcaaaagaggaaatatgacaccctgatagtggagctacggatggctgtgtgccacaatacagaccccagacctctgaaagaacagctgctcctaatcactgggccatctctctgactagaaaaagaatatgaggccagcttggtttatataccaagttttaggccagctacatagtgagactctgtctaaacaaacaacaacaaaaacaaacaaacagggaaaaggaaaagtgtgtatgcgtgtgtgtgagagtgtgtgtgtgtgttacatttttgttgccatgattaaacactaagaccaaaagcaacatatggaggaaggtcatatttggggagaactaagaagccagtaggttttttttgtttgttttagttggtatgactttttttttttaaattatttttctccctgtgacagggtttctctgtgtaaccctggctgtcctggaactccctctgtagaccaggctggcctcgaactcacagagatccacctgcctctgcctcttgagtgctgggctgaaaggcgtgtgatatcaccactccagtaagtcaggagctttaaaaggttgaaagaacggtatcctctttaagattcttttgcaaaaacaaaaaaccaaaaaccaacttaacaattttctcagcttctcccttctcagccatcttccttatctgtatccactctgctggaatgtatacagttctgagaagctgctgaaacaaccaaattatctccccagcccatttatttatttatttatttatttatttatttatagacagggttttttgttttgttttcttttgttttgtttcatttcgttttttgatttttcgagacagggtttctctgtatagccctggctgccctggaactcactttgtaaaccaggctggccttgaactcagaaatctgcctgcctctgcctcctgagcactgagattaaagaagtgtgccacccaccacaccgggctatagacagggtttctctgtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaagcaattcttttagcctctacatcagtagttctcactcttcctactgctgcgacccttgaatacagttccttgtgttgtaatgaccctcaaccatgacattattttccttgctacttcacaaccgtaatgatgctactcttatggcttctaatgtaaatgtctgtgttttcagttatggtttatggtgacccatgtgaaagggtcatttgagatccacccctcctaaaaaaaaagggtcatgatttacaagctgagaggtgttgctttttacaggtattttctgaagagtggtcctttggcatctaatcccagaactcaagaggaggaaacagttgtcatattcaagtatgggcccaattacttagcaatattgcatctacacacacagagacctacctgcctcctgggtaatgggaatgaacaagccaccatgcctgacaattgcctttgtcttagtctcagctgcactgttgctttcagtgaatatcacatccccatagttacgggaagcagatgacttttgcttttgtttttgttttttttcaaaacaaagattgaagaagctctagaagtctgccccattttaaacctctccggttttccatccgagaaacttcagagacttaaagaagtttgtggtttggatctgaagtgtccctcatagactactgtgttgaagacttggttcccacccagtgccactattttgggaggctgtggaaacctgagaaggccaggcctgtttggaggaagtaggtcagtggaggagcgcccctaaaggtcattgctgactccttgtcgtcttcacactccgcctcctgctcaccacgaggtgataaacctctcctgctccatgcttctgctaccatgacattttggtctaaattcatggagcacagtagccatggaggagtgaccctctaaaactgagagccaaggggctgctgagatggctcagcggttaagagcaccaactgctcttctaaaggtcctgagctcagatcccagcaaccacatggtggctcacaaccatctgactctctcttctggtgtgtctgaagaaagctacagtgtacttacaataaataaataaataaataaataaataaataaataaatacatctcctgggtgtttaaaaacaaacaaacaaccgagagccaaaataggttttccctccttgcaattatcctagaaggtctttgaggacactgataatgaaggaccaccccagagatgcagatgctggcagtaactcccctaagtagttctaaattgtagtgaacaaagccgagtgacagctgtgacctgctgatattcatggtgtcaggggactgcagccaccttgtccataagctacacataaaatccatcttagtcacgggtgctggcacctgcctttaatctcagtatggcaggtagggagaggaggatcatgagtttgagactattcctgggcttatggtccattcaaggccaacatggaccacagaggaagaccatgtcttgaaagaaagagagtgggagggaggaagaaaaacaaggaaggaaagaaaggacagaagacctgcctggtatgtagcttcatgcccttggtctaatctccaatactctcccccaacagctggccatattatatgtcttagtgttttactgctgtgaacagacaccatgaccaaagcaagtcttataaagaacaacatttaattgctgctggtttaccggttcagaggttcagtccattatcaccaaggtgggaacatggtagtatccaagcaggcttggttcaggagttgagagttctacatcttcatctaaatgctgctagtggaaggctggcttctacacagctaagataaggatcttaaagcccacacccacagtaacacacctactccaacagggccacaccctctaatagtgccactccctgggcccaacatatacaaactactacactatattccctaatatgtttctctgttgctgtgaccaacactgcccaacagcaacttggggaggaaagggtttgttctgtttacagggttcagtacatcatggaaaacagccagggcagaaactctgcagggtagaaaccaaagcagaaactatggaggaatactgcttgtttggggcttttgtttttcttataaaacccagaaccacctgcccaggagtggcactgcccacaataggctgagccctctcacttgtatcactaatcaagaaaatggccatagacatgttcccgggccaatcggatggagacagcacctcaactgaggctccctatttctgagtgagtgcagtttgtgtcaaactggccaaaggcaaagccacacagcacacagctacacagagcaatgcttccgaataacttcagaatgagattaagtgaatgaatgtgtagtgattgagtttttaattttatttgtgtagctgagtgtatgtgtgtctatcctatgtgtgcagcacctgaggtggtaagaagtcccctagaactggatttatggacagttgtgagccatctgtgggtactgggaattgaacccggatcttctggaagaacagccagtgctcttaaccactaagatacctctctaagccctagctttgtctttttaattcactccaccccttgcccagggaatgatgttgcccaaatttagggtgagtcttcctaccccaaaatctagaccctttctcatggacatgtccagaagtttgtctcctagatgattttagagcctgttatattaaccatgttgaccttcccaatggcaagtgagctcctcgctttgtcacgaatgttaaatggttaattaatgaagcactgatgcaccccaatgcccacaacgtaacatgaccctacaaatattaggtataatcaccaatgggcacacaaatgagacaattatttttcattttactggtcacactttgtagttaagaaaatcttcaaggcatctataggctactcacattaagtgggagttaaacaattctgtgaaaaagtccttcaaatacttcacaagcaaaataatgaaaagaaaggtaagaaaatataactcacaagcaggctctcaagaatggttattttccatggatttctatggtgtagtgtaattagttgggagttacagcagttagccaaaaaatattaacagggtgctcacttgggcaatgtctgtactaaacaacagtgtcagctcagcagtggtgacacacacctttaatcccagtgcttgggaggcagaggcaggcaaatctcttggagttcaaggccaacctggtctacagagctattccaagacagctggggctacacaaagaaaccctgtctcaaaaaaccaaaccaaaccaacaaccaaacaaatcagcataactcccgagcaaggctgactcacgaattcctgaagccttccagattgtttgaagataagagtcttggagccaggttggcctcatacttgctatatagcagaagtgatcttaagttcttgattcttgtgcctttgcttgccaagagctgggctttcgagcatgtaccatttgctttaggtttctgaggaactggagctggactccatggttcctgtatactagacaaatattttactaactgagctatacccccctcctccagccctgcaagtttgtgaaatctgcatatttttgtatgaaaactcaaaaaaaaaatagctgggaagatggctcagaggtgaaaatgcaaacctgaccgttcgaaagcccagaacccaggttaaagcagaaggcaggagattacagactactactctacaatcccttcactctaacagggctgtcagggagtcgggaagttacagggccagctagcatggtatacaagcactgaaatcatgagagaccctgtctcaggaaaggtgggaggtgaggactcatatcctaggatgtcatctgacctctgaatgcctgcattcacacagaagcatttaagacacatgaactctcaaaaaaaaaaaaagactcaaaaacatgcacatatctcatacacacataataaataaataagctaaaaacattaggggacaataatggtctgtatttgacaagattgaattttctttttccttctactgttcgtcaggcagcaccattgccgtgcatgaagttctggacaaacatattgtcaagcagtaaccaagtaattttttttaaagaaggggatgatttatttctattaatcatcatgatcttaagaatttctaccttgggcaaagggacatgcacacagtacatgcactacctatggtgtttgagatctaaagttatgctgggcaattctgtcttccaggagtatctgagaaaatctaagccgttatctgttatcctttggaagaaagagtcccgcaagggccactaaaatgcaatgacatcatttatagatggtacttagattgagatgtggggcacacccaaacaatgatgtggaatagctagctgcttcctagagacctcaacttctgtggaagaagggcagattctgaggtagaggtcatattggccagctcttcaggagacctgactttagggaccaattagaacagaggcagtcttggggaggcctcagaggtgcccatcaccctgggtctccttcatcaactgagtctttcctaaaaccagtttgttctgtcctgaccaattggacaccactatgctagtttccatcatatctttcttcagcgcaaccttcacttcccaggtactaaggagccagagacgtagctaaaagggattaagcacgtgaaacgtctactttgccctttccggttcggtcacgtgcattatataatcccgggcttgcccttggcaatgagccttcgacttcgaaaatgcccgcaggtcgcgctttgagggctcacgcccgtccgtgaatccagaccatcacgtcccctgcgtcgaggggcggggcctgatggtctgacgtcacccactacaccccgcctcccagatattatcagtgccgcccgccatcttgtctcagtgtctggtttggcggcggaagcattggcgggctgtgtgagtctgtgagtggaaggcgcgccggctcttttgtctgagtgtgacccggtggctttgttccaggcattccggtgatttcctccgggcagtccgcagaagccgcagcggccgcccgcgctctctctgcagtctccacacccgggagagcctgagcccgcgtcacgcccctcagcccccgctgagtcccttctctgttgtcgcgtccgaatcgagttcccggaatcagacggtgccccatagatggccagctttcccccgagggttaacgagaaagagatcggtgaggctcgggatggagggggagcgcggggtctaccggcagagcgtgaaggggctggctccggggcccggggggaaaacgggggtgggggatgggagaacggggaagtccgatgccaaggcccacgagcgcgggggaccggatgcccgggctccggagaaatggagaggagcaaggactgacgctgcgtggcgggaggaagcggtcccgcgatgggcgtcggccgggagtgaatggacccagagcgggcctcccgagtttgctcagcgccgggcaaaccctagtgacaccatcacagctggggtgcggatcggacgtcctgggattctcccggctgtgtcttggatatcgaatggacctggagagttactagcataggctaagtggtctatcctaggctctctttggtgggaagaagttgtgaacttttgtgttttttgaggcgcagcaggaacagcagcatctgtatgtccggtactctattgagaaagggacctggagaggtgtcagcggcgtagaaaaaaaagttttagtgttttttaaaggatggcgttatgaaagtgaagggttctaaggagggaatatgttgcccacctacacgggggggtgggggtggaaggagccgtgagaataggtggaatggctgaaggagggctattgtacagaggatgtagccgtggctagacctgtcacgcgtctggctgaagcctggacaatggggagtggaagggcgtgggccagacctgcccgttggcccctttaaagcacttagcattatttaaattctctcaaaggagtcacctttgagcccattggatgacattcgttgaacaaaattatcgtcagtagacactgactttacagttttgtcaattggattttcatgtccatgctaaaggtaggggcaggactccatgagtgtgtgaagagttccaggtcaggctataactgagctactaccctctttaacaaggcactgtcacacttcctttctggtcgtgaaatcggaggatggaatgtgaggaagaacttgaatctggttagccttgttcagtgatgactcatgatgtaagtgctatgcagataggttgggttttagggctggttcccacccactgccccattacttttttttttccccaaagcactttagagaaaaaccttgaggttgataatattttactagtcagtacttgagtatttaaagcagctaattaaagtataaaaatcgtttgtgtctgttagctaacaaggaaacgtgaaggcacttagaaaaatgctgactatgtaacaattagaatgtcttacatttgaagatgagttagtgaattgtttcttggggtttggtgtttgaaccagccacatctctatctcattaacactttataaagaaaagtagccaaatgagtgtacccaagactagtttttaaaagtaaccttaaagtacagatataaatctctgggaaataaagtattcttcttagatcaacttgggagcattctcttttaaagcgaatgtttccattgccttcttttaaaaagtagaattttaaaacttgttttccttatttgtgaatgaagtccttcctaaaattcattttgaccaatagatgaaagttaagcaggaatcccagtttggggggctgagtatgagaagaaccccagtgaaaggaccgtgtaagagtatatgtaggcttggagaaatgcaggaagcctgcagcaatgtgctccttctgaggtttcgcattgaaaatgcattctgctggcattgaggctcacctactcatgagtcttatatcagactcatgtgactgccagtaacaggaatgtgagcttattctatgttgctcccttttgaagaagtgggggttctctatcactttggttaaaccacaccaggaagtagtctccagttctgggtatcacctttttaagggttactactaatgggaatgtattccaggaaaatgtaaaaattaaggtaggaaaagatagaaaattgactcaaaactttataatctgaagactgatggaaagaactagaactattgtatcctagagaagactcctatataggtgtcatatgaggtcatgaggtcaagattgttctcagatcagattcagctcaataggtgggtggggtagaaggaagattttgaattcttttgttttttgttttattttttctttgttctccttaaggcagaatttctctgtgtaacccgggaactctgtagagcaggctggcctcaaactcaagagattcttgtctgcctctgccaactgagtgatgggattaggattaaaggcgtgtgccactaccattcagcagatttgagtatctaaaaaagaaaacattgtttaagcaaaatagttttatcttagtgatgggtgttaggatattttcatacaagaaggaaaattttaaaataatgtaggagttctgagttggagcctggcctggtctacagaatgagttccaggacagccagggctacacagggaaaccctgtctcggaaaacaaaaattgcgtgtattatgtgtgaagaatagtaaaagtgtgttctccccttgtgccatgtggctactaggaattgaaatcaagtggtcaagcttggcagcaggtatgtgtacccactgagtcattttgctagccctccagctcttcccaggctgaccatgtagctgaggtgaccttaaaattccaattctttacctggtttgtactaatgatgaagatagaaaccagagcttcttgtagattagcaagacaacctatgcctaacgatttatagttcttgaaaggtgatgataatcttaattccccttctgttctcttttctcttcccactttcatggggtctacctatttaatctaggttggccttaaagatttgtcatccagccccagctacactgaaactttgtcacagggtctcatgtggctcgggctggtcttgaactcctgaacagtaagccttctaagggctgaggtgtgccttccgtgcctagtgacatattttaaaatctcttgaaaaccactatcaaaacaaagctcatctctaatgttttggggtagaaagccaattaaaccatgtctaaaaggaaagggggcaatctcagcaaatgccaaaataatatggggccatgtgaatccggtgattgcatacactatcctgatttctgtctttgtctgtttcagtgagatcacgtactataggggaactcttggctccagcagctccttttgacaagaaatgtggtggtgagaactggacggttgcttttgctcctgatggttcctactttgcgtggtcacaaggatatcgcatagtgaagcttgtcccgtggtcccagtgccgtaagaacttgtaagactgctttcctttgcttttgttgaatttactattgtctttcagtgttgggtaataagatattttaagttttctttttttttttttttttttttttccattttttattaggtatttagctcatttacatttccaatgctataccaaaagtccnnnnnnnnnnnnnnnnnnnntccccccctttggccctggcgttcccctgtaccggggcacacaaagtctgcgtatccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagcttttaagttttctttacagccagtgttagaagcttgtttgtagttggaatcttcattgaagattgaatgtaaagaattacctgagctagtcactgctgtatccctttaatccaagcacttgggaagtggaggaggcaggtggctctctgaggttcaaggccagccaggtctacatacatagtagaacttgtctcaaaaaagaaaaaaaatctgggtggccatggtggtacattcccgtaatcccagctcttgggaagcagaaaggatgatgtcatagtatagaccagcctagactacgtagtgaaaaggtctggactaaatttgaatattatagaatgttgtaaaattttctcaaatatttatgctcccaacccctcccacactgaaccccagggtcttcatacacaggggccaatgctttgccaactaacctacatccctgtctctttgtgtgtgtgtgtgtgtgtgtgtgtgtgtgtgtaaagacagattaattgtgccttgctttagtgtgtgtgtgtgtgtcctgttgtgtcagatcaagtgatctgttagatgaagatttttgcattcactttggatttcacacactttattggttaacagaggtgtataaacagatttttttctaaaatagatctggtcactatgtggcccaggttggctttaaattgatctgtctcagcctcctggatgatgctgtcgggtttgagccacacacccttctgattggagtagggtcagggaaagctttaacctaggccaactgcagattcagtatgtatagccttggatgaccttgaacttctaatcctgcatttctactcagaattgctggaataactaactgggtatccctctataccccattatgttctggtagagatcagacctgaggtttcatgtctgccctgtaagcattccaccagctgaagttttatatgtctgttattttaattttcaagttaattagattttatctaggcttgtgtggtcccttcactatgcaccagggtcactgaagttctcatcaagataactcttctttctgaaggaacttaatctagtcatgctatctgtccatcacctgacagttctttttatctctgcttgaattaaggacatgttcatgatagcttcaaagttttctgaagtctatggcttctagtttactggaataatctagtttagtatcctaaaagatggcttatataatacttaaaattatttagcaatttagcaatttaatttagcaaatgagctaaattagtccttaaattcatattgagagggctggagagatggctcagcggtaaagagcattgactgctcttctgcaggtcccgagttcaaatcccagcaaccacatggtggctcacaaccatctgtaatgagatctgagaccctcttctggggtgtctgaagagagctacagtgtacttacatataataaataaataaatctttaaaaaaattcatattgagaagttactgttttttcatcctaagttctcttctgagcataaagaaaatgttccaggtttagtgtcaccactgagtacatgtcctgtgacagaagcggtctcagttgagaccctgaccagtgctggacactgtcaacaatgcccctctcaggtggaaccaggctttacactctctgtaaaggaagttctatgaagccggtttggaagggaaatcagctataaattgttttcttactgagggttctcagccaacaatagttttcatgagttgaatttgtctagccttttatttcagataccaactttttcatctttagaaatagtgttagaattgtattgaaaaacctaacaagtgttaacaattagtgtttacagaagttcggtataaagaaaaattcattttcaatctttttcccctcagtcttttgcatggttccaaaaatgttaccaattcaagctgtctaaaattggcaagacaaaacagtaatggtggtcagaaaaacaagcctcctgagcacgttatagactgtggagacatagtctggagtcttgcttttgggtcttcagttccagaaaaacagagtcgttgcgttaatatagaatggcatcggttccgatttggacaggatcagctactccttgccacaggattaaacaatggtcgcatcaaaatctgggatgtatatacaggtatggattcatattggaagtgaacctggaaagtgagaattaatgtgtctttataattgtcctaagtcttataataatttataattttaatctaggagaataataagagtttataccacttgataagataaaatatgcaaagcaggtttgggtcttattttagttaactataaactaatattttagtttctgactcagcaaaatgtcttacatggtttttcaatgataacttaggggttttcaagggaaagcagttttttgtatcccaagcaggcatcaagcttgctgtgtagctgatgatgactacttccagttaccacatcctgagtactgggattgcaggcctgtgctgcaactcccaattttatgcagtgctaggactccaactctagggcttcacctgcatactagggaagcacgtgtcaactgaaccacttacttacccagctacagatcggagggctggtgtcttagtttgggttttactgctgtgaacagacgccatgaccaaggcaactcttataaggacaacatttagttggggctgccttacaggctcagaggttcagttcattatcaagatgggagcaggcaagcatgatacaggagctgagaggtctacatcttcatctggaggctgctaggatacggatgctaaagcctattcccacagtaacacacccacttcagtaagcctctactgcctaatagtcccactccctgggccaagcagaaacagacaatcctacagttgggttttgagacaaggtctctcagtatgtagaccaggctggcctcaaagtcacagagatctatctgcctgcctcccaaataaaagtgcaccaccatgcctagctcacaaatcaagttttaataatcaatatctaaccttcaggtttttttgttttttgggttttgtttggttggttgtttttttttcttttgttttgtttttttggcttttcgagacagagtttctctgtatagtcctggctgtcctggaactcactctgtaaaccaggctggcctcgaactcagaaatccgcctgcctcttcttcccgagtgctgggattaaaggtgtgggccaccactctcggctcccttcagaaggttttaatcactttatccaatatctaactatatagttggggaagttgaattctttgaacaagtaagtattcaaggtggtagcagatgcctttgattaaagcacttgggaagcggaggtaggtggatgtctgtttggggccagctcctgtctacatagtgagttctaggtcagctagtgctatgtagagagaccctgtaacaacaacaacaacaaaaaaaagcaagtatataaatgttcaaactgggcatggtgatacataggtgtgtgacctcaacactgagatgtttgagtggccagcctgatattgcttcaaacctgaggttcagtgaccagcaatgcaagaaaagaaaaaagtgctgggcagtggtggcgcacacctttaatcccagcacttgggaggcagaggcagggggaaaaaagagtttagattttgttctagttcttagcatattctgtttgttcacaaatataaaataattttagtgagcataaaagcaagatgtaccccaggacatagacagtaataatggcattgacttgaggacaaggaatcaaagtttgattggcttattgaggggaaaaattaaggtgaccacagatttttctagaaaacaaaacttccagtaactggtaattgtttgtttgtttgttttgtttagataatgtttatggagcatttgatggtccaaggtcaaagagaaaagttgatactttgatattgtacaaatgaaaagtcagtggtgtggggctttcttaatgctaatttggtctaggagttttcttacattgcagtcatttcttttatagttttctaatacatggagggtttgttatcttgggaagaatttctgagttgtagattctcacagctaacgatagccactagttaataaattaaacaatttgtttcataaaacaagaaagtacccaagaatgtctgtttaatttttttttcttctcctttcaatcacatttaggaaaactcctccttaatttggtagaccacattgaaatggttagagatttaacttttgctccagatgggagcttactccttgtatcagcttcaagagacaaaactctaagagtgtgggacctgaaagatgatggtatgtatgccttttgtcttttccctagctgtgtcaaagggtgaggttttgtttcttttttttttttttgagccagggtctctctgtagccttagctggcctggaaattgctatgtagaccagactatcctcacaagaaatccacctgcctctgcctcttgagtgttagagttaaagatgtgttcagccacacatggccacatctctttatgactagttttcagagagatgtggggattgcccttgccctgccctgactcatgaaggacaccaggagtcatagctttaggggaggtagggcaggagaattgagagctctaggacaaacctgctagctacttagcaagactgtcagcaaaacagaaaccaaatggcttggtgatcattgttactttgcttttttctgtttaatactcgggtccctttcctatgtagatcaaacaaagcacagcttaagtaagtaagctggaacaggaaccagcagttactataacaaacagtctgacactgctcagaccaaccacacagacctatgactctaggtctaaggaattcaacatctcctggcccctctggatactgcatgcaggtgctacacagacatatatgcaagcaaaataatactcacatattaaatacatgaattttaaaatcaaaaacattattttggggctagagagatggctcagaatttaagagcactgactgttctgccgaaggtcctgaattcaaatcccagcaaccacatggtggctcacaaccatctataatgaaatctgatgccctcttctggggtatctgaaaaacagctacagtgtacttacatataataaataaatcttttttaaaaagccctatttttaaaattttatttaaaacaacaaatctagtcacccaatagaatttagattatatagcctgatttacaaatcaggatttgtaatgtggttaaatgctggcaagcatagatcataaattctttcataaaatatacgagatgttttatcctctaaccctcatggaaaagtatgttggtgtactcagtttctttctgagacgtgtggtgtattgatgtattttacttcatagaaacaaatgtctttatctcctaaatactgagattaaaggtgtatacattagcatgcctggcttttatattctaaattgtattatttttagttctctatattcatgtttgtctacatgtggttatgtatgggtgtctgaggaggtcagagtgttagattcccatggagcaataaagtgctggggaccaaactcaggtcctctgcaagcagagtgtgctcttgactactgaggtgtgtctccagccctgtgtaattttatcaagcaaaatactaccccttgtgagttaggccatcttggtctgcatagtgaattctagaacagccagggctacatatagagttcctgccttggtaaaagggatggaaagaaagcaacgggtggctgatattgaaggcctttctatgcatatacatccctttcagctgcagaagtttatgatgaatgtagattactgtcttgtccgtcgaggtgttactgattggaaatgggtcctgacacggatgcttcttttgttcaggaaacatggtgaaagtattgcgggcacatcagaattgggtgtacagttgtgcattctctcccgactgttctatgctgtgttcagttggcgccagtaaagcagtaagtatcaaagttcttgtacacgtgctgtgaattggatgatgatgatgaatgcctaatcattttaaatctaagcaacctattaagtctgtgctcggtgtcctgaatgtcttaagtgctttatttcattatggagagaatttgcaagtagaaaattagttatctgtgaattgagattacttgaattgcttttagagatgcttataaaatgaagggttagtgagggttttttgtgggttgttttttttttttttgtttgtttgtgaaatctaggagtgcttaagtgctatagatgagatctagtccatttttaagatatttccttgctaattattttctttgtttttgttttgtccagtttgctggttttgttttgtttttaaattttgagtctcagttgatcatggacatttaactgaaaaaaaaattattaaattataagcataataaaattaaaactcatggatgtcctacagtggattatagatgaagcttcacatggtttgacagcgtgcctattgacagcttaagtagtgactgttgaaggttgtacttttagtgaactgtcagtttactagctctgagttaatgtatttttaagagtttagcagcattgagtatgaacctggctgaactcaatacgtataatgatggcaacactctggattgatgggggtgggggtgggggtggctagataaaacacattttattttgccaagaagtatgttaagatgatagttgtgaatgttagaagtttaaaacaaagtagcttagttttgtttttgttttttttttttttgttttaaatcataacaacaagctagatgttgacattgtgattttaggctgtgtgttttccatatgcttcttgctttccctgtcacaggtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcggcgtccactttctgcttttctttcttttctttttcttttctttttcctttaaaagtaatttcccccacagtaatgtccagactcctgagtaaattgatcttccagtttgaaggaattgagagtctgacaagtaaatttaatgttaacgtaattggtttttgagtgttttctctgttttttggaattcttaagatactagtagtaccttaaattatttacccagttattatacttatttcccttgggaaacaatgtgtgcagaaaggaagtagcagaaaggattattctacttcaagaggaggaacgctgtctcactaggcttgctgtaaacctcccagcttacatttactcttaacagtaagcattagaatactgtccagaactacttgagaggctaaggcaagtagataggccagcttaacttcttggtgagacatgacctcaaagcaaaacccagcaaaacctatttagagccttctgcacagtctttggatgtttaaaatctaaactgtatgtgggcttacttttacgtaatttaactgttttatgctgaaagtaactaatgatcatagtcaatttggaaaaataagtgttaaatcttgattatctaaaaatgttgtagttatattttcataaaatagtatattttcatctgtaatatggtttagtaacatacttgttgtttgccaacaaaattatttttggctgtgaaaattctctttgcttgcagtatctgtttctcttcctaggctctcggtggtgacccaagcctattgtaaacaagtgattatctcaaagggagatgccaatggagtaacaattgctaacattacattttctgtctgtatatatttttaaaaattggtagtttctggaaaaaaagagaaaggggtttgtaatacttaaccctatttatttccatatattttagttaattagattttggaataaatggatttcagtatttgtggttaaattgcattgcctttattttccctttaggcttattttttaaattaacatttaacagaaacatttgaaatagaaatttgcatgtctgctttaattaacgtaaagactgatttttaatctacgacactgagcatattctttaaattactcataatttgtaattaatttgatgtaattaaagtagcaattttagtttaagatgtgcccctttgtcctctgtgtgtctgagtgaaactataacatttccctcttttatttcaggttttcctttggaatatggataaatacaccatgattaggaagctggaaggtcatcaccatgatgttgtagcttgtgacttttctcctgatggagcattgctagctactgcatcctatgacactcgtgtgtatgtctgggatccacacaatggagaccttctgatggagtttgggtgagtaccacatgaattatttcagttagtaacccaacattggctttcagtatatatagatttgaagaatttgtataaagttagaatccctaacaaaaatgtaaaatgaacagctctctgtttcattgaattcggctgtaacagttctcttcagtcttagttgtatcatcaaagccccactttaaaccttattcagaggccagtgaactcggtaccagggctattttgtttcttgaattgattctgaaactttgcaaatgtgtctctgaccccaggcacctgtttccctcgcccactccaatatttgctggaggagcaaatgaccgatgggtgagagctgtgtctttcagtcatgatggactgcatgttgccagccttgctgatgataagtgagtattatggagtataatatagttttgtctgtagtcgtgatttttaatgaaagtgtgctttaactcataacacactcataagcttgatttaggtttttgtacaggagttgtttgtatttgaaatggttttggtatatgggccagattgatcttgaactaaagatccttttacctctgcctcctgaatgctgagaattctatgtgaaccaccatgcccatcctgtctttctagacaacactttggaaggtgttgtttttttgcttaactggctgtggtgatacacctgtaaattgatggccactgcttttgagattagacaaatgtagaaaggagtaaatcagattgtgttatattttatttgtaagaaaatgacaaagcttccagttgtgaacattacaggttcaaagccatgccttgtaatctctttggagtttatccaaattaccaaatgataataaaatgtaaactagtctgtatagatatataaagcacgatagtatagaatgcctgtaattgcagcatttgggaagcttctagcttgaactgtgtagtgagacccaacctcaaacaaaacaaacatattaactaggtggagaagacagacctgtaatcccagccctttgggcagtaaaagcaagttcaagaatttgatgctggcccggattgtgtgcatatgagcccatctcaaccaaagttaccatgctgtttgagtgactcgtgcgtatgcatgctgtgatcagaacacaggacaggagcattgctttctgacttactcattctggatttcccttccagaatggtgaggttctggagaatcgatgaggattgtccggtacaagttgcacctttgagcaatggtctttgctgtgccttttctactgatggcagtgttttagctgctgggtaaatacatttttcttgtttctttttcttttgaaaacttatttttcttttatgtatgattctgtaaatttcctagacaaactctttatataatcctgctacttgccttgccttggagttcttattagagtctaaggtgagatgtatggatctgatctacagctgtagggacataggacaagtgtagttgtgtaaccatgattttgtttttccatttctctgaaggacacatgatggaagtgtgtatttttgggccactccaaggcaagtccctagccttcaacatatatgtcgcatgtcaatccgaagagtgatgtccacccaagaagtccaaaaactgcctgttccttccaaaatattggcgtttctctcctaccgcggttagactgaagactgcctttcctggtaggcctgccagacagagcgccctttacaagacacacctcaagctttaccagctcaagcgtctgtccttggaggctcagcagatttatttaattggaatccactcttattcttcatttcattagttggacttttaaagcattatttatacaccatagaaatatttctgaacatatcatgtaatttttttaagataactgtgaaaacattacatacatgtatatatttagacatgagctgctgctatatattgaatgggccctttagttttctcttagttctgacctgtatatattgctttaatagagccacgatttgtatatgtgctgttcattagagcaaattcaggggaatttttgttctttttttttttatttgggggcactaagtttagatgagatgaattgcctcataggaaatggaattggtcaggatagatggtgtgaaactgataagaggttttggatgtgaaaaagagtttccaaaagaatggtgtctgggagtttgaatgtgatgattaaaaaaagagccaaggaaaaaggtagctagaaaaaaaggttggctctcatcagccttaattttggaaagcagctacttacccctcagagaataaagtattatgcattcttgtcaatttgaaaactacatctactgtattattgctgaatattttgttaatactaagggacaattattttaagaccatgggttttgtttttaacatattttatttctgcagaggatattggtaacttaccaaagagaagcaatacacagtatgtctgctttagccttcttttatttatctcatctgcagatgttgagaatgtatgcattatgtaaaatgcttgtttttttatccctgttgagtttttttaattaaacgacacaaaactactacattgccgatatttctttcatgggttgcattgtgtagtccttttgtctagctgtactgtaaggttgctggtgggtccacagatgctcagtgcagaaggcagtgaggaaggatggaagcatgtacaggaagcatcactttgtgcgagcatgtgtgcggtgtgttccaccaccgtgtcctgggtgctgccatagcacccacacagtgttcctcctcaggcacacttaatgctgtagagcaaagaacagcagagcaaaagaagacctcagagcagtggaccgcctcaaagtaagccggcctggttagtgatagaggctgatagtctgggtcctcaagaaggcactcttagccatgtatgatctaaaggctatgaccatccactgagtattgatacgttcatgttggccaagtatatggaagtagttagggaagccagaaaagactaccaagtgcttcctcatggcagcagctatattatacaaaaaacagaggcatctctaaccttaggggttaccccccatttaacttgtatactataattttaaaaataagatttaaaactttctaaaattgtcaaattttaaatatacaaaaaataggattttaaaattataaaaataatctctatgaatatttactttttataaccacagcaaataccagtcctgtaacagtagttgaataatacacactctgcttaagatgcttgcaaccccagtgtcctaagaaaaaaacacaacagtataagacccatgtaaatatgccagggcctccctttgtcttggagggaggggttgtgacccgcttgtggtgctgcatgcccaaagggaggcaggggaaaaaggtggttgggctttttcttggttcagattctagctatgtgattttagattgaggttgcttttttaaaatattccttgccacagccatgccatttggagaactgagaagagattaccattcagatttgattgcctgggcttttgttttgagacagggtttaactatgtagctctccctggatggccttttaacccacagagatccccctatttctgcctcccgggctgatctccccctccattgcctgtaagtgggtatgagtgcaggaaagagtctcctttcataatgatgcataccactttaaggtctgtaacctgatctctggttggcaaaccctcagtttatgatccttgaaatgccttgcctgcttgtgactgagataaagttggattgggctggtctgcactgccctagggcagcaagacctaagatgggatggagggaactatgattcttggtctaggcagtggacttggctgccagccgagctcaaggataggaaaagaagcttgagaagttaaacattgtctcgcacaaccgtgtaggccacccatcacattgaagacctggaggagcctcagcattctatccaggcagctcctaccagcgtctggtcttaggtgcattttagctatagaacacccggttcataaatggatagttcaacgaggctggagaggtggcccagtggagaagggtccgtactgccaacacacatggtggaatagggaactgattggcacgagtgttgtctgacttgtataagtacttcaattgtacttgtggacaccacacacacacacacacacactaaataaatagctacccacaggagcagagctaccgctgcgttacttggtgagcactgagtgccagcatgtcatgttgaggactcagcaaacaagcagacagaattcagatctgatgtgtgagaaaaaggaagaagcctatgccctgcccaacagatgacctttttcaaaacaaaaatgaagctaccacaggatggtcaaatcctcaaatgtatacatgaaggtagcattcaccaaacacttggcatagggcacacaaatccacacctgtgtgtgagcagtactcagccgccacagcactcagttcagtgcaactgcaagtaggttgtttttaaggtactaggataaatgttcttttagtccatctttctatgtaaggctcagtggctgagaacactggctgttctagaagactgctgctcagttcccagaacacaactgttaactccatttctaggggacccagcaccctttcctggcattctccggtaccaggcatgcatacagtgcacagtagagttgttggttatacatgagcttatagtttcagtaagagagcatagatagaatataggtgcctgtgcgctggctcttttggttgtatttaaatcctttatctctgagaagtgttgggagccgcccccacattcgccgtcacaagatggcgctgacatcctgtgttctaagtggtaaacaaataatctgcgcatgagccaagggtattttatgactacttgtactctacctttcccgtgaacgtcagctcggccatgggctgcagccaatcagggagtgatgcgtcctaggcgaaatataactctcctaaaaaaggggacggggttttccgccattctctctcgctggcatctctctggctctgcgcgccctgcgctctctcgctgcctaaagatgtaaacaatagagcacgctctgcgctttggcgcgccggagctctggctcctaaaattattgaaggggctttcgtttttggggctgggggtttttgcactcctgctcctgaagatgtaagcaataaagttttgccgcagaagattctggtctgttgcgtctttcctggccgggcgtgagaacgcgttaataacaattggtgccgaaacccgggacgagaaattccgggacgagaaaaaatccgggaagaaaaaacccgggaagaaactcgggacgggagtttcaccggcgcaagaaagatccctcattccagaaccagaactgcgggtcgcggtaataaaggttcccgtaaagcagactgttaagaaggattcaactgcataaattcagaacttttcagctggggaacggcggtaacccgtaagtatagctttacgaggtaagcctggccttgaactttctaaggagattcaagacagtctatcagaagtaaagtagaaaatagctttataaggtatgtttggccttgaactttctctagtgttagaagcccttttgttccttttcacatgttatcaagtggttaaggcagggcggattctggatgaagttcaggacaatctatcagaagtaaagcggggagagagagtaggagcaaagagaaaatatggtacacaaaataagcatacaggcctttccaagggtcttgaacctgaggaaaagtttaggtcaggtaagaatacctggggagagattagaaggaaggagaaggaaaaagaaaagaaaaaagatcaattagcggaggtctctaggagaaggagcctatactcatcactaggtgagctcaaggagccagttcttaatagttctgaatcagatgaaaaggctattagggcctggaaggcgctctcccgagcaggtgaagccactggacaataatgacagaggcaggctcttgcagcctacaaggtcttattgtccaccctggagttgtagatcaggattgtaaaggggaacttcaggttctctgttcttgtcctcaagttgtcttttctatatcacaaagggacaaaatagctcaactaataattttgccaagcctacatggctgttttttcttcctctggtattcctagagctgccagagggattggttctactagaaatgattctgattacttaataatgcctttagattgttgtcaaattttatctactcacgtaggggtaaaccctcgtggcgtcaggccattacaggtctgacaaatggatgtcacgcatatttcctcctttgagagaaatcaatatttacatgtttagaagaaacccacttaaaaatgggattgtggtatatactgatggatcaaaaactggcataggtgcctatgtggctaatggtaaagtggtatccaaacaatataatgaaaattcacctcaagtggtagaatgtttagtggttttagaagttttaaaaacctttttagaaccccttaatattgtgtcagattcctgttatgtggttaatacagtaaatcttttagaagtggctagagtgattaagccttccagtagagttgccaatatttttcagcagatacaattagttttgttatctagaagatttcctgtttatattactcatgttagagcccattcaggcctacctggccccatggctctggaaaatgatttggcagataaggccactaaagtggtggctgctgccctatcatccccggtagaggctgcaagaaattttcataacaattttcatgtgacggctaaaacattacgcagtcgtttctccctgacaagaaaaaaagcccgtgacattgttactcaatgtcaaagctgctgtgagttcttgccagttcctcatgtgaaaattaacccacgcggtattcgacctctacaggtctggcaaatggatgttacacatgtttcttcctttggaaaacttcaatatctccatgtgtccattgacacatgttctggcatcatgtttgcctctccgttaaccagagaaaaagcctcacatgtgattcaacattgccttgaggcatagagtgcttgggggaaacccagactccttaagactgataatggaccagcttatacgtctcaaaaattccaacagttctgccgtcagatggacgtgacccacctgactagacttccatacaaccctcaaggacagggtattgttgagcgtgcgcatcgcaccctcaaaacctatcttataaaacagaagaggggaattgaagagattttaccccgagcaccaagagtgtctgtgtctatggcactctttacactcaattttttaaatattgatgctcatggccatactgcggctgaatgtcattgttcagagccagataggcccaatgagatggttaaatggaaaaatgtccttgataataaatggtatggcccggatcctattttgataagatccaggggagctatctgtgttttcccacagaatgaagacaacccattttggataccagaaagactcacccgaaaaatccagactgaccaagggaatactgatgtccctcgtcttggtgatgtccagggcgtcaataataaagagagagcagcgttgggggataatgtcgacatttccactcccaatgacggtgatgtataatgctcaagtattctcctgcttttttaccactaactagaaactgggtttggccttaattcagacagccttggctctgtctggacaggtccagacgactgacaccattaacactttgtcagcctcagtgactacagtcatagatgaacaggcctcagctaatgtcaagatacagagaggtctcatgctggttaatcaactcatagatcttgtccagatacaactagatgtattatgacaaataactcagctggggtgtaaacaaaagtttccgagattgtgtgttacttccattcagtatgagaaatttactaggacagctaatttgtcaaaaagtctttttcagtatatgttacagaattggacggctgaatttgaacagatccttcgggaattgagacttcaggtcaactccacgcgcttagacctgtccctgaccaaaagattacccaattggatctcctcagcattttccttctttaaaaaatgggtgggattaatattatttagagatacactttgctgtggattagtgttgcttctttgattggtctgtaagcttaaggcccaaactaggagagacaaggtggttattgcccaggcgcttgcaggactagaacatggagcttcccctgatatatctatgcttaggcaataggtcgctggccactcagctcttatatcccatgaggctagtctcattgcacgagatagagtgagtgtgcttcagcagcccgagagagttgcacggctaagcactgcagtagaaaggctctgcggcatatatgagcctattctagggagacatgtcatctttcaagaaggttgagtgtccaagtgtccttctctccaggcaaaacgacacgggagcaggtcagggttgctctgggtaaaagcctgtgagcctaagagctaatcctgtacatggctcctttacctacacactggggatttgacctctatctccactctcattagttgggtggcctatttgctcttattaaaaggaaagggggagatgttgggagccgcccccacattcgccgtcacaagatggcgctgacatcctgtgttctaagtggtaaacaaataatctgcgcatgagccaagggtattttatgactacttgtactctacctttcccgtgaacgtcagctcggccatgggctgcagccaatcagggagtgatgcgtcctaggcgaaatataactctcctaaaaaaggggacggggttttccgccattctctctcgctggcatctctctggctctgcgcgccctgcgctctctcgctgcctaaagatgtaaacaatagagcacgctctgcgctttggcgcgccggagctctggctcctaaaattattgaaggggctttcgtttttggggctgggggtttttgcactcctgctcctgaagatgtaagcaataaagttttgccgcagaagattctggtctgttgcgtctttcctggccgggcgtgagaacgcgttaataacagagaagtcggaactgttgacaacagacaatatggtagccactggaaggaatgaagattatcataaccttggtgtgtgtttatgtaagctgttctgggctaggttcggtggttaagaaagtttgttgcttttgcagaggacctgagttctggtcccagaacccacttgacagctcacaactataactccaattccaagagatccaacatcttcctctgaccttgggcactaggcacatctgtggtgtgcatccatccctgctggcaaagcacttttacacacaaaacatctgaaacaaaacacactaacaaaccagaacaacaaccatccttgctctaaaagcttgcatttatccaaaagcaaaagttgggtctgcaccaggggtgaagtgagactgttacaggagacgtggagccttatgtggctgttagtaatgctagcagtatgtatgagccaactgattagtatgttagagccaattgatgcttacgccgtggctcactgacagaagtcaactttcagcctggggaactgctcagtggtcgtgtgcttctccagcatgctcaggacctccagtttcaacctacaccaccacaaggggaaaaaaggagaaaagaaaagaaactttggggctggagaaatggctcaggtagtaaaatgctgagaacctgaattcagatacctagcaacccatataaaatgccaagtgccaatcagtatttccagccctggcgagacattcctggagctcactggccagtcattctacccaaatcaggggagagaccctgtctaaagaaatgcagtggagggctgtcagagaagacactcaaatgctgcccgtgaccccacataatcacacatagtgaagttctctacctgtgcaataaaggggaaactataaagtcatctactgcaggtccagaagactgaagtggctatcccagtaggttgtttcccagttgttgatggataatgccgtgttatgatgcagtggagagtatgcgttgttactcagcactgcaggctgaggtgagtcagtcactatcacggagggtgaggaggcctgagagtgaggatatggaacagagtcaggaccgaggcaaatgtaaacagagccacggggccctaaacacaaaagcgaaatcagaaagttgcatggtcctgtgtccatcctgacagtgactaaggaaaaggacgggatacgttaggaagtggatcctaaccaccaatccgttaacatgtggtgttgttcatcctgatgagatgacattagcaagtgaggacttgggaaaagtcatgagggcaggagcccgcttaatggaatttgtgcctttataagtcctccacactgctaagacaggagaagggagtgaaaggggctttcaccagtccccaaccgtgctggctcctgggtctgacttgcaacctccataattgtgagaagggtgcgttgtatctaaaccacctacctagtctctgtgtgatttgtgacaacagggcaaacagacctgcaagaacgcctcctgatatgagccgggaagaagtcctgctaagacacaaagctagccactctgtctgtgtgctcctctactaataaggtttgaacctgaaaatccctccacaggctggttttgagggttactttaaatgttgtaacccctaaaggttgtagggtctgtttggtggaacccggtcactgaatgcaggggagttgtggaggttatacctacccctacctctggcctagctctacttcctaatctgccaccttgtgaacaactgtggcctcgtgttcccaccgtcatgccttctctgcctgctggaccaagtgacacaggatatttgtcccttaagttgattccgtcaggagctttggccacggtaacatgaaagtccgtgacacgccccattatacctgcctctgcagaggggtcaggtttcctcttggatgatattatattatattggtagagctgggcagagaaccagccgactcgtgtgagccttctgtgctgcaagggtctgcagtaactggaaagtggtcaggaaacccacaagtcagaggtggccccctcaccccaccccatcccaccccaccccgctgcctctattttctctcagcctgttttgttttcttcaatttcgtcaggccccttcggtggtgccggataagctgccccagctcactgccgtcttgccacggaatcctacgcgatctcatttcttcaccccctccttggactttcgaataaagccctgtttcaaataagttaatcattcttagatgttgattccttgtttagaagccaaattcctcacacctgaggagattctgtcgccttctcacgggagctgctggcgcctggcttt

SEQ ID NO: 536 - DNA, 1266 bp, Mus musculus
atggccagctttcccccgagggttaacgagaaagagatcgtgagatcacgtactataggggaactcttggctccagcagctccttttgacaagaaatgtggtggtgagaactggacggttgcttttgctcctgatggttcctactttgcgtggtcacaaggatatcgcatagtgaagcttgtcccgtggtcccagtgccgtaagaactttcttttgcatggttccaaaaatgttaccaattcaagctgtctaaaattggcaagacaaaacagtaatggtggtcagaaaaacaagcctcctgagcacgttatagactgtggagacatagtctggagtcttgcttttgggtcttcagttccagaaaaacagagtcgttgcgttaatatagaatggcatcggttccgatttggacaggatcagctactccttgccacaggattaaacaatggtcgcatcaaaatctgggatgtatatacaggaaaactcctccttaatttggtagaccacattgaaatggttagagatttaacttttgctccagatgggagcttactccttgtatcagcttcaagagacaaaactctaagagtgtgggacctgaaagatgatggaaacatggtgaaagtattgcgggcacatcagaattgggtgtacagttgtgcattctctcccgactgttctatgctgtgttcagttggcgccagtaaagcagttttcctttggaatatggataaatacaccatgattaggaagctggaaggtcatcaccatgatgttgtagcttgtgacttttctcctgatggagcattgctagctactgcatcctatgacactcgtgtgtatgtctgggatccacacaatggagaccttctgatggagtttgggcacctgtttccctcgcccactccaatatttgctggaggagcaaatgaccgatgggtgagagctgtgtctttcagtcatgatggactgcatgttgccagccttgctgatgataaaatggtgaggttctggagaatcgatgaggattgtccggtacaagttgcacctttgagcaatggtctttgctgtgccttttctactgatggcagtgttttagctgctgggacacatgatggaagtgtgtatttttgggccactccaaggcaagtccctagccttcaacatatatgtcgcatgtcaatccgaagagtgatgtccacccaagaagtccaaaaactgcctgttccttccaaaatattggcgtttctctcctaccgcggttag

SEQ ID NO: 537 - protein, 421 aa, Mus musculus
MASFPPRVNEKEIVRSRTIGELLAPAAPFDKKCGGENWTVAFAPDGSYFAWSQGYRIVKLVPWSQCRKNFLLHGSKNVTNSSCLKLARQNSNGGQKNKPPEHVIDCGDIVWSLAFGSSVPEKQSRCVNIEWHRFRFGQDQLLLATGLNNGRIKIWDVYTGKLLLNLVDHIEMVRDLTFAPDGSLLLVSASRDKTLRVWDLKDDGNMVKVLRAHQNWVYSCAFSPDCSMLCSVGASKAVFLWNMDKYTMIRKLEGHHHDVVACDFSPDGALLATASYDTRVYVWDPHNGDLLMEFGHLFPSPTPIFAGGANDRWVRAVSFSHDGLHVASLADDKMVRFWRIDEDCPVQVAPLSNGLCCAFSTDGSVLAAGTHDGSVYFWATPRQVPSLQHICRMSIRRVMSTQEVQKLPVPSKILAFLSYRG

SEQ ID NO: 538 - DNA, 39522 bp, Homo sapiens
  misc_feature (1)...(39522): n = A,T,C or G
acaatagcttcatcatctgtaaaaggtaatactacatgatctggcctctaaggtcatttctagctatgagtctgaaaatgattctatgcctctgaaacattagtttaaatgcctgttcttaaaaactcctaaatatttattgaagataacctcttcaatacacttatttttccatctgcaactaataagcaaagtcacacaaaacagtagtgcttacttctcttggaggatacttccaagaccctagtagatgcctaaacctgcagatagtactgaaccttatgtatactatgttttttcttatagatacctatgataaagtataatttataaattaggcacagggctgggcgtggtggctcgtgcctgtaatcccagcactttgggaggctgaggcaggcaggtcacctgagatcaggagtttaagaccagcctggccaacatggtgaaaccccgactctactaagaatacaaaaattagctgagcatggtggtgcacgcctgtaatcccagctacttgggaagctgaggcgggagaatcgcttgaaccccagaggcggaggttgcagtgagccaagatcacccagcttgggcaacagagtgagactttgaaaaaaaaaaaaaggaatctgaaaaaaaaaaagaaaaaaccaaattcagtaactaaaacaatatggaagattaaaaagaactgaaataatgtggaggagtcagtcagaagttccttagcctaaaaaaaatactatgacctatattctagcaagtaaagatagcaatagcagatcttggattcaaatccattgtaccaggacaagactggctggcaggggtgaaatcttgaggagagatagcctgtgacctgtcactaggactctctgagacccttgaagaggattcaaattccagcccatgtcattgcaccagaagtgggaaacagctgactaaaaagcttgccaaaaaagccgggcacctggagataagactcaggaagcgttttccaaacaagaaacaaaagagtgaaggaggaggccacgaaagagaaatcctggagttgtatgcagttggtgaaggatcattgttttcttcctcgcaatctctgtggaatggtcacaggcaaaaacatcagaaaatgaaagtgcagagctctattagaggaagaggaaaattattgataggaggaaaatctccatcatcgcatggaatattccattttacacagatttcttctgaaggtcaaggactgaactaaaggacacagcctgcatgtaactgccctgagtttgggggtaaggagaggagagggagctgggttatctcatcagtgtgtataggaaatccaacagagcaatagagatggggggcctctgcttactcttttttttttttttttttttttgagatagggtctcactctgtctcccaggctggagtgcaatggcacaatcatggctcactgcagccttgtcctcctgagcttaagcgatcctctcacctcagccacccaagtagtagctgggactacaggcatactaccataccagactaattttttaaaaattttgtagagatgaggtgtcatgttgcccaggctggtctcaaactcctggactcaagtgatcctcccgccttagcctcccagagtgtcaggattacaggcctgagccaccacacccagccccactgcttactctttcagatataatttcctgtaagcctccagcattctggcccagacacagatgcagaaacatctagactggctgcaccattttccacactttgagcctttttgggtacagttttaaactaagatcaaagtatacatctttgaaaacccaatactaatattctgctcaaaccacattgtcaaaacaccccacacaaaaaatgtgaaatcagggaaaaagtgaaaaataagacagcagggtaaaaatgggggcactattagatatttcatccccagcaagactaccaccgccaaaagtggttgccttcagaattttcctctgggtcctcttatttttccagcatttccacaattacaaagatatctattactatttattaatgtacatgcttatgtgtataaattgtacttgcccagctgaatcctgggcaaattccatatcctttcattctagaatcccagacttagtgccacaaatcccatgatttgaaactcctggcctagaatccaaaccctgcataattttgtatgcatccttagacttagcatggagaagttgtaaaaacaatgcaatagcagagaggtccaaaaagcaaaaataagcaactctcctattgcttaagcaatgcatgctgtgcaaggcatttttaattgttttttgtttggacttggtcaggacagagtcaaaacagtatgataggctttttttttttttttttttttttgtgagacagagtctcattctgttatccaggctggagtgcagtagtgccatcttggctcactgcaaactccacctcccgggttcaagtgattctcctgcctcagcttcccaagtagctgggattacaggcacccactaccatgcccggcaaactttttatatttctagtagagatggggtttcatcatgttggccaggctcgtcttgaactccggacctcaagtgacccgcccacctcagcctcccagagtggtgggattatagacgtgagtcactgtgcctggccatatgataatcatttttatctttgagatttgaccacactaggaaacaataaaatattggcattgtgtttgttgagtttggttttttggtttttgggcttaaaaaatttttttttttggtggtagtgggcttcattcaattctctgttacagaatttattagcttttctattttattcatgtgtggttttttctttattttctttattttttttaaagacgaagtctcactgtgttgcccaggctgcagtgcaatggtgtgatctcagctcactgcaacctccgcctcccaggttcaagtgattctcctgcctcagcctcccaagtagctgggactacaggcgcccgacaccacgcccagctaattttttgtatttttagtagacacagggtttcattacgttatccaggctggtctcaaactcccacctcagcctcccaaagtgctgggattacaggtgcgagccaccgcacctggcatgtggcttttgttttaagtaaatgttgctttcttttagttataggaaggggatatttcctttcttctgtcaccaaaatataggttcaaaaataagaacctgcaggaatccttacgaattttaaatttatttagaggtttgtctgcaacttcagagctctatatggatgcatatcctgatagcaacccacttgaattgctcaacaaaaagaccacagttgtgaactggatacattcatggtatcaagggaaatatacctgtaatgtctataggaataatgaaaagttaattataggagaagcccagtcctccgcgatagtaagtattgtgaagaaaagaaaaatgttcaatgccaaatgaagtcaaagttacctacagtgatgtagtaaaaagtgtttgtttgttttttgaggcaaagtcttgctctgttgcctagggttgagtgcagtggcaagatctcggctcactgcaacctccatctcctgggttcaagcaattctcctgcctgagcctcccgagtagctgggactacaggcatacaccatcacacctggccaatatttttgtatttttagtagagacagggtttcaccatgttggccaggctgttcttgaactactgagctcacataatctgcccgcctcagcctcccaaagtgctgggattagaggcatgagccaccactcccagctaatttttgtatttttaatggagacagagtttcaccatgttggtcaggctggtcttgaactcctaacctcaagtgatctgcctgcctcaggcaaagtgttgggattacaggcatgagccaccacttggctgaaaaggttttttaatacaggaaaacattattttatgataggaaagaaaaggcaagacacaaacttttaaattgtaatctactccaaatgctaattatttccatatgcatagttatattcactccccctgaacaaacgaatgtgactattgttccacctctttaatgcttctgcacctccctgttcatataagaaaatggtgtagaaaaagcaaaggtataactacatgaaaagcctgcctgtttatacaacattttgctgagatgtgagataatagcatgatggaggatgcatatacagttacatatacaggttgaatatctctcattggaaatgcttgggaccagaagtgtttcagatatcagaatatttgcatacacataatgagctatcttgaggatggcactaagtctaacatgagtctaaacatgacatttatttatgtttcatatacatcttacacatagactgaaggcgattttatacaatttttttttttttgagatgaagtctcactctctcacccaggctggagtgccgtggcacgatcttggctcactgcaaccgccgcctcccaggttcaagcgattctcctgcctcagcctcctgagtacctgggactacaggcatgcgcccccacacccggctaatttttgtagttttaatagagacggagtttcaccatgttggtcttgaactcccgaccttgtgatctgcccaccttggcctcccaaagtgctgggattacaggcgtgagccaccgcgcctggccttatataatatttttagtaattttgtgcacaaaacagagatttgactgcgcaaacttttttttctctttttgaggcagcatctcactctgtcacacgaggttggagtgcagtgctgcaatctctgctcactgcaatctctgcttactgcaatctctgcctcccaggctcaagagatcctagcacctcagcgatcgaccccagctaattttttgtatttttggtagagacggggtttcaccatgttgcacaggctagtcttgaactcctgagctcaggcgatctacccacctcagcctcccaaagtgctgagattatggctgtgaaccactttgcccagcctgtacaaacttttgactgtgacctgtcacatgaggtcaggtgtggaattttccacttgcagcatcatgttggaattcaaaaagctttggattttgtagcatttcagattctcagattagggatgctcagcctgtatatgtatatgtgtgtgtgtgtatatatctcaggataataaatgttggtaaaaattatgggtaaattggccttaacaaataactatataacagtgatgttttttgaataattcaagaatgagattcaagagaatgggattttagtggttgggtcagctttgtttttgaaatgaatgctttctagaacttttgtttattattatttatttttatttatttatttttgagatggggtctcactttgtctcctaaactggggtgcagtagctcaatcacagctcactacagtcttgactttaccaggctcaggtgatcctcccacctcagcctcctgagtagctggtactacaagtgcgtgccaccatgcccagctaaattttttgtattttttttgtagaagcaaggtttcaccatgttgctaaggctaatctagaactcctgggctcaagcaatctgcctgcctcaacctaccaaagtgctgggcttataggcatgagccatcatgcctggccttttatttattgtttcaattgtacatatacttaatgttatttcacagctttttgccaaccctctattttctatgagattttgatctttcagttttgcagttagctaggattactatatataaaaatagtatttaacacatatatagtactctgtgtcaggccctgttgtaaatactaatcctcaaaactgtgaagtaggtattattactatccccattttctggatgagaagactgaggcacagggaggctaaattatttgtctaaagacatgacattactaatacaactttttaaggggaaggaaataacaccaaggtgtcaatggtggtttttcagggtgtggggttataaaggattgttaagaggattgaaatgacaagatcttgaactaagcccatggcagctgagctgggacagacaggacagactctagaacagtttaagataaaatattggcaagccttgtggattggttgatttcatgttgggatgaggcatagcagggaagctaggaagactcacctctggcacctgtgactgggtggacatttcactagagtaggaaatacaaaagatggagcagactgaggagaaatgatgtgttcagttttgacattttgagttttattgtaagcatttgaacatgtaaattttaaacttaagacaggccgggctcagtggctcatgcctgtaatcccggcactttgggaagccgacacaggtggatcacctgaggtcaggagttcgagaccagcctggtcaacatggtgaaacactgtctttactaaaaatacaaaaattagctgggtatggtggtgtgcacctgtaatcccacctactgggaaggctgacacaggagaactgcttgagtccaggaggcgaaggttgcagtgagctgagatcgcgctgttgcactccagcctgggtgacaaagcaagactccgtctcaaaaaaaaaaaaaaaagacggaagttagctctcaacttgagggtcttcacacagagctggtatttaaacccaagaaagaggttgccatcacccagggagactgcgaaagaaggaaaaaaaaaaagctgtgggccaaggacagaactctagagaaccccaacatctatgcgacatgtagggaataagaagccccttcagatttgacattaaagtagcaaacacagatatgaaatgccaggtatatatttgcttttcaagctaggtttcatttatgagaggcaaggtagcatggaagcagggcagtcaaacaagtctgagttcagatctagcccctgcagcttactctgtcctgtggcttctcaggttactaagtgtctatgaaatgtatgtcaatacactgtatgtgcactccagccagggcgacagaatgagactccatctcagggagaaaaaaaaaaaagaaaaagtcatcacaataattcactgatggacactcaagaactggtatttcccatgaatttgtatggtatagtacaagtaacagggataatagcagttggttaaaagaattaactgagatggatataaatgttggtatatgagctacaagactgcattaaagtttttctgtaatgtatgtcaatacactgctcatatgttgtgagcatgaaatcggttaatccacagaagcacttatatggctcagtgcttagaagtatctattactaatgagtacacaaatcataaaattatttttcattccattgtcatgctttgccagttgagaaaatggccaggaagtctgttggcttgcaggaataaactaaaatagaaattaaacaattgtattaaaaagtctggccggggtggctcacgcctgtaattccagcactttgggaggccaaggcgggcagatcacttgaggtcaggagtttgagaccagcctggccaacatggtgaaatcccgtctctactaaaaatacaaaaatcagccagccatggtggcgtgtgcctgtaatcccagctactcggaaggctgaggtaggagaatcacctgaacccaggaggcaaaggttgcagtgagccgagatcgtgccactgcactccagcctgggcgacagagtgagactccatctcagggagaaaaaaaaaaagaaaaagtcatcacaataattcactgttggacactcaaaaactggtatttcccatgaatttgtatggtatagtacaagtaacagggataatagcagttggttaaaagaattaactcagactgatatgaatgttggtacatgagctacaagactgcattaaagtttttcttttgttctactctaaaaattcagcaactaggcccagtgcctgatacagagtgagtcctcaagatatcgttgactgaagctaacaaagtgatttattgatttatttatttattgagacagagtttcactcttgtcacccaggctagagtgcagtggcgcgacctcggctcactgcaacctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaaaaggatgaaaaaaattagctgggcgtggtggcagccacctgtagtcccagctactcgggaggctgaggcaggagaatcgcctgaacccgggaggcagaggttgcagtgagccgagttggcgccactgcactctgctctgggagacagagcaagactccgtctcaaaaaaataaataaataaataaccaaaaaaaaaaaaaaggaggggcgatgttttattaaacatttcgctatttgaagaattaatacactcatgcaaagaaaagatgaagtaaacatgccctacagtgttatcatttgagatctcttaaaagcggctatgcagccgggcgtggtggctcacgttgtaatcccagcactttgggaggctgaggcgggcggatcactcgaggccaggagttcgagactagcctggccaacagggtgaaacgccctctgtactaaaaatacaaaaattacccgggcttggtgtcacatgcctgtacaaatcccagctactggggaggctgaggcaggagaattgcctgaacccgggaaacggaggttgcagtgagccaagatcacgccattgcaccccagcctgggagaagcgagactccgtctcaaaaaaaaaaaaaaaaaaaaaaaaaaaagcggctatgcaacactctactctgtcccatgaatatctgccacatatttgaattcccagtcttatacgccccaggcctttgcaatgtttagggtccacacgagaagccattaaaatgcaaatacgtcatctgtgaccgggaaccaagctggcatctagcagatactgacacatttatcagtctgatgtgtggacaactaggtgcctcccagaggccttcaggtaaggtggaggaagggccaattctgagctgacacagtgggatccatcttggccaggacagtgggatccatcttggccaggacaaaggcagtccagagaggccccgcggcgcggtgcggcgcgatcacgcccgagtctccttctcgttcccctcggcccttcctaaaacctgctggctcaggtctgaacaatcgcagctggacaggtggtgcacaacgatgttaattttcatcctgtctttttcatcagtgcatccttcagttccctattacttgtgggctggggagttggccaaattgagtgaaaacctgaaatgtctttttgttcttttggttcagccagtttaagttccatgcaatctttaagctaggaggctaataataatacaattctctgcttgcccttttcaaagccacttcagcttataaactccatattagaccatccaggcccagaagacgccaccggcctacaggcagagtcagcggaaccagcctgggctggatctccccctgcgaggcccccaggcaacgcccgcgccgggccggggagatcacgtcccgtgcgtcgggaggcgggggcctcgggctgtgacgtcacgtggccgcgcccctgccgcccagatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcggtgaggattgggaccgtgggtgggcgcatgagggccgaggagaggcagggactccccggaggaggtttgggaggaagcgactccaagtctgagggaagagctccagtgcgccagggccagcccactagcgaggaggaggaagccgcctcggtgggagttggctgaggggtaaacggcaccgacgtggatgcagcacctactgtgctccctcgcggttgctgtgtggctggggcgggcaaggaccccggtttcttcgtcggaggtccgcgcagggctcttgtcctgggagttcttggctcagggcatgactgtcgagtggacagggaagggccactcagggactttaggtttacaatggggaaaagtaaacttgtgggttgtaagcggtaatgaaaggagggggtcctcgtgtgtaccaaccactcttagatagaaatgagatggaagaggtcccaacagcctggcaaaagcaatacagtatttttaaaatggtgtggccttaagaaacgcagcggttcgggggaggagacttttagaattatctttcaaacacttaagggaggagctgggtggttgggtggagtgacagaaggaaagcttttgtgcggaagaggaaactctggaaaaggcttttctggcttagtgtctatccctggtcggcttagtaaagggcaattagtgttgaaggttgtgcgtccacacctacttagtggctcagtggaaagcacgtcgcattatttaaatcctcttttaaagtaaaataactggaacaacgtttgacggtgttggggggtgctgtacattggctgataacacttagcaaacactgatcttactgtgtgaagtaataattagctgcggccgctgagcagagagcatttacattttcctactcttgaagtgaatgtgtgcctttactaagtacaaggaggagttatttctagagaagggaagaggctgaagtagccaaaacgcgcactattttgtatgtgggtgaatttttatatctagaaacagctgttttagaattctggacttttgttgtcttagggatgattgattaggaagggactttaaccctggttttaataaccatttttaaagatacaaacacagaaaaaaaagggaaaaaattgtagcagagttcacacagaaaaaagaaaaaaaaagatgcaaagaacacaaaatttgtgtccagttattattttaactgtattttaagactagaaagtatgtcgcgaagtgggacaaagaactcaaaagttcttatcagtccagtgggtttttcttttactttagtacaccataatgttatagacgagtgatctgccttttttttaaatctgtattttacttcatcctgataaaccattttgaaaactttgcggtcctgttttctctctctctttttttttttttgagatggagtttttgctcttgttgcccaggctggagtgcaatggcacgatctcggctcactgcaacctccggctcccggtttcaagcgattctcctccctcagcctcctgagtaggtgggattacaggcatgcacacgcccggctaatttttgtgtttttagtagagatggggtttctccatgttggtcaggctggtctcgaactcccgacctcaggtgatcgcccacctctgcctcccaaagtgctaggattacaggcgtgagccaccccgcccagatttccggttttgttttctaagagatggatagagatggatagcatacctacataaagtagaaccatccactaagtgttcccccactagccccctgatttctcttttcttttctttctttttttttttcatatttaggtctcagtgttatttcctggatacgttataaaaacttactagctaagtgccagatatctagaagaacttttgctttttctgagctttttttaaccccagtttttttctttgtttctttttttgaattatcatttggatacaaggttgaacatttctctgcgtagctttttaaatctatgaataaggatttactttttttcttttcttgggtgttaattaaaagccaagccaagtttagtttctcaaggacatacggagagtagaggcaagatttccatgaatgattaaataattctgtgatactactgccttgagctactgccctttttcacaaggcactgccacagatcatccctttctggttatgaaattttggggaggaatgtaaagaaggagctaaatctggtttgcttggttcagcagtgactcagatggtatgttactgttttacagatattaataatgtagtgttgtatcttacggctgatttcccatggcagcctttcccttaataaggtcattaaatcatacatttctgttgctaacattaaacagttacagataatgtaataaaggtttaacttaaaaattttttttcaaagcactttattacaaactttgtgctaggtttataaaattgtaccagtatttaatctgagcacttaaatcattttattaaagtgccaaaggcaatttgatatacctgttatccagcaaagaaacacaaggcaattattagtaaattttaacagattaatgcatttatttggtaggttttataatggctctatttcttgagtttgtatatatttgagaattatgttataaatatgttattatttcattgtctttgctatctatttgaaccaattttttagtaattgttaccgctcttttacttttttttttgttcctttgagactgagtctcgctccgtcgtccaggctggagtgcagtagcgcagtctcagcttactgcaacctccacctctcgggatcaagcaattctcctgcctcaccctcccgagtagctgggattacaggttcgtgccaccacacctggctgattttttgtatttttagtacagatggggggtttcaccatgttagccaagctggtctggaactcctgacctcaggtgattcaccctcctcggcctcccaaagtgctgggattacaggcgtgagccactgcccccggcctactctttttttttttttagacagagtcttgctctatcacccaagctggagtgcggttgtgaaatcttggctttctgcaacctctgcctcctgggctcaagcaattctcccacctcagcctggtactacaggtgcatgccaccacactcgctaattttttaaattttttgtagagatgaggtcccctatctatcccaggctggtctcaaactcatgggctcaagtgatccatccaccttggcctaccaaagtgttgggattaccagtgtgcctgtcctattaccactatacacaaggagttccatgattgtggtcaaggtagaagaaaaatatagagtaaccttaaaatacagtctaggctgggcacggtggctcatgcgtgtaatcccagcactttgggaggccgaggtgggcagatcacctgaggtcaggagttcaagaccagcctggccaacatggtgaaactccgtctctgctaaaatatacaaaagttagctgggcgtggtggtgggcatcatgatggtgcatacctgtaatctaagctactcgggaggctgaggcagggagaattgcttgaacccgggaggcagaggttgtagtgagcggagatcatgccactgcactccagcctgggcaacagagcaagcctccgtctcagaaaaaaaaaaaaaaaaaaaaaaagtcacgtatgagaaatttaagtcttgcttatgcttgctaagggagagcttaattttagtctcatttactagatgttcttgaaattgaatgcaagggctgttcctcgtatacaagttacataaatattctccatagagacttttaagttgaattttaaaacttgcttcccttatttgtgaacttagcatttttttcctcctaaaaatgcttgtaaaatgtttttaaaatgctttaaaaatgttttcaaagatagatgtggttaaacaggaatccaagttaaaaaaaaagtgtgcctgatgcagtgggtcatgccttaatctcaccgctttgggaaaccaaggtgggaggatcgtttgaggccaggagctggagaccagcctgggtaacatagcaagaccctgtctataaaaaattgtttttttgccgggtgcggtggctcacacctctaatctgagcactttgggaggccgaggcgggcgggtcacaaggtcagtagttcgagaccagcctggccaacatggtgaaaccccgtctctactaaaaatacaaaaaataataataataattagccaggcatggtggtgcacgcctgtaatcccagctactcgggaggctgaggcaggagaattgcttgaacccaggaggcggaggttacagtgagccaagatcaagccactgcactccagcctgggcgacagagcaagactgtcttaaaaggaaaaaaaaaagtttgttttttgtttttgtttttttcagttagccaagtgtgggggcatgtgcccgtagtccctgctacagctactcaggaggttgaggcaggaggatcatttaagcctacgagtttgcctctgcactccagccttggcaacagagcaagaccctgtctaaaaaattaagcaggcaggggttgcaaattcagaggccaggcatataaagaaccctggtaaaaggaacaaataaggctgtaggtttgggaaaattgtaaggaaacctggagcagcatgctctttctgaaatcatttgtatgttaaaggtatctgcaggcatttgagggtcaccaagtttgtgaattttgtattaagaaagttatgtggctcacatctgtaatcccagtactttgggaggctgaaggtgggaggatcacttgagcccaggagtttgagaccagcctgggcaacaaaaggaacacctacctttacaaaaataaaaacattaaccgggtgtagtggtgcatgtctgtggtcccagctacttgggaggctgaggcaggaggatcgcctgagcctgggagttcaaggctacagtgcgcagttattgtgctactgcgctccagcctgcatgacagagcaagaccttgactcaaaaaaacaaagttatgtgacggctagtaaagttaatgtcatcttatgctgtgctaatatggggtgggtgggggactctgctgctttgattaaaccacacctgaagtattgtggttagttctgggtgccacttttatgagggccagtactaactagaatttatccagaaaagtatgatgaagttaggatgggaaatggacttgaaaccatgtgatctaaggtatgattgaaaggatagagatctcttagcctggtaaaaaagattcattgatggctatcttcaatatataaatgccatatgaggatagcagcaggcttattctcttaggtcagaatcagtactgagtgggtagagtggtaggaggaagattttgagtcattaaaaacggtctcagttgcaccaaaatagtgtaagccttattatgaatatcatagaaaagtaggtctcaggctttttgtttttgctttctaaaccacacctatttgttaaggtgtcaagaattgggcagataacatatttaaatcactttagaatgggagcataaatgtgtgctttcatattcattccgtaaatatttactgagcacctgtcatatgccaggtgctatactagctgttgatggagcatacattcaggctgaagaagtacattttgggggtgggtgtgtccatgtccaggttctctagctatatcagtgtaaggggttcttatgtgaacagcaataacatagaatatattaaagcttaggtgttggaaagtttaaaccagaaatacataaaaatatattattatacagtgtacaattgaccagacaactgaccacaaaataggtaatagggaaaattaagaccaacccaaaataggtgatacactgataaagaggctcctttccccaaattgaggaaattgtagctgagtttgcatgcatgcattgcagtatgagcttgttgatcatgctttttgttaaatatggaagtaatattctccatatactctggtaatatgccaatttttgttaggaatacaaaatttgagtaatctgaatttaaaatatatgacattgtccattttttgtccttaaaaaccaaaataattccatttttgagtcagtttgaggcctattaggaagactcttaaggaccagtatttgagaatcacaaatataatgcattttggttttttttgtttttttttttttatgacagtcttgctctgtcacccaggctggagtgcagtgatgcagtcttggctcactgcagtctccacctccaagattcaaacagttcttatgcttcagccttccaagaagctgggattacagacacactccagcataccaccatgcccggctataatgcattttcttttattttagcttattttttttttgagatggagtctcactctgtcgcccaggctggggtgcagtggcactttcttggcttactgcaacttccgcctcctgggttcaggcaattctcctgcttcatcctgggattacaggcgcccaccaccacgcccagctaatttttgtatttttagtagagacagggtttcaaaccatgttggccaggctggtctcaaactccagacctcaagtgatccgcttgtcttggcctcccaaaatgttgggattacaggtgtgagcaaccacacgcggcctataatgcctttttaaagcactggtttggagggttggactagacaacctgtaagtctcttctagttctgagggttttgtgatttttgtgacctgggcctgaaaagggtaaaaatacttgtttggatagtgtattttgtagtgctttcctttgagtaatggtgtaatattgtattttatggtgaggtatggtttttgaaagctaagaaacttaatttggaagatacttttcctgccaactaagtttaatttcttgcattttaaatgttaataatttgatgagaacgtaatacaatgcaaaagttaggacttttgtaattgttaggtctaattggtcattacattattattgaccagttttttttacggaaactttcttaaaaactcttgcattgggaaattttagggaaatcactttatcaaaacttggagatagtcattatcgttaaggggtcttcatatactgcataccccccgttagaggatggaatgcagaactcactataccctgtctgcatagaagagggaagaaactcaatcccaaagtaatatggaagcagtctcacatgtattgttggttatatatgatatccagtatttttatttttccttttagtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaacttgtaagactgttacttttctgtattttgtatctgtttgtggaatttaccattttctctcagtgtagggtaataaaaacattttgatatttaagttttactttatagatgatgtcgtgagttttaatcatgggctgaatatatttattggaaattttgtgtaaagaattctttgggccgggcgcggcggctcaggcctataatcccagcactttgggaggccaaggcaggcagatcacttgaggtcaggagtttgatacccgcctggccaacatggtgaaaccccatctctactgaaaatacaagaactagctgggcgtggtgtggcacacctgtagtcccagctactcgggaggctgaggcagaagaattgcttgaacccaggagccggaggttgtagtgagtcgagatagcaccactgcactccagcctgggtgacagagccaaataatgtctcaaaaaaaaaaaaaaaaaaagaattgtctggtgttatttatacattaagtttttctgtatgttaaaagtcagattgtgtctaacaagtgtatatatatatatagtgttgtgccagagtaggtgacttctgtgatgtgaagctttttggattcactttggattttacattttgttggataaccctggtgcatagtagtagagacaggggtttcaccgtgttggccaggctggtctcgaactcctgactttaggtgatccaccctcctcagcctccctaagtgctgggattacaggcgtgagccaccgagcctggccctttgttgttgttgttgttgtttttgtttttaatggacttatagtccctctgtttggggtaaattgagtttggatgtttgttgaaagtttttctaaaatgtatcatgtgctatattggatctttccctgttttttttgtgtctagcagaccttcatggttatagtcactaatgttctcattacatataacttgaggtctggaacctatgggaaactgatcattatggtttgaggatttttttccccctttaaggcaattttctgatatcagcttgaccatatcttaagttactgggtttttttgtttgtttgtttgttttttgcttatttatacttgtgtttttaggttgaaggagcaccagttgattcggtggttttgaggaaaatttgggaggcaaataagttataatataaattgctttattgttgaacttactactcagtcactgagaatttctattaatgtccttctctcgtagttcaaatatcaacctttcccttcctatctataggattctattgttatttggtgtcattataataatattgaggttattttaacaaacacttgtaattattcaatgtccagaggagtccagagtgaataataatacaatttccatctgacttcccccactccagtctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggtatggattcatagtttttaaagcaaatgtattattttatgatgcagggcactgcttataggcactggaattgggatttgaggatttcagcttactgaaaagcaagaattgatggcataggtgcgtctttataatagacctgaatgtcaccttcttcagctcatgattttaatttaggaaaactatggagttcatattgcttcatcactctttagagagtattacagtaggaaagggttttccagggaatgtttagttagttgtcctttataaactagttatttagttaatgactcacatgtcaaggtgttttctttgtttatgctttttcaatgattgatagcttagaggttttcgaggtaaatcagatttcagtaatcatctcaccttggaaaggtttagtgaaagtttagatagattgagaagttaaattctttgggcaactagaaataaatgtgttgcttattgcctaaaacactttctggcatataatatgtactcaaaaacataaaggatttttaaagaagcattaaaagaacatgtacattagaacataacaagtgatactaacataggtgataatgagtcaaaatttgggttcttgaaaaaaacaagatgaacacatagattgtcttagaaaacaaagctcttacattattagttaaatacattttttttcactgggatcatgtttgaaaactaaagttgtgggataacttgtatcttttgaggagcttaacattcctaggccagggaaataacaagcaaagaaataatttgattttatattttaaagttcatgcctgtaattccagcactttgggaggccaaagctgggggatcacttgagcccaggagttctagaccagcctgggcaacatagtgagactccatctctccaaaaaaaaaaaaaaaaaaaaaaaaaggccagccgtggtgacttgtaactgtagttccaactatttcggaggctgaggtagggggattgcttgaacccaggaggtcgaggctgtagtgagccaagattgcgccattgcactccagcctgagtgacagagtgagaccctgtctcaagaaaaataagaacaaaacaaaaatatattaatactgtcttttttttcccttttctatcatatttaggaaaactcctccttaacttggtagatcatactgaagtggtcagagatttaacttttgctccagatggaagcttgatcctggtgtcagcttcaagagacaaaactctcagagtatgggacctgaaagatgatggtatgtcttttttccaagctatgaactaggatttgtttcttgatactactatggagaggtattgggaacatgtggggcatttgactttaaaaatgacatgtgatcaaagttccttttctctgccttaacacttaggttcctttcctgaatagatcaaagaaaaacataaatgtgacccagaataggagccaacagttattcgaagtaaatgatctgatattattcagaaactaaccacataaatctgtatcaactatctgaggaccaaatatggatcaggtttgggattttacaggaaccagtctgtgtttatgtcctcttagggagggttattaacttactgtattggctgagtgaaaatttaggtaggtcttgaagtaacttagtatctaataaaatttaaattgaaacatgacctacataccagaacttataacatgtgaatattagtaaacgttaaattggctaggttaagaagtgcttttataaaaagtgaaagatttactgtccaatacaatagaaagatacgttggtgtcaagtactcacctttctctaaagccttacaaagttttggagatgctacctcatttgagatgagcatctcttccctttctcagtccctaatgaaagagtttatatgtttaactaaaaccttaaatgtaaggtctgttggtgctctaacagcctcaagctggaggttaacaggcttgcctaggggtaataaagcttaaattgaattagtaggaaacaaaaccctcagatctggagatgttccagctgatagatagtaaccattccttaataaagttctatgctaacattaacaaatcatgaaggaccttctctgtgttttatctgctcagctgttgaggtgcaaagggatgccaacagttgaaatattttaataatttttttattttgcatatcgaatgatgcttgcttatctcaaactaatttcagcaatgtacatgttttaagaacatagtcttagtaaaatataagctccaagatagtggggtccttgccttatttccagttatatcctcagtgccggcatagggcctggcatgcgtaggcactcagtaagtatttgtaaaactaagagttcagtatacttaagcatagttgtgtgctgtgggtataatacacaaggactttggagtgagttgtaggttctcaaaaatgaagaatgaaaaggcattttgaagatggtcaagtttcttaaccttgctgttgtgttccagttgcttaacttttaaaataaggggattggactaaaagaattctgtcttttttttttttttttttttttttttttgagatggagtctcgctctttcgcccaggctggagtgcagcggcgtgatctccgctcactgcagcctctgcctcccaggttcaagtaattcttgtgcctcagcctcccaagtagctaggattaccggcatgcgccaccatgcccggctgattttttaatgttttttagtagagatgggtttcaccctgttggccaggattgtctcaaattcctggcctcaagcagtccacctgcctcagcctctcaaagtgctggaattacagacaagagccaccgcgccaggccccagactttttcttgaagggctagatgttgaatatttgaggcttgtgaaccatgctgtctgctgtagagcacaacataaacacatggacaggattgtgttccagtaaaatttaaaacctaagcagctggtgtatatcggtaacccttgttatagataaattgctttcagctataaatgtttgtgatcctttgctttactgctgttttgaaatactgctcatttgaagtggattctagggttaatacagattatttctttttgttcaggaaacatgatgaaagtattgagggggcatcagaattgggtgtacagctgtgcattctctcctgactcttctatgctgtgttcagtcggagccagtaaagcagtacgtgtcaaagttcttgtacattcattatgaattggattatgataatgtgtgcataatcattttaaatctaagtaacctatgaagtctgtgctcggtgtcatgaatattttaaatgttttatttcatgatgggggagaatttgcatgaaggaaattaaatatagttattgattgccaagtgagaagttggattgtttttagagataatagataataatgggcatatcagggttttttttttttgtaagtctagaaaagtttatgtgctgtagaagagatctagtctatatgttaagacattcccttgctaattattttcttctctgttgttctatttttttggtccagtttgctgtttttaaagttttgagtcccagctggtcctgtacatttaactgaaaaaaaagtaacttaaaataatataaaaatagcactcatgtatgtcctacagttataggtgaaatttgatattgtttgtcttacatagcatacctatagacagcttaagtaaagtgactgttaagagggttatgcttattgatgaactcttgtagttgtttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccactcgcacacaggcgcacaatggtgttagctgggcagaaagagtggcatctctggctaccgggctgggggcgacctttaccataggatgaagtaaccttgcattcggctgcaaggtgtactgtacgtacacaggtgctggtcgatgtccactttctgcttttctttctttctttttttcttttttaaagtaatttcccccacagtaaaatacactgactcctgagtaaattgattttccagttttatggaattgggagtctgacaagtgaaaccaatttaatgtaaagtatttggctttcaaatggtttctctgtgctattttttggaattctttcagattccagagatatcttacgtctttgattcaatttaaaatttgtacttattttcttttagaaataatgtattgtgtctgtgcagaaaaaaaaaaaaccaaaaaggattgctttactccaagaggagagattgtcttaggataaacctccaagctcacatttaatataacagactgaagtaaacattagaatcctgtttagagctattctgcacagttaactactgatctttagaatctaaaattgtatatgaacttattcttaaataattgaaccgttttatattcaaatgacttatgatcgtggttagtttgggaaaaataagatggttaaattttgatttattgaaatgtaattgtattattttcataaaatagcattttcattttgtaatgtggtttaacatccttgttgtttgccaaagaaatttcatttggctgtgaatattctatttgcttgcagtatctgtttctcttcctaggctcaagttggtgacccaagcctattgtaaacaagtgattatctcaaagggagatgccaatggagtaacaatttgttaaccttacgttttctgtctgtatatttttttaaaaatctggtagtttctggaaaaaaaagagaagggggtttgtagtacttaaccctatttatttccgtatattttagttaattagtttttggaataaatggatttcagtatagctttgtggttaaattgcattgcctttattttatgtttaggcttatttttaaattaacatttaacagaaacatttgaaatagaatttgcatgtctgccttaattaacttaaagactgattttaatctgactatgacactgagcatattctttaaattactcataatttataatgcttaatataatcttaattaaatttagcagttttagtataagatgtgccattttgtcctctgtatgtctgaatgaagctataacatttgcctttttattgcaggttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggtgggtacagcatgaattattttagtctataattcatctccacctatcaagttatgtgaataattacaatcaccaatatatgcaacctaaaattacagtctattctaatttaaaatgttggtattatttaagcccttgactaatggaaagccttcgatataaattctaaaagtaaatttggctctcttgatacaagtcttgctacttaacagtacccagctctctatagaagtactaattatgtttagagtttttgttggagaaaaacagttaaaaccaaagttggacttaatcttactgtcttaaatcataaaagattttttttttttttgacagagtcttgctctgtcgccaggctggagtgcagtggcgcaatctcagctcactgcaacctccacctcctgggttcaagcagttctcctgcctcagcctcctgagtagctgggcttacaggcacctgcaaccacccctggctaatttttgtatttttagtagagatggggtttcaccatgttggtcaggctggtctcaatctcttgatctcgtgatccacctgccttaacctcccaaagtgctgggattacaggcatgagccactgcgcccgaccataaaagattagttcttttcaggtgactttaatttggatgtatcatctctactgagtcttctcagttatattaattaaggctactttaaacactattcaaagacagatgtactttgtacctgggtaattttgttttcttgaagtgactgatatccactgaaaacatatatttgacctcaggcacctgtttcccccacctactccaatatttgctggaggagcaaatgaccggtgggtacgatctgtatcttttagccatgatggactgcatgttgcaagccttgctgatgataagtaagtatgtgcattatagcttgactgacttactattaccttttacattcttaagccttaaagcctttctgcagttaagagttttaatgtctcttcctcaacacaagcccctgggagattttgttgtgtcttaaagaatatcagcctgaacaattatctgtgtaaactaaagataatgcatgcctctccctgtgttccttgtttaacttgtttaggcatagtgggttgatttttagtcagcttttagcccagcttacagagatttttttaaagtaatgtcttaacaaaggttgaagcagaaggaaatttctaaagtgaaacaaatagtaaaaccaaaagaattacaaataaatagtaatttgtatccaccatgattgagattagaatatgaaatgtcacatgaatgatatgtgctgcttgttggtaagaagcagaaactagttgcaaccatctgtgttcatgcatatagcattgagtagttcggtgacgtcaattcataaggcagctcttctcttcccagaatgttagcaaacatatggagagaggttttttttgtttgtttgtctgcaaccattgtttcctgtttgctcagatagattctgcatgttagttctctgctgtatttgtagacacactcagcctgggtgaaaagctttttttcctttcctggttttttttgtttgtttattggagacagggtcttgctttgttgcccaggctatagtgcagtggtgcaatcacatctcaccacagccttgattttctgggctcaggtgatcctcccacctcagccttccgagtatctcacaccacaggggtataccaccacacctggctagtttttttaaaaaattttttgtagagacagggtctccctatgttgcccaggctggtcttaaaagtcctgggctcaagcagtccacccacctcggcctcccaaagtggtgggattatggttgtgagctaccaggcccacctagcttttaaaaatgtcttgggaaaagggtgaaacagactagaagttgattgtattgtaagtgtaggaaagtaaggagaaagtttccgggtgtgaacattctaggtttgaacactgggaaggagggaaggcagccatgcattgtagtctcttaagtgaaagtttatccaatttaccaactgatattatagaccttaaaatattttgtaattgtataaagcaagttattataattgcctgttggtgtgatgtgtgtattttgtgactcataactcaatggcatttctttctaaattttaaaaaagttgcttttaccttacattttctacaagatactaaataatttatttcattttcagaatggtgaggttctggagaattgatgaggattatccagtgcaagttgcacctttgagcaatggtctttgctgtgccttctctactgatggcagtgttttagctgctgggtaaatatatttttctcctttttttttttttttttttttttttgagatgtagtctcccaggctggagtacagtggtgcaatctctgctcactgtagcctccgtcttccagttcaaggagattctcctgcctcagcctcccgagtagctgggactacaggtgcacaccaccagtcctggctaatttatttgtttgttcgtttttccagtagggtcgggatttcaccatgttcgcctggctggtctcaaactcctgaccctgacctcaagtgatcttcccgcctcaacttcccaaagtgctgggattacaggcgtgagccaccacacctggcccatttttctcttttctttaagggccaatttaagggggcttttagcagctagtaatttattgtcagtaaaactctaataagtgttcttcatagtagtgttaccttgtcatggaatacatcattggttagttcttcctggttgggttttaatgtgaagtttgtgactccactactcacatgtattgggtgatagttgtttgagctgtagcaacactgaaatacatatacttgggtgactaagcatgtgctttgtttctgtttaggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaaattgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgtaaaaaaaaaaaacagtatattgcaaatgtttcttaaataggttaggtggagtactttctctctgtctccattgtaaggttgatggtacaccacaggcaaattaagcaaaaaggacaatgaagaaagaatgcaggactcaggcgctgctctagaattcattcagggctccccgagtgcagcagctcttatggtggttttgtttttaggagaactgttgtaataatgcatattttaaaagcatagggaagctctagaacacaggaaggtgactactaagcaagagaaaagtatcttttagtggggaactaccagcctatagtaagtctatctggttaaagtagttattatgaaaatctagcagtctgggtcctttgagaaggcattaaaaaagcaaaactcttatgagccatgtgtgattttgaagactcatttccactgagaaattatttggaagttcctatggttagctctgttaaggaatgtaaaaatttatagggggtgtagggttatcaatttgaaagccagtagaaaatctgctcaagttacttcttgaggatcatctgtattttacaaaaagaagcacaagaagcatctaatctttatacttcttgtgactttttttcccctgcattttactttgtaatatatcggctttataattttaaaatacactggccgggcgcagtggcccacacctataatcccagcactttgggaggccaaggcaggtgggtcacttaaggccgggagttcatgacaagcctgaccaacatagtgaaacccctgtctctactaaaattacaaaaattagctgggcatggtggtgggttcctgtactcctagctacttaggaggctgaggcaagagaattgcttgaactggagaaatggaggttgcagtgagctgagatcacgcaactgcactccagcctgggtgacagagtaagactctaaataaataagataccattacttttcatatcattgcattatttttgctttccacaccaacatatccagtcaagtaaaaacagctttttttattttttattttttattttttttgagacggagtctcacactgtcacctgggctggagtgcagtggtgcgatcttggctcactgcagcctccacctcctgggttcaagcaattctcctgcctcagcctcccaagcagctgggattacaggcgctcccccaccacgcccagctaatttttgttgtatttttaggacagacggcgtttcactgttggccagactggtctcaaactcctgacctcgtgatccgcccgcctcggcctcccagagtgctgggattataggtgtgagccaccgaacctggcccaaaacagcatttttggaagctacattctgtgagatgttcacctgtttgccacctcttctcgtgaaaaccatagtgagtgccagtgtgaaaggaagattgcagcgtatatgtcaagtagaaacatgtttgaattttccatttgtctgtggggaagaaggtaataacagtaataacagactgaaggaccaaaggaaaatagggaagacgttgattatggacttggatcagattctagctacatgatttgaaaatgacactgcctctcctattttgccacaagcctgtcatttggagaactggcagatcatttatgttcagatttaattttctgttttagaatcccatggagtacatgtgaacataggaaaatcacactcagcagccaagctatccttttgcgataatgaaatcactttaaaacctataacttgatcttaggttggcaaatcttaaacttaacgatccttgaaatttcctgcctgctgtgactgtgatgcagttggattcaactggtttacactgctcttggatcggcaagaccaaaaaaggttggactgcactgtagcatgcttatgggttgaggcagtggcagaggcagaggacttggccgtcagccagccagcacaggcgtaagaaaatagcatgagaagtttcacgagcctgaaaccattgagacagtgattacaacctccatattaatcagatgagggtttgtaggtgacatagcattttacccaagtaattctgaacagactgtggcttatgataatacattttaactagcaagtgtgtggactataaaacaaatatctagagttatatatggatgtactatcatttggtgataaaagcatagaaaaagcataagttggagtatactgggtttttttgttgttgttaaattcttttccatcagaagtaagagctgttggcagcaactaataaaatgcaacctagtgacatgctcgtcataaccttggcagatgtttatggtaagatgcttggaaggaatgaacgtaagtaggcaatctcaacctgccctttgatccataaagcattctttagccaccagcaaaaatctggtctgagccaggtataaagtgacctgttttattacaggtgggtggggtagctttgtgtggttgttttttgacattatgtatgcttttattttttactttgaggtaggatctcgctctgtcacccaagctggagtgcagtggtgcaatctcagctcactgcatactctgcctcccctggttcaagtggttctcgtgcataagccacctgagtagctgggattacaggcgtgagctgggccaatttttgtatttttagtagagatagggtttcatcatgttggccaggctcgtcttgaactcctggcctcaagtgatctgcccatcttggcctcccaaagtgctgggattacgggcatgagccacagtgcctgaccagtctaggcttatcttaacagttgaggaatcagaaaatgattgaatagggctggaattggagaaggaaaaaatgatttaattcaatttttatcaactccagcactattttctctattagagactactgtcattatccttctggtttctgttttaaagatactgattaaggaattttctttatagttccacataacagttggtcttctggtctgaaagtagtattacaggttttgttaggaaaacctataatacagtgttgcctgtcaccgtcattatagtgagtttgtgtttgtttggttttaaataaggctgaagcatcaatggctctttctgaaaaaattgttctccaaaagtaaagtgtgagctatagaaatcatctagaacaggggtgtccaatcttttggcttccttgggctacattggaagaattgtcttgggccacacataaaatacactaactgatgagcttaaaaaagaattacaaaaacaatctcataatgttattaagaaggtttacgaatttgtgttgggccacgttcaaagccatcctgggccacatgtggcccgtgggctacacgttggacaagcttgctcgagtatagatcagtaagtaagagaaatgaaatggctactccactgggtcgttttatgcttccgaattgttgaataataatgaaatgttcttataaaaaatagattaaggatgatgggcattagagagatacctgagaaagataatgattaaaatagatccaagaggccaggtgcagtggccctcgcctgtaatcccagcactttgggaggccaaggcaggcagatcacctgaggtcaggagttcgagaccagccggctaacatggtgaaaccccgtttctactaaaaatacaaaaaattaacccagcatggtggcatgccgtctgtaatcccagtacttcaggaggctgaggcaggacaatcgcctgaacccgggaggcggaggttgcggtgagccaagattgcaccattgtactccagcctgggcannnnnnnnnnnnnnnnnnnngtgcctcaccaattctgtaggttctgctggacaccaagtcattgacaaacatcgataagcagtttcgtatccgaccatgaactcgggatgccacctgatcagcactgcgcaggacaactacccattagcggggctccacggcatcagacgactattgatgtctgcagtgcatcctcatgatccacgcgtcgaaagcagagacactctctcgcacactggctgcagtacaccggcgcgatcatggtgcactgtagtgccttcagactcccgggctcaagtgagcctcccagctcagcctcccgagtagctgggactatagctatcaccaccatacttggctaatgctgtctatgtcattcgtagagataggtctcactctgttgcccatgctggtctcgaactcttgggctcaagcacttcaccttcctcagcctcccaaattgctgggattataggcgtgacacaccatgcccagcctcattgtcatatattaaaaatatctaaaaagttctcctgagacttcctcattgacctgtgtgttacttagaagtgtgtcgtgtaagctccaaacattgtgggatgttccagctatcttgctctcactgatttctcgcttcggtaggttgtgctctgtgacacaaatatatatatatatgtatatatatatattttttgacacggagactcgctctgttgcccagactggaatgcagtggtgcaggctcagcgcaccacaacctccgcctcccgggttcaagagattctcctgtctcagcctcctgagtagcagggattacaggccgtgccaccacacctgggttatttatttatttattttgagacggagtctctccctgtcaccaggctggagtgcagtggcacattctcggctcactgcaacctctgcctcctgggttcaagcgattctcctgcctcagcctcccaagtagctgggactacaggtgcctgccaccatgcccagctaatttttgtatttttagcagaggtggggtttcaccatggtggccaggatggtctcgatctcttgacctcgtgatctgcctgcgtcggcctcccaaagtgctgggattacaggcgtgagccaccacgcccggctgtattttttttttttttagtagagacagggttctgccatgttggccaggctggtctggaattcctgacctcaggtgatccacccacctcagcctcccaaagtgctgggattacaggcatgagccatcacgccctgccttaaatggaaatcttaaaagacatacatttgcaccaagtgagctaaatattttggcaccaaactcacacaaaatggccgggcacaggggctcacacctgtaatcccagcactttgggagactctggtgggcagatcacttgaggtcaggagctggagaccagcctggccaacatggtgaaaccccatctctactaaaaatactccccaaaaattacctgggcgtggtggctcatgcctgtaagtcccagctactcaggaggctgaggcaggagaatagcttgaacctgggaggcaaagttggcattgatccaagatggcgccactgcactccagcctgcatgacagaaccagactctgtgtcaaaaacaaactcacacaaaatgggaaacccagtaagttgtatgattcacaatattaatctcacagtaatggctgaggaaaagcacagttaatattatggaccgaatgttgtatgcacaccccacgaccaccaccaccaccaccagtaatacgttgaaatcctaatcctcaatgtaatgatattagggagtggggcctttgggaggtgattaggtcatgagggcggagtcctcataatgggattcgtgcccgtgtgaaaggaaccctagaaagctctcattccctctccaccatgtgaagatacaatgagaagacaacagtctaaccgagaagaggacctgcaccctgatctcaaacttccaacatccagaactgtgagaagttaacttctgttgtttataacccatctagtctatggtactttcttctagcagcccaaatggactaaggcataggaacagcaggaatgcctccttgaaacttctttattttttcaagatggtctcgccctgtgacccaggttggggtgcagtggcatgatcacggctcactgcagcctccatctcctgagctcaatcgattctcctgtctcagcctcctgagtagctgggactatagttatgcaccatcacacccagctaatttttgtattttttatagagacaaggtcttgctgcctaggctggtctccatctcccagactgtagcagtcctcccgccttggcctcccaaagtgctgggattacaggtgttagccccccacacctggccaaaacttcttaattagatataaactgtgctagagcacagacagtgatttctgtgtactccccaaccatcttgccacctctaagacccctaacatgatttggcagaaattacacaggcttcaagttctcccttggatgataacagttgagctcagaagagaaacagtaaacattactgtggccttgctgtgttgcaagggtctgcaggcagcttctgggaaataggaccgggaagcccccaagtcaaaggttgtccctgccatccccctgggtgacatgagcctgtctcacttgttttacccaatttcataacaaacccaattcttgtatatttgagtttatgatgcattacctaaatggcctgtttttggtggtcagataagctggcccagccagaagtcatcttgcccatttctcaagttccatcagagtcctaatttccacatcacttccttcaaatacagcctgttgctaggtactcattcttgggtgttggttactcatttagaatgcaaattccttacacctgaggaaatccttcaaacttttcccactggactctacccctggctgatatttgggtcacagtggttgttgatgccttggcaagtgagagaccagcccccggtcagcagtcatggcagtagctctggcctggggagctgggatgggcatcctggtgcacgctcatccagcttgtgctgggtggagaaagcagctccctcagactgtgtctgggtcacgctgctcaacacctggcaaagacccagctttctaggcttggccccatctggcctcagatcaggaggctgttcatatagcagcttggcccactttctcgccacagggcctgctgcccagaggactttgcagaagtgttggctgaggctgcagtcccaagaaagacaggtgattgctggcttggctgcttaacagcttgtaactttcagagctttgatctaagaatactgtaataatacctctcctccatgaatagtgtttagcttctattttgtatctgcaacagtgtcaggtacatggcaggcacttgacagctgctactaccatctgttgagcactgaccacgtgctcgtcactatccctggtacttcttaacaaccctgtagaattatcctgtattatagctgtggaggttcagagaggccagctcctcaggtcacacagctaagagaagaccatcgagcatgtaaattcagattaatctgtctccaggctgggcccagtggctcacacctttaatcccagcacttttggaggccaaggcgtgagagtcacttgcacccaggagttcaagaccagcctgggcaacatagtgagagctcgtctctacaaataataatttttaaaaaattcgctgcacatggtggtgtgcctgtggtcccagatactcttgtagcaggaaaagctgcagacaaaacccctcagacatcgagttaaagaaggaagcagtttattcagccgggagcatcagtaagactcctgtctcaagagccgagctccctgagtgagcaattcctgtcccttttaagggctcacaactctaagggggtctgcgtgagagggtcgtgatcgattgagcaagcagggggtacgtgactgggggctgcatgcaccagtaattggaacggaacagaacaggatggggattttcacagtgcttttctatacaatgtctgtaatctatagataacataacctattaggtcaggggtcgatctttaactaccaggcccagggtgtggcgctgggctgtctgctggtggatttcatttctgtcttttagtttttacttcttctttctttggaggcagaaattgggcataagacaatatgaggggtggtctcctccgttactctggaggctgaggtgggaggatcactcaagcctgggaggtagaggctgcagtgagctgtgattgcaccactgcactccagcctggcaactaagagagactctgtctcaaacacaaaataaatctgtctcaggagccctgtttcttttcatgatggccatagacgggcactgtcatttaggaagggcattcagtcaacatcaaataccaaaattagctctctttttttctatgaattttttatttcaatattttatttttgtgggtatatagtaggtgtatatgtttatggggtacatgggactaaattggttcttgcctgtgcctctgccaactccctagagccagccatgatgtcaggctaaacctttcccaacactccctacctttcattgaatcacagggaaaacaaacgcagaaggaatgactccaaatataattaggccattgaaacccacacaaggtgtccttcgcccaccacctgggcaaatgataccaaaggatggttagttttttcctacacaccactctccttgggaactgatctcacattttcattgcaatgtgaacaaatccaactcaaacaggctggagcaggatgctccaaagcaatcactgcaggtgaggaagtcacctgaccctgcacccctggctttatttatttgtctggtcatggtcacaggttgagcctctagctttaatgatcaacaagaggtcaggttacaagctgacgtgagccccttttttttttttaattttatttttgtgttttgagacagagacttgctctgtctcctaggctggagagcagtgacacaatcatggttcattgcagcctcaaccttctgggtttgagcaatcctcccacctcagcctcctgagtagctgagacttcaggtgcgcggcatcacacctgactagtttttgtattttttgtagagttgggttttcaccatgttgcccagactggtctcaaactcctggactcaagcaatctgcccccatcggccttccaaagtgctgggattacaggcatgagccagcacacctggcctgacatgagccccttctaccagctgtatcagacaagggtagtcccacttgcctggagctgacctgccagtaataccagccattggggctggccctgggttaagagtccaggggccagactgcattgggtggaactgttatctagatcaactaatacagatgccatctagggagcagggagaattcatacccaggaaggacccaactcagtaataaagggtcagaccattcttaccatatttcactgataagaaagttatacttttatctctgcactctgaaattaggacatattttataatcaaagatgtcttaaaaattgttttaagtggtacacactgtaatggtatattatagataatggtacagattataagtgtcattgaggatttgataaaacacaaagtcaggagaatgtacatataaaagtcaaaggtcagtggaatgctatatataatgtcagcagtaaaagacaccagaaacaggtagtaagtgaagtgttaatttctatttgtattaaataaagtgttaatttccatttgtattgaaatatagctaacatttatgaactttcaccatgattcaggcactgttctaagtgcttaatgtgtataattgaatgctcacaacaaccctatgaaacagacagttatcttcattttataaatgaggaaactgaggcacagaggggttaactaactcgccagaagtcacgtgatagtaaatagcagagtcaggattcaagcccaggctatctgactccagagtcaagaaatacttggggctgggtgcagtggcttacgtctgtaatttcagcactttgggaggcagagtggggaggattgcttgagtccagg

SEQ ID NO: 539 - DNA, 2816 bp, Homo sapiens
ctccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcgccactctcttctctgttgttgggtccgcatcgtattcccggaatcagacggtgccccatagatggccagctttcccccgagggtcaacgagaaagagatcgtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaactttctcttgcatggcaccaagaatgttaccaattcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcagctacttcttgctacagggttgaacaatgggcgtatcaaaatatgggatgtatatacaggaaaactcctccttaacttggtagatcatactgaagtggtcagagatttaacttttgctccagatggaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgttcagtcggagccagtaaagcagttttcctttggaatatggataaatacaccatgatacggaaactagaaggacatcaccatgatgtggtagcttgtgacttttctcctgatggagcattactggctactgcatcttatgatactcgagtatatatctgggatccacataatggagacattctgatggaatttgggcacctgtttcccccacctactccaatatttgctggaggagcaaatgaccggtgggtacgatctgtatcttttagccatgatggactgcatgttgcaagccttgctgatgataaaatggtgaggttctggagaattgatgaggattatccagtgcaagttgcacctttgagcaatggtctttgctgtgccttctctactgatggcagtgttttagctgctgggacacatgacggaagtgtgtatttttgggccactccacggcaggtccctagcctgcaacatttatgtcgcatgtcaatccgaagagtgatgcccacccaagaagttcaggagctgccgattccttccaagcttttggagtttctctcgtatcgtatttagaagattctgccttccctagtagtagggactgacagaatacacttaacacaaacctcaagctttactgacttcaattatctgtttttaaagacgtagaagatttatttaatttgatatgttcttgtactgcattttgatcagttgagcttttaaaatattatttatagacaatagaagtatttctgaacatatcaaatataaatttttttaaagatctaactgtgaaaacatacatacctgtacatatttagatataagctgctatatgttgaatggacccttttgcttttctgatttttagttctgacatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaaattgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgtaaaaaaaaaaaaca

SEQ ID NO: 540 - protein, 421 aa, Homo sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGHHHDVVACDFSPDGALLATASYDTRVYIWDPHNGDILMEFGHLFPPPTPIFAGGANDRWVRSVSFSHDGLHVASLADDKMVRFWRIDEDYPVQVAPLSNGLCCAFSTDGSVLAAGTHDGSVYFWATPRQVPSLQHLCRMSIRRVMPTQEVQELPIPSKLLEFLSYRI

SEQ ID NO: 541 - DNA, 83888 bp, Mus musculus
  misc_feature (1)...(83888): n = A,T,C or G
acttaggacaaaaattatagacttataatgtgaattatatagctgtcatgtgaatgctggaaattagatcctggtcctcttgtaagagcagcaagtgctcttaaactgctgagctaattatctggctcccagtttttctttctttctttcttttttttttttttaattataaatgtgtgtgtgtgtgtgtttacacagatgcaggtgcctgtagaggccaaaagtggaagttggatcctctgaggctgtagtcatggcagtttgttagctgcctgacataggtgctggaaactgaactcaggtcctctaaagactaagcacatgtttgtaaccactgagacatcttttttgccaggctttttattatttttcaattttaggtgttttcgttttctggttatgattttcctttttatccaggatgttttattgtctttgagatgttttcctagctatctttatttgtgtgtttgtttccggttttcaagacagggtttctctatgtagtcctggctttcctgggaaaaactctaggccaggctggccctaaacccagagatctgcctgcctctgcctctctagtatgaggattaaaggtgttcaccaccagtgtctggttttatttattaatttatacttcagtgttgaagatcaagccattcaaaatttcagcatagttagggaggaacttgagaggccccactgctgacaagggagctatttgttggtagtggatagctactgtgggagggaaagaccatcgaaggtgtggccagtgttggttgcccgtgtttcaatagctctatagctatgcacatatggtctgcattaaatggacttagtagactattttttaaaaaagggctggcgagatggctcagaggtttttttaaaaaaaagtcataaagttgggaggcagacatgtggagatctggggcattggagggggagaaatggggctggacataatcatatttcattgtaaacacatgaaattctcaataaaaattaaataaaagtatttctattttaattgtattgtcagcaaatatggttttcatgttactagtactttcaaatttgaccttaactttttatagttgaatattttattacttactgctgttgcaaaaattttcaaaatgtagtacatgttagaaaagtactgtatcctgggcttattcctgatcctctttagcttttacattttatttatttttatttatttatttatttatttatttatttattatttatttatttattgggtttttggagacagggtttctctgtgtagccttggctgtcctggaactcactctgtagactaggctggccttgaactcataaatctgcctgcctctgcctcccaagtgctgggattaaaggtgtgcgccatcactgcccggctattttgttatttttaaaagaagatttatttttaataaatttatacctagtagcacaattacagatagttgtgaactgccttgtggggcctagggattgaacctaggtcctttggaggagtagtcagtactctaaactgctaagccatgtctccaactgtactttttactttgtaattttgaagcagattctctctgagtttcttgggcttgctttacactctcttacacaggctagcatttgagtcatgagtctgagcctccttagtagtgggattacaggttcatgccaggttcagtttaaaaaacaacagacaattttaatatctcaaagttctgcttttctaaaatccatgagcggctttatgataatagcttttgctcactgtttttcaaaagattgcagatgagcagcagtcatctaaagatttgacatgtactaattattcacttccagtgacatcatttacatagctataggggggtggcttcaatatctatatctatatctatatctatctatctatctatctatctatctacttcaatatctatatctatctatctatctatctatctatctatccatccatccatccaatcatccatctatctatctatctatctatctatctatctatctatccatccatccatccatccatccatccatccatccaatcacccatccatctatctatctatctatctatctatctatctatctatctatctatctgtctatctaatctaacctatctaatccatctaatctatttctagctgcttgcaaaagggctcagttcctgttgctaggccttcttgaacacatgacaattgacattgtggaaggtgaatgttttgagagaatcagaagctatgtcttttttaaagacccttggaagttgatacaccctcccttctgctatcttatattaattacccatagagaacagttttcatatagggtgcaagaactacacaaagatactacaacattggaataattatgggccatcttggagtctagatagtcatgaagttcattttataaagtttttatatgttcttgaaaataatgtgtaatctctggttcttgggtataattcttatgtgttgttttggtcaagttctgcattctaatttttcccccttactacaatgtataactgaaagaaatatatgttaggcagtcttgcactgaatttgatgtgatttaatttttttacttttattgtgtgtttgtgtacatgtggtatgtgcacacatgcttataccaatgcatgtgcacacacatagaccagaggagggtgttgaatgtcctgctctgtcactgctttattcttttgacacagggtttctcactgaacttagagctagactggtggccagcaaaccccaacagttctccattctttatacccctaacatcattgaggttgcaggtacttgcacagccacgcccagcttgttacctgagtaccagcagcagaactcaggctcccatgcttgtatagcagccatctctctaggccaaagtagtagatatgccagttttgttatgtgtatataattaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatagtttgactttttcttccaactggaatgtttattttatttacattaatcatgattactggcatatttgaacttatttctgttactttataagacttttattttcctttttttcactctacccccttcttgaatttgactttttgttttgttttattttattttattttattttatgtatatgagtacactgtagttgtttgccttcagacaccctagaaggcggcaccggaccccattacaaatagttgtgagccaccatgttgctggaaattgaattcaagatctctggaagagcagtcaatgcttttaaccactgagccattactccagcctgaatctgacttttcttttaggcttatttttcttctgcttgaagcatgttctttagaactattttaaataagggtctattgcagtaattgctctttttcttttcttaaaaatatcttaatttcctcctcatttctgagtcataatttcaccagtatgtagaaatctgggtagttgtttgcctcctaagtctattaaagatacccttttcttacttttctgctgttgttgagaactcagttgtcattataattgccattactctataggtggtatttttctttctggctgctttaaagtctttttctttttcaccttttgtattttccctctcaccaaaggtaattatgttgagtaatgaatgcattaattgacttgattattgtcatagttacttttctattgctgtgataaaacacagtgacgaaagcaatttataaaaaactgttcaggggtgggggcagtgggggtggcggggatggcggagatatcagcagtggagttggtggcagcacacgcctttaactcctagcacttgggagacagaggcagggggatctctatgcattcaaggctagcttgggttacaaagtgagttccaggacagtcaggactacccagagaaaccctgtttcaaaaaaaccaaaagaaaaaagaaaaaaaagtttagtttggcttatgctttcagagggttagaatccatgatgtcggagcaaaggaatagctggagagatcacatcttgacccataaccatgaggcagagagagagagagagagagagagagagagagagagagagagagagagagagagagcgcgcgcgcgcgcgagagcgagcgagctagcagcactgggaatctcaaagagtctttttgaaatcggaaagaccaccccaagtgatgcatttagacagttctaccagctgggaaccaagtgttcagatatatgaaccatggggataattttcattcagactatcacaattgtggttatgatttcacaggatattgaaatcttgttatgtaagttaaatatataaaattttatttgctaattatgcctaagtgggaaaacaaatgtaaaagtctgcttttaaatgagggataattgggagttcttgtacatgcgcctttctgtagggcaggttggtagggagctcacttcatggttgttgaccctccagatgtgtttcagtggagatccactttatctggacgaatattgcctcactggttgcctgggtagtaatgcttgattaaaggattaagccaagagcctggtaggtttatattatggagattgtcacctattaaggaagtaagaggattatcatggaaaggttattttatagttcaggttttaaaatataggcaaaggaaatggtcattgtgtctttacctctgaattcggtgaactgtctgtactttgtctgtagcctagcaggggcaacctgttgctcctggaccacagtctcaggcacattgctccaggtaataaaaggtggttgttaaaggcaattggaaaggcagtgtaatgttactggtttattctttcattcaacaaacatttattaattgcctttataaaacctcctaatcaaaggataaaacgacttttgagaaagatgtctttcttgctaccatggaacttaaaatgcaagagtgatatgcattaaacagtttatcatgtggctaattatatttgttacaagaatcataaacatcctggggatgtggcttaattgatatagagaacttgtttagcctccatgaagttatagacatctgtagcactgtatgaaactgggcatggtggtacatgctggcaactttagtaattagggagtagaggcagaaggatcagaagttcagggtcatctttgattgcaatagagagtttgagtctagggtagatgagacactagagaaatagagaaaaatttttttgagcaaaataattgtatttgagagttttttttttttttttctttcatggctttcttttcagtgagcgtatattactttcacaattggggaaaagtgaattaaacttcaaaaatacgctatattacaaatatctttagctatagtagaatatagagatatctttggacataatagaatataaagggcttaggttgcctgaggaaaaaggaaaaagaagcacctttgaattatctctatttaaagcaaaatatgatctactataagatctcaacaaatagggagttatttagaagaaagcataacattaaacaaagaactgtgaacaatgagtagtttgtttctattttcactcagaaattctttgaaaggtcacagactaaaatgtgtgcttctgtgtacattctaatgagtttctaaaaggcctctcagactgtaatggaagttaggggtgatgttacatttcacttagtgtacacacaggaagaaagcaaaggaaaaatagctcatgaggaggaagaacaccccgtatgtcatctttaggtattaggaaatacacacattaaggaggtgtcttctctgctggagcacaggctgactgatgaaaagcaccggctgcttttccagacgacccgtttgattccagcagccacatggcaggcaggcagctcgtgaccatctttaaactccagttctgggacatctgacttcctctcttttggcctccaagggcattgtatgtacatggcacatagacacacacattattattaatattttttaaaaaattaaactacccttgactattgtagcttatattaagcacatctcccagaagagtctgtgttattggttacgtattacatatgtaatagtcctttatgtagtactcaatgaacttaaaattatgaagtttgtttttattttaatgtcattttaagtctataattggcaatcaaacaaagctattattcctttagcaaagttaaatgaaaaaggtgagctaactgcagattgttaagccaggaatccatgatacaggatatggctaagctaataatatatgaatcactaaagttgggcagagtggatggataagcctgaaatttaatcctgagctcataaaacaggtattacataattaccatttttaaaaccatacagatataaaccatctgtaggcaaaggtatttgcatggagccaaactagttttgccaagaagcgaatttccttgaattcacttttccttgaaagcttgagttttagtttattcttttcctgctattctgaatagccacctaaattttcatgcacagaagcattaagtctttttttttctttaaagatttattttatttatatgagtacactgtagctgtcttcagacacaccagaagaggaatcggatcccattacagatggttctgagctatcatgtggttgctgggatttgaactcaggacctcttgaagagcaaccagtgctcttaaccactgagccatctctccagcccagaagcgtcttatagaacctatttatactcacttcacccctatttatgcaaccactattgaaactccaaaagctaattcccaaatgtcttttcagcaggagcccgcttcttaccagcctaaactacagttgtattatttgcacagaaaatgctggctccattatttccttctctccctctgtaaagttcaaaagccattaggtaaaacagagcaagtaggcatctctgtacatgcttgggtaaaagagcctgatcagagtgaaaaaggcattgctgtggaggagagcagcataagacagaaagagtgtccacaattgccaggctaggcagagtcagacaaggagagactactctgtagagggtggccagacagaacattagttcacacagggaggaggggacaataggccacaggatgacaaggccccagtgggataaggatagaatttataagaaagatatccctagataggtgtcagtacctgagtgggcctagaaggtgctggtgggctgtggccagagcaggcgtgtactagctctagcaggtgcatatggggaagcagtgtagcacaagcagagtgtccaagcctggcacagtaaaggaggagggaacaagagagtcccagggggacagtgtgctgctgactgagccgcagaggcgctcgccacctcagctgggtttctgtaacccagctggtgaagttaaagttcataaaattaaaaacataagatggcttcattcttttggagttctcttggcttccttttccttactcctttatttaatcccattaattgtctacttttcaccctatggtcaatttggagtttaattcagcattttcttctcaaaataggctgcttttggattaagtgattcttcagttgggtggtttagaacattgcctaataggattagatagctgcatcttatataactattaaatttaaataaaatcaaacatttgattccttatctggactagccatactgcagatatttacaatagcaaggtagagctggctagtggccaaggtactgatcattgcggatacagaatatcattgcagaaaattctattatttgttatttagaatatgccacagttcttcggacttgtgcatagtcctgttgtgtatgtctattccaacatccctgttgtgtgtatgtgtgtgtgttttcctatataagccttctgtgttttcattgagagtgcattgtcatttgggaagattgttcgttcatcaggctttctgtttcctgttgtgtgtatacgtatactcccctagtgttgtgttaagtgggtcctatttgtacacacatacacatctgtgaatgtgtgtaagtttgcagctttattcttctggattttctattgattgtatggaagggctggggaaatttagatttacaagctgtattgttgttgccttagttagggtttccattgctatgaaaagacaccatggctatagtaactcttttaaaggcaaacatttcattgaggctggcttacaattttagaggtttagtccattattatcatagctggaagcatggcagcacgcaggcatgcgtggtggtagaggagctgagaattctggcgtcctcaggtagctaggaagctctcctctgcaatgggtagaacctgagcataagagaagacctccaaagcccacccgcacagtgacacacttattctaacaaggccacacctcctaacgtaccatttcctatgggccaagtatacttaagccacagtttcacttgtgtgaaaatggcacagttgacattttcaccttctaaaattatctttttttgagttttcaatttttttcctccatagtcttctttgtttgttttttgtttgtttgtttgtttttttgatgcatggtttctctgtgtagccctggctgtcttgaaactcattgtatagaccagactggcctcgaactcacagacatctgcctgcctttgcttcctgatttaaaggcatgtgctactactgttcagcttcctcctctttatggtcagttatgtaattctatagtttctgtgcactgccttccttacatctgaacctcatcccctctgtgtttgttacttctctgctgtcaagctaatcctgtcttactgactacaactgtctggcatgtcacttgttcctcccacctttacttgcaccacctctcaagtggagagagtcgtaggtgtggtctcacagaggagcctccttggttctctctcagtatcaccagggtctaagaatagtgcattgatttctgatgcttacgtacagaattatgcttttgagttgagatgcatttttacgcagtgaagttgaactcatccacaggttagtgtaaatgtgagcctccaaagaatttgtttttttgtgagatgaatttctaggttgtgttgctactgccttggttgtgtggttggttatctttactgcggtcagttttaactctgttcctgattttatagtttattgaatttgaacaatttgctcttatttcctattgattagtgctttgcagcctagattttctttgtctgtatttcattcagtgcatacactgaaggactgtgtgtatttcttgcggaattctcttactttgtagctagagggacatagctctggttcctaggtcatcattcttcttggaaaacactggatagaagatttgactttatagatacaggtttatggcttacagaagggaaactgaaaattaaaactaacaggccacttaggatttgctctaaattctaggttgcattgtacattagagtttgagatataaatattcgtaggtatggttgataaagatttcctaaaaagttgtgattttcactgaaaatacatgtttagtcttactatttttcccttttagcttccaataaagacaggacagcagaacacacataccaaagtcagcaccgagcacaacaaggagtgtctgatcaacatttccaaatacaagttttctctggtcatcagtgggctcaccaccatcctaaagaatgttaacaatatggtgagtatctgacttacatgatctctgctttgtggtgaatttgcttcattttcgttgtgattttggaagtttggagagcatgttttaaagtatggaaaacatattcttaggctttcagacacaagttatttaatggacaagctcaagagtaactttgaaattttgacttcaggtttttattcccgttgaagcttctcttattaattactctgttattcgggaattagaattttatatctcttttgtattgtatgtaaagttatcataatatagattccttccctccttccttcctaagctatgccttcagctgggtagtacaggctttgttaatatgctttctgttagctgcttccttagatgtatttattgattgtccctgtccaaactacgtggtgaaaaagagtatgacctttcacttctaaagtgagattactttttcccgctgtattaaagagttttctctgccttccccaaatctgaagcaggctgggtagtgttagcgactcagtgttagagagcagcgttctctgtatcttagcagtcagctgacttcatcaagggagtccactgctgagagctgccagtccttcttccatccttcccacccggccgcctctgtactccaacagcttttaacaatctacttcatacttctccagacagtagatggacgtctccttctctcagtttgtgctgtttgtgctgagctgtgaagcagccacttttgtagattctgaggattagttttctagtcaggtcagctttggagaatttccttttaagaaggctgttcaataccagagttacagaactgatgaattgcgggtatgggcagttcaatagattcttttctttgctaaatttatgctttttttttcttctaaaaagcataggacgtttaataaactgtacagtgatttacaggatgcacttcctgttgtgctgtagctcttcgcctgctgtggagcgcagtattagtgtttcttctgtctgagcatgctgctgccgtcccaggcgcactgctgtagtttatatttgcaatcttctttagaactctagggatgttggcattcatgtagacctcactgaaaagttacagggcctgtaaggtggctcagtgcataaaggtaattgtcactggtcctcggagcaaactggttgaaggtgagaaccaacccctgaaagttgtcattctctgacttccacatggacactgtggagtgcccacagccatactagcacatacactacatgtacaataatgataaaatagaaaacagaaaaatttaaaagaaaaaatatataatgaaagtcagtttttttttttttttttttaaagatttatttattggttatatgtaagtacactgtagctgtcttcagacactccagaagagggagtcagatcccgttacagatggttgtgagccaccatgtggttgctgggatttgaactccggaccttcagaagagcagtcgggtgctcttacccactgagccatctcaccagccccgaaagtcagtttcttgttagtaggtaggtgatacagggttcagtttgaaagtaatgaatgcttaagattcactgtaagcgatgtagtagcattctgtttaataagaattaagaagttaattgttttgcaaaggaggcgatagctaaatgctaattcaggacaggtacaagcctcttaactcatgagttattttaaactctccttgattcattatttacccccacacccttcttccttttctttttccttccctgtcactcccccaccccgatagagtgtataacatactctgggctggcgcctcaaacttacttccctagtgctagcattgaacttctaatcctcttgccactatttccatagtgttgggactaccaatgtcttttcattatgtctggccagcttatagatattaaaaaatataaagcatcatgttttactgttatatagctaacagcaggcttttataaatacctctgtttctttggtttttttgagacagggtttccctgtgtagccctggttatcctggaacttactttgtagaccaggctggcctcgaactcagaaatccacctgcctctgcctcccgagtgctgggattaaaggcgtgcaccaccactcctggctaatatctctatttctgttagcttggaaatttatttttagggtaaaggaagaaatgatagatttaagtatcattgaatgtaaaagacaaagtggaagagtaatactttttcttgatcttcagtcttttatatttcatgtgtgctaatttgtagtgaagtgttaatcatattttctgaatatattttttagaggatatttggagaagctgctgaaaaaaatttgtatctctctcagttgatcatattggatacactggaaaaatgtcttgctggggtaagtaaattcattctaaagaggcaggttttgtgaattcagtcttgagaatgaggtggaacactgaaaggtcagtgtgggacactgaggacacactaagagtctttgtggtagatgaatatgaattctgttaatacagatgacctgatagctcagtctagagaaaattattctctcagcttttataaatcccatagatatttaagtttacttaaaatgttaagtttgagccccatttctgtctcttaagattttgttttaagaaaatatttttatgaaggaatcactattccatttaattatttttcagatatctttagacccgtgcctttgtatagttggaagaatgtggtcagcacaccaagggtagtcttactttcctgccttcatgatatggtttcaactttatacagaccccgacaatgggatctatcctttctttgtttgaagctgtccttctgaggatagctactaccagaagatttgtgtaaatgtgagcattttcataggcatgtggaggagtcattgagtaccacgcagttctttcccaggttgcctctgagtcgctgtgtctacttatttcaattaagactttcactttttcaagatgttttctgctgcatacattatttatattcttccctaatcttaattttccccaaacatgggtaggtgtttatataaatacatgatgaatatttgttttaaaattgtctactccatttatgctagttagcttatttctttttattcagcacagaatacagaattttgcttttattcagaatagcttttctcttatgagttctctacagtaaatctagagggaagacacttaaaacaatttttgaaaaggtattttgtgtggatgagtgttttggctgcgtgtgtatgagtgtgtgtgtatgactggtgcctgcagagccagaaggggcatcagatctcccgggtctggagttactagtggttgtgaagtaccacgtgggtgctaagaccatattcaagtcctctagatgcttttaaccactgagccactctctggccacaagaaggaagagattttaatgtattaggattgatgatgtagttgagaagagaaagaatgtttagaagtgacgaggattatgcagggaattggaaaacaaaaacccaaaacatctcactcacacaaaactttctctagggaagtttgtgagccagaaacaaaaaaaagtatatgatttatttatagtttttaaagtttaacttaaaatgatttaaatttgtgtgtgtatgcttacatgtgggtctgtgcttgagtttaggtgccctcaaagggcagatgcttccgatccccctggagctggaattacaggtgatggcaaatcataatcctacgtgggtgctgggaactgaactcaggttcaagttcatgcaaggagagtgcgtgctcataaccactgagcagaatctccagctcctgtaatatttatttttatttatgtgcatatggggtacatatatggaggtcagaggacaactcttggatagtcagttctcttcttccactttgacaaggattttagggattgactttaggtcgttggttttacacagtaagtactcactaatggaaccatttttgccagcccagcataatacttcaaactcttaaaattaaaaaagtatttatctattttattttatgtgtacgagtgttttaccttcatttatgaatgtttatatgtatgtgcgtgcatgcctggtacatgaggaggtcaaaagagggcatcagatcccttgaaactgcagttacagatggttgtgagctactgtgtgggtgctgacaactgaacatgggtcctctgcaagaacaagtgcttcaaaccactgagccacttctctagtccctgatattttgaattctcattgatctctggccatagtccagaattacagcatttgtaagttttatacttaaaatggtaggaataccatttatactaaaatggtattttagcttggtgttctctgttaatctgtgaaatggagaacaaaaacactattatctagtggggcggaattgggagtttagacattgaaaccttggcagtgctcttagtactttgtaatttttgctgtatcagaccaaccatgattgagttgggaagaatggtgtagtgcctctttaagtttcacaactttttcttcattaacaattttaattgagaggtaatgttatcttggagagtggttgctgatattctttggagatatcctaattacaatgatgccatatttccacagtatacctgtatagtttacatattactttgacttggtctgctttgaaattgtttctttttggtttctttttttcttttttcttcctttttttctttctcttccttttttgcttgtggaattagagattgtattcagggccttgtgcgtataccactgagccacagccctagaactatgtcaggttagtgagttagctgctgcttaggaaataatccaataatctgtaagacagttgggccagttttaaaagtaaatttcatggaatgtaaaaatgagatatgtggagtatgggggtggggtggaaattgctccagaataaagacactgaaggacagaatagtcatgctgtgacctctgaatcacttttgggtcttcagtgaataaaaagctatgaagacattttcagtgtcatgcagtgtggattgggtatttgatacatggaatggtgttatttcttagaatgttaattgtgttgaaattgcgttagagaatatcctcattaggataagctgacatacacaagggctgagatattataatgtttataatgtacttggatgtgatttagctcagcattatttgaggtgcatagtacatgttttggtcagattatacagaggccatgtgctccctacctaattcctctggaagttaaatgatatagtgtactcacagtgaatatgaataaagtttattgagaactcacagggaactgcaagtttctaaaaaggaagggatcgggctagtgagatggctcagtggttaaaagcgccaactgttcttccagaggtcctgagttcaagtcccagcaaccacatggtggctcacaaccatctgtattgggatccaaggccctcttctggagtgtctgaagacagctacagtgtacttacatataataaataaatattttttaaaaaaaggatcaactgataaactaggaaacctgtgaggcaagatggagggtcgggcttcaatggtaaagatagggtgatgatgtcttctttactgaccaggtataggacgatgtggcaaattcaaggaaacgatagcaggtgttgaattcgagtgatagctgtgtggctgttccttctattccagcttctctgtgtgcttgacacttaactgtgaatgtttgcaggtaaaggaaaagccttataattatgtgattatttccattttagcaaccaaaggacacaatgagattagatgagacaatgctggtcaaacaattactaccagaaatctgccattttcttcacacctgccgtgaaggaaaccaacatgcagccgaacttcggaattctgcctctggggttttattttctctcagctgcaacaacttcaatgcagtctttagtcgcatttctacaaggttagtgcctaaagcatgtgggaaattaagtaaaatcaattttagaattcttgtctgcataagagtggttaacagaatgacatctgggtttttgaaggaattctatatattgatttttcttgacattttaattatataatattagaaattactttggagatagtgatatttagacatgaatactattatgaataatgttacagacttggagaagatatctccatggccatctctctctctctttctctctctctctggtgcccgccctccctccctccctccctccctcccttccttccttccttccttccttgtggtgctaaggtttgaattcagggtcttgtgtatgtaggcaagtgctccaccacagagctacactccagccatgggtaggcactgtaaacatattcttcagattaaactatgcaaataggtagaatagttgagaagaatagcagacattctaatgacctaattctcatggctcctaaatttccttaaaaataatctaagtaatatagaaacaaaaggaagtaattacaaagttggaaagtgaggtgtgttttagtgactatgaaagtcccatttactgaggattcacagtttatgccatgtctcacagtgataatgaaaggttgttacaggcaaataaattgatacccctcaaaaataaatgtattgtgctggtatagtggctcacaactttaaaatctgagcatttgggagcagagacaggagttcaagaccaatctttaatgagtttgaatccagccagggctgcacagtgagactccgtctcaaccccccccccaaaactccaacaaacaaacaaacaaacaaggaattgtgtcaaataatggaatttgacacatttccaaatttctaagttggataggcctcaagaactacgttagtttcattatattagttttcagtatttctattttaactatcttgtggaattttaaaatactgtacatttaatttagtgatttcaaaaatgaaatagtcaggagagatcgcttagtagttaagagcacatggttctcttgcagaggacctgagtttggttcccagtgtctgcatggtgcctcacaacctaaaccgtccagtttagggaattcagtaccctgtttggacactaggcacacatgtggtgcacatacatgcacagtacattcatataagcaaccatatgcataaaataaaaacaaacttttaaaaatgtaatttcggtgaaacggaaagtaaagaaaatgttggctggggaatcacttggtctgtaaagaccctcacagagcaagcctgctggatgtgggttttatccctgggaccaagaatcactaccacagtgtcgtcctctgacctacacctcctaacacataaagcttaaaaatgaaagaaaattattgtttaaatatttcctgatcagtcaaaatcataaccatgatattacagatgagaaaattagtttaaaatggtgctcagtgggatgaaatgataaataaattgtgactgatttgtcttcatgaaaatgatttgcctgtcttgtataagtacactcatatgggttcttaattatgataaaataaaaagtataaaacaacccacgtaaagatttagtgactaaaagacaaatacaaacagagaaaagtaatcctttttactctttggttcctctctctgtcacttactagagttacacgaatgggtttctattatgttcactcttgtttcccagtgaggtgaatgggaatatacattaaaattcaagaatttatggcccgctatttaagaactcacttgcaataaaaaaaaaagaactctttttaataaaaagttgttctataattatgatggtaggtgacaatattctatgatattgtatcctacagtcttaataaactatgaaaagaaaatcaaaactttatttaatgatatatcattggttaaggtttatataacagaacatttccatgatattttttttcttggtttttcgagacagagtttctctgtgtagccctggctgccctgcaacttgctctgcagacaaagctggccttgtagatttattttatattctgagtcaccatacactgatggagccaacaaggtggcaaacagggaaataggattctgggcggttatacaaagtaaaacactttcatttaggtcagtacgagattagttttattacttggaaaaaaattcttaaaaagaagataaaaagcaatatagaaaaatacagtttcttagtgtatccatgcaggaattgttaatgtttttatagaactatatttccataaagtttttgagtaagtgtattattctgtaaaatagaacaaatgtgccatctttgaaaaccctaaagttgggctggagagatggctcagcttttaaggacactggctgctcttccagaggtcctgagttcaattcccagcaaccacatggtggctcatgaccatctgtaagggcatctgaggtcctcttctgctttgtaggtgtacatgcagacagagcactcctacagcaaaaaacttaaataattatttattaaaaaaaaaaaaaaaagaaaaaccctaactcacccaaagctgcttccatgaagtttggcagcattagttaatttataggcaacttttgttgattttccaagtctagtagtttgttatctgttgccagaatagaagttgtggctagagtttcattgacttcggtggcagattagccagaaatgggatctatgagataaatgcttaatacagctatgtgtcttgatttacttagtaccagaattaggaccactcacctaacagactgctgtgatggtttaatttacatgggggcatcttatgatactattcttatagctactattcctttatctatatattctgtatatatagaagnnnnnnnnnnnnnnnnnnnncctccctccctccctccctccctcccttcattgttttgattgtgtagacagactttgtctgtgtagctctggttgtcctgcagccagctctctgtagaccagactgacctccgtctcagagatcctcctgcttccttctcctcagggctggattaaaggtgtgcaccaccaccacccaactacatttcatttataattacgatcataaaaatgagttgaactttaccagtttctttgtcagcagatgttctttttggcggtgggcggggcagtattggtggttgaacccagggtgtcatatgttctactactgagctacagctgtagtcttctttttactttgaaaaagggcttcaccaagcttttcaggcaggcctggaactcagtttgtagatgaggctagccttgatagtgtcctccctcagctctcttagaagctgtcattacaggtctgtaacacccacaacagctttagttgttgtttgtttgtttcatttattaattgaaaaaattataacatagctttattctgctgaactgtcttatgctgtaggcttattacactctttagagtttaattttatattgttttatatatgttacttgtgtgtcagtgcctgtggaggccagaagatggtaagggatccatcccctgaagctgagattacaggtggttataagctaccatgtggtgctaggaatcgaacttgagtcctctggaagaacagccagtgcttttaagcaatctctccagccctcattgtactttcttttcttttcttttttaaaaaagatttgtttattattatatctaagtacactgtagctgtcttcagacactccagaagagggagggcatgagatctcattatggatggttctgagccaccatgtggttgctggaatttgaactcaggacctttggacaagaagtccgttagctgagccatctctctgcaccccccctcctcccattgtactttcttacatagaaaattgtttttttataacagacttgataatacttaatttggtgatttatttatttttgttaaattcttttagagacaggtttcttaagtcatccaatcagttgttagatatagatattatctggactatccaacatttcccataaaaattttacctacttgataatctctggatcgattattaattggaagtgggaaaagtaaaaacattccccacgcacgccccacgccccctcttttgactagtgaggcagggtcgcactgtgtagcttcagctggcctggaacttgctgtgtagcttggctggccttgctgtggcttgcttggagctcatggatctctcctttctgtctctgactccagaatgctgggattaaaagtgtgtgccgccacatctggctggagtctatcattctttatttttaaattggacatactgtatttctttatgggttttgtgattgtgagaattaaaatccagagccccttgcattaaattgtgctttctctttattttcttccttctttcctctttcccctctcttcctccctcctttctcaagaccaggctttactttgtagcccacactaacagtaattctcctgtgttctcctgtctccagtttcccgagtgcttggatgatgggctatgataggcatgagccactatgcctagctgaaactagattcaaatgtaaactatttcatttttttcctgtaaactgtttttttttgtatatttatatcattttaatataatataatctaaacagggaatgcagggtagaggcctgttccaccattattcctttttagattgaagtgattctaaaagttggaaaagctcacctgtgagtttcttctctcagtaactactgctcctcctgcccccatgtggattgcagttgtagaaaaaagaaaagttggggcaggggcagtaggatggctcagcaggtactggtgcttgctgccagcctggtaacctgagtttcagtccctgagacttgtatggtggatagagaggacagttctgtttttctgattgataatgcatgctcacatataataaataaatgtgattttttacaaaggaagaaaatctgatactccaattgtcccagtttaacagttatagtgtctgattgtacagctgtatgattttggacttgactataatagttgctaatttccttgtcttcaatttcagggaaacctaaatacatttgaaaatatgctccaatcttagaattaactagtttttccagaagagccatggctaatgtgagaaatacaattcagacctcagtgttaaagatacaaatacaaagtttactggaatatcactttttgtcatgactcttaaatcggttgaattatttagttttttttaaataaatatgttcttattttatgtgtctttcattcataaaccccctttctattaaatcagaatcttggactgttctaagacttaaattgataaattacttttgatttttacttttcaggttacaggagttgactgtctgttcagaagataatgttgatgttcacgatatagaattgttacagtatatcaatgtggattgtgcaaaattaaaacgacttctgaagggtaggtttaaatagatatggttatagtaaacttgtttgaactggatatcaaaatagattttatagtgtgcatgttcttgtgaaatggccagaaatgtatgtgcttgactggattttgggcatttgaaaataatacagcagaacatgaattttattttttgagacagggtctctctgtttatccctggttttcctggaactcatttttgtagatcaggctagccttgaactcagggatccacctgcctctgccccctgagttctgggatcaagaagggtctttactgtcatgttcatctgagaatatggatatttaaaatcttggcagtaggaagttttcttttttctttttccttcctcccttcccttccttcccttcccttccctttccctctctccctccctccctccctctctttcctttttttttttaaagattttttaaaaagttattttatgtatatgagtgctctaactgcatagagacctgcattccagaaaaggacatggaatcacattacagaaggttgtgagccattatgtgcttggtgggaattgaactcaggacctctggaagagcagctagtgctcttaaccatctcttaaccgagccatctctccagcctgggaagttttcttgagctacaagttttgcttttaataaggagaatgttatccttttagaatttgatcccttaagtgactctaggtcgcagaatcaatttgtttggttgtccaggtgcttgaagaacatggccttgagctgctggagtagtgtatgcctgtaatcccagcacatgggcagatgaggaaggagagttcaagaccagtttgagctatgtagtgagttcagtgtcatgatgggctatagaggaagccctggtctccagaaaagtaacaaacgaacaactccctccacatcaaaggacggagtgaaaatctcaaacagtggcttaatttctgacctgagagactgagcttgagttatgtaagctatgagaagttttaatagttgtgtaatacagttttcaaaatacttaatattacaaaacatgctattaagctggatgtagttatatacacctttaattccagcacttgggagcaggagcaggcagatcttgtgagtttgagaccagcctggtctacagagctccagaacagccaggtttctgtagagagacccaatctcaaagaaacaaaaacaaaagcaatacagtgacagaaaacttttttcttttttgcctttaatttagtacacaaattttacatgtgttcatggaatcttgaattctttgaaagtcagttttaagagaaaaaagtttatagacatgagtgtctactatttaaaaagtcagaaatatcccagataacctaatgataacctcaaggtcttagaaaagcaagaacaatccagattcagcagcaggggacagctggaagtaacgatggtcagagcagaaatcagtgaactgaaggatgaaagaactgtgtagagggaaacagagagtcggctcctggaaagttcagcaggattggcaagtcctggcttgtcaagactccatcaaattagagatgaacaagctgagttaactacaggtcctagtgaagtgcagagaaggagggtatattctaaatagttggtaaacctagaaaaaaaatgggtaaattcttaggtctatcaaaactgagtcagtatggtattaacagcctcaatagatgcatagcaatcaaagacattgaagcagctataaggcaattcaagtagtaataaaagatctcccaacaaagaatgcaagagcagatggaatccactgccgaagtcaaacaaaaatttcctttacagaaaaatagcaaaggaaggagtactaccattctgtgaagccagcagtacagtgataaatacgcaacaaaaagaaaacttgaattctcaacagaactccagaagcaaaactccagaacactgtggtttccttccagggatgcagtgttggtttaacacaacatagaataaaccatagagtaaaccagcatgtaggtttacgagcagaaattacccggtaatcacaggtgatcagaaaaggcccttgcttcagaagttcagcattcctttataataaaagctcagcgggcataaatgaatgcaccaaaacataaaaaaggatgcatatgaataaaacccatagccaacattatactaattgaggggaaaataggagaagttcctccaaaatctagaatgagattaaggttcagactttgtgtggtgcagacttttaatgccagtactcagaaggcagaagcaggtggatctctttggtttaagcctagtttgatctagttccaggccagctaaaaccatatattgaaacactgcatcaaaaacaacagcaaaacaaaaacaaacaacctaaaagtttccagttctcttttagaacttagtttagtatgccaaatcttacctagggcagtaagtcaagagagagcaacaaaaggaattcagatggggagcaaaagtccaatttccccagtgctgaggcaacatgtcttgtttcacagcagaactgaggtgggagctccccctgctggctagttttcacagtgcagaagttgtatgtgggagactggaggagaaaggcattaatgaggatcgcaccgcagagatctctgccacccataataccaacttgtaggcaagatgtactcattgcagtagtggcacaaccatacggaaacaaccagatgctctgtgcttggttttgaagcctgttccccaagagggagtccatgcctggaactgtgaacctagttaacttcctatgcctgaggtctttgaccctggaagggaacttactgttgttgtttagttaaattgataaagcgccaagctgcctttaaaatacttaggtttatgttcgtgagttaaacactactttgaaaagtataatgaataaggaaaatttagagtcacatggctgctgaagatactgagagtaagtagtgggcaagtgctcagccctcaaaaaaaaaaaaaaaaaaaacaaaacattcaggctacctctctgaggctcagggagcagtgtagaatgaggagtgggaagagtagaagagctggaagctaatgagaagagctgcaaagtactgtcatgtggccgtgacacagccaatgaaaatcatgatctcacagcagcagcagcagcagcagcagcaatggacctatacaagactggtcccatctacagtcttcatatatctgagaagggtccatttggtcctccccttccttgctgaactatgaactactaatggatttgggttgggggagagcaaacaatgttatcttttgtgtaccacctgatcagcctatcgttctctgatgaatagtagcagacccctggtcacacaggtgaccctaattaaactcagtgcatcactgagtacaaaaatgtaatgtgtgaataggattctagggagtcatagaggtaatagtgaaataagagggagaagtttgacaggagtcagaaataggctacatatatgtatgaaattgtcaaaagaacaaaaataataaagtaatgaatagaaatatgagtaaatacaatttttgttaagaaagaaaaaaatagactttatacacacccaaaaggggatttattagagtaacctataggtgtggcccagatagtccagcaatggctgtctcctgacagaagggccaagaaccagactgggatgtcccagcggtcctaatattatgcctggagtcctagaagaagtcttagaaagctactggtgttcagggatatgttggaatacagaaagaagtagcatcaagagatgcccttaaaggattctgctgtactcaagacatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccctggattcctgaatccctggctagggagaaactgaaccatatattagatgctgaagcacatactgctttctggagaaccctgccccagtcttccagggttctgtcaccgatatccattgtaactatgtcttccaaaggctattcacaccattctgtcaagttagctgcttcaggaggtagggaacatggtaagaccagtgaattccgtgagcattagcccactattatatttatttgcctgtgaagtgagttacttggttagaagcagttctgtgtggaatatcatgatgatggataagacattctgtaagttcatggatgatagttttggcagaaggaaaagcaaatctataaccagagtaagtattctagtaaggactaagagttgccctttctatggaagaactggtccagtgttgtcagactgccactaagtctctggctggtcacctgggagaatggtgccatatctggggctcagaattgggtctctgctcctggcaggtctggcactcagcagctgctataaccagaacagccttggtgactggaagtccatgttgtcaagcccatgtataacgttcttttttgccaacatggccactttgttcatgggcccattggacagtaacagagatggctggggaaagaggctgactgtgtacagaatgggtcatcctttctacttcattattgaataacccctctgcaaaagtcaccttttgatgaacatttatatgggccacaagtatctttacatcatttgtccatttggagagatttgtccccatcttccctagttaacctttctcactaactttccattcatgctcctaagtccctaaccatcctgccaatctgttggcttcagcccatgagttcaaaaacagtcacatctggccatttctcattccaagcagaatttacaaccatgtgacctgcccaaagtttgctttacaatgaagatttctcttcactggcattttttatggttgttctgtaaagaggttataatgcagcagctttccacacctgggtggtgcctgcatagtgtgcagaaccatcaggaaaccttggtctccaaacttttcttttctcagtcagttgattctaggaaacaccccatgagatcataggtacatgcttgttaggaaaagacactttaacagaagtagaaaacaagcacttggacaacttcttcatatatcttgctcaggacctactggagcctgatcacaatatattctactttcatttgataatggtttgctgttatgttcatcctacttcatggcttggtattatggctggtaaaaccaaatactactcagctcatgataggtagctcagatagcatagtaacttggtggcccattcaatagcaggcaaagagctgtctcttaatgggagaatggttgtctgcagatggcaatagatccatgttctaaaatcccaagggtctcctctcacctagaggagcctaccaaaggctataaactgctactgccatctaaagaaccattttagcgggtctcctggatcacatggtccaagtggtagagcagcctgcacagcagcctggacctgttgacgagctttcttgttctagctcccctcaaagctagaagcttccttccttacttgaaataacaaaacaaagtgaggagtatgctcctctggaatccaaataggcccaccaagctttgtgctgctttcttggtcgtgggaaagaccagatgcaataacttacccttcaccttagaaggaatatttctgcatatcaccactggacttgtagaaatttccttgaagttgaaggcccttgacttttgtctggatttatttaccatcctcccatgtacataagtgttaccaatatttccaaagtggttgctccttcctgctcgcttggttcagtcaacatgatgccatgagtatactggaccagggtgatattttgtagagagagatgctcaagctcccttcatactaagttatgacacaggactggagagttgataagtactaacctcgaggtaaaactgtaaaaaggcatactactgacttccagctgaaagcaaattgcttctggttgtgcttatggacaggaattgatagaaagcatttgctagatccatagctgaataccatgtaccaggagctgtgctaatctatccaagtaagggcatcacatctagtacagcagctgaaatttagtcactgcttgattaagttttaatggtcagtggtcactctctatgatccatctgactcctgtgctggagagttaaagggagatgtgagaactaccatccctgcatgtttcaagtccttgatggtagcatggagtattatatttggttcactatgttcccagaggcaatgccagtctcttcaatttgtgatttccaaccataatagctttcagttcacaggtcaaggaaccaacgtgggattttgccaatgtctaagtatatctataccaattatacattctggaactggagaaataaccacaggatgagtttggggacccagtagactctctgtgatttgggtttcagtcaaaattccattaatcacctgataatcataagccccgatttaactggagggccacagtgctatttgggggtctcttggaaccagtgtcagtttaaaacgagtgtccagtaaaccctggaaaacctgattgtttcctttttcccagagtacatttacccttgtaaaaggtcataggatgggagaagggctaacagtaaaacttttaggtattttagcaaggtcctcagggggacctagccttctcatcattcaaggactttggggtctgcaaactagctcaagtctggaaattgattgataagttgagatacccctttgctactctgcagtattctttttgtttgtttgagaatttttttttttgcttatatagatgtaaaaacaaacaaaacaaaataaaaacatatattcctggaagcattattagccagtacaaaaagatccgtaggagtcatgccatcataaaagttactctgtctgtgctgcccttcatgataaatattctcgccttgcctttggcaatgcagtgctgatacctggccctgctactctgggggcctaattaagcccatcccatttaactttttggattgagcatcagtgtctccaaccttaaggtctggcacaaagagaagagcgggggcaaagcccttcaaatcctggtgcccctcttaccattttgtgcctcacaggattagtgaagagaatgtcttctgggccttcccattgtggaggattcggttttatacagcacacccatcattgcagtttctctgaaccctaaaatcccttcatcaatactaagtcaagggacatcaggtatccacagttccctttcagtagagtatggctagtgcttagccaaccagtcacgcttttgatacctttttaactgtaagaacgtctgtattgaacttagaaccttaactcagtgggcccatatcaataaattcagcttgattcagttttatggtttttttttcaccattatttcatgcccttaaaaatccattctcatatatattgcccagactacggcttgaatgaattcacaaactcagtaaactttagtattgtaccacacctttgttgtgaatttcactttctgtttcgctcctagaagccttcttagccttgatactgattatagttcagaggcaattattgtcgacagacactgagcggcatcagtattgccttgcttgatgtttctctttcagtgaaagtcactgaaatttgtagacaacaaaggattaatttcctcaggccaaggtacaaaaggaaatattgcaaggtgtgacagtggggccgcaccctacactaagagtgggcagactactgccacaggtgagacagacgcatcagaatttgaagggtcaaagtcctcagcacctgtcccctacacttctccatctcaagttacaggatcccaccccttaccagccagtgcctttaggctcctatttaccttagcaacaggagaagtgcacttgactagggggagtgcaggcaggcaggcaaaagtgaaaagtttctccttccatgttccttcacaggtgtgattccagatatagtcaagttgacaaacaagattagccatcatattacctaagtttctgacaaagctatcaaaaacatgcattggagaaaaggtgccctctttaacaagtggtgctgggaaaactggatctttctctctttctttctttctttctttctttctttctttctttctttctttctttctttctgatttattttatttatatgagtacactgtaactgtcttcagacacaccagaagagggcatcaaatcccattacagatggttgtgagccaccatgtggttgctgggatttgaactcaggacctctggaagagcagttggtgctctttaacctctgagccacctctccagcttgaaaactggatttctatacatattgtgcaacaataaattcagtgtcttagttagggctttattgctgtgaacagaaaccatgaccaatgcaagtcttataaaggacaacatttaattgtgggtggcttacaggttcaggggtcagtctattatcatcaggggagaagcatggcagtaaccaggcaggcatgatacaggcagagctgagagttctgcatcttcatctgaaggctgctagcagagtattcatttccaggcagctaggatgagggttgtaaagcccacgctcacagtgacacacctactccaacaagaccacttcctgggccaagcatattcaaaccatgacattcagtatatcaaaactctaatgaaagaagaagacaggtaaaaatatttgaagacataggcatagacaagaattttctgaaaaggactatagcacaggaaacaataccaagacgtggcagagagagttacatgagattagaaatcgctaccaagcaaaggacacagtcactagagtaaagagaccatttacaggcttgggaaaagaaatttccaggcttacatctggctggggactggtatctatgatatataaataactgctaaaattaaactctaaaatcattttagagtctgtagataggctcatgagctgaatagagtccctaataggagaaatacaatgaccagtagatacttggaaaaagttttcaacattcatagacatcagggaaatggaaattaaaacctctttcagattctgtctcacttcagttgggacgttgtcaagaaaacaaaagacaacagaggggaaaatgtgggtggggctagtgggatcctgagtagctactttttatttttctgtttttttctgttttttttttttttcttttttttgtttttcgagacagggtttctctctgtagccctggctgtcctggaactcactctgtagaccaggctggcctcaaactcagaaatctgcctgcctctgcctcccaagtgttgggataaaaggtgtgcgccaccactgcctggcagtgaaactccactatgacagtttgaagggttcctcagaaaaactgataacagaccatgtgacccagatatactactatattgtatagccacagaaattcttgtacatccatttttactgccacacaattcacggtggcttaggaaataaaccagcctgaatgtccatcatgagaagaatggaagccggacagtggtggcacaccctgtctcaaaaaaccaaaaaaagaaaaaagaaaaaagagaataatggatacagaatatttggtacagtgagtggtggtggctgcaacagtaggcatttgtgtggtggagtggaggaaaactggaaaggctagtggaatggccaaggctaagttaatttcttgctcatagagagctggctatgtagtttcctgtgggccaaatcaacgaacacttgaagatgcacatcatgggccatgggtatgtgggtgccactgctgctttgtacagggcaccttactgccaagacattggagttggcacgtaatgctttcaaaggtctcacaaggaagcctatcagttggtatcacttgcagctcacagtctgtggtgaggaagatggattcaccaattaaggctaccactgttgggcatagtgtgattctttacagccacagatgtcagattgcaaaataaagttcagcagaaagctgcccaggagggttattttaaccaacctacttcccagtgttctgtaactggagcagaagataacggtgagcagatgtggaagtttgtttgtttgtttatttattgcttatgaatatactttagctgtcttcagacacaccagaagagggcagcagatcccattacagatggttgtgagccaccatgtagttgctggaaattgaattcaggaagtctggaagaacagtcagtgctcttaaccactaagctatctctccagtctggaattttaaaaaatagttaaatggaaaagtatagacaattactatagccatgataaaacaaaacaaaacaaaacaaaacaaaacaaaacatttgtatgttcttggagcagagtttggtaaagtgcctttttatgtggtagcagttctgtgttgattggccagacttctacttcgtgttttttattaaaaaatatttttataaaataaaaaactaaaatgctatattatgataatggaattttatacagctgaaaagaaaaatgccatcatgacaatttccagaaaatggattcaaccggaatttattatgttaagttaaataagcttggttcagacaaacaagtcatgctttgttttctgtagggaacttgaatttaaaggtgtgtttatgtgcatatgcgcactcgtgtacacacacacacacacacacacacacactacagatagatcatgaaacggaaaagatcttaagtaaaggggaaacagagggtatggaatatgtgcaatatggaagcagaaggttggactgcctggttaggaagaaagggagccagctaggaggaggcaggtaaaaccgggtaggttagggataacaatggagagcaacatagaatgacacatgtttatgaaatgtcacgatacccaattctttgcatggtaacttaaaaattaaaagaattcaaagataaagtgtaatctaagtattcagattatcaaaattaaagctgtcctactagacagtgatggcaagcatgtggcagatcgtcagtatacagctcagtggacaacttttctgaaaagcagctctgtagatttcaaaatcctcagaaagtatttgttccttgctgacacagttgcttacgttgaagaaaaagatggtggataaaactttacttaagtataagtatttatcagtactactcaaaatactgaaatgctagagatttgttaaatgtatgactgaaaaacatttaaataaccagtgtctgttttttttttaaggttttgttatgtgtgcatatgcatgtagtgccctcagacagcagaagagggtgttggatcctctgaagctgaggttatagatggttgtgaacaggtgctgggaactgaactcaggtcctgtgaacagcagccagtgctcttgaccactgaaccacctctccagcccatataggtttttgtttttgttgttgtttgtgggacaaggcctctctatgtagctctggctgtcctgtaactttctctgcagaccaggtctttccttgaactcacagggatcctgcttctacatctacaaggtgttgccatcatgactgacttctgtgtcattatttaatagacttaaaaataagatgtatattgttatcgtatgtgtgagggtgctttggctgcgtgtgtctgtgtggcgtgtgagtgcctggtgtccgaagaggacagaagagggcgcctgatgctgagctcccttctgggtgatgggtatcaaacctaggccctgtggtagagtgtctagtgttcttaaccaccaagccatttctcagtccccatgtttatagtttttgtttgttttgttaatcaatttaaaaatagagcaaagggaaaacttgatgttcaagacatgtttgcttttcatttacttctgtctctatcaatgtagctcatgggtttgggggtttatatttatttttattattaaattgcttattaataatactggaagcaaaacagtttataaaattattttatagtagttctgaattttatttgttaaataattgagagttaataaagcatttttttccctccagaaacagcatttaaatttaaagccctgaagaaggttgcacagttggcagttataaatagcctagaaaaggtaagcttcaacctcttgggtatgcaagttttgattttgattatgaccttggctgtattcggtatcttgagtataagaaagtcaagacttgtgtggtacttcctcttaatgggaagaatgcaacacgatatttgtgtgaagaaacttaaattctgtgttatttaatatattggaaaattgactgctttcctataaaaacatgtatttttgttacttgtaggctttttggaactgggtagaaaattatccggatgaatttacaaagctataccaaattccacagacagatatggctggtaagctggctaaagagtgactgggtgtggggtgaggggcggcatggcaccttgtgaaactctcagagggaaatgtgctgcttttcagtttatttttttcaaaagtgttttttctgttttctttgttcagctctaacaggaattacagttttctctcctgtttctgtattatttccagtcctttcccttctgagcaagtggtaaaagaagtttgaagtgaagctctagtctttcatgttgtgattgaatactggtggctttctcacagcgtgcatgtgtgtgcttgtgagtgtgtgtttcctagaattctatatttaggtatatctaaggaggaaatactatttttacttctgaatagcaattttgggggaacgcctgcatagtagaggctagagacccccgggaaactatcagccttttgtttctctgtgagaccctgagactgtgacaacacacagcgattctaaaataccaatgcttctaggatgtgtcacattagctcttcttacacttctcttagactgtgatagttgagtgttttaataattctaggttttaatttaatgcaaggattttcttgcctaatataatcatttaatgtttgtatttttcacagaatgtgcagagaagctgtttgacttggtggatggttttgcagaaagcaccaaacgtaaagcagcagtgtggcccctacaaatcattctccttatcttgtgtccagaaataatccaggacatctccaaggatgtggtggacgagagcaacataaacaaggtcaggagggaaacgagtggctgccatctcctgatgggagcagcttgtttattcaaggtgtacattttagttatgtccatgctaggtcaaacagttggttgcccttagcagagattactcatgttatagtcatgactgaaaggctctgacctctcttggttttaatgctgaataatagtaaaccagataaattctgttatttaagcttgtattcaccattaaaatacatttagacatatataatttacctttatgtttatgaattaaatttggctggctatttgcaaataaattgtatagctaacaatgcattttctaaggcttcagcacaatgacttgaggaaatgtatattgactatgttttttcattatgaaacataactgtcctaacaatttaatttctgcaaaactaagaataaaaattggaaattttcatctttttctatgggctgaaataacctagttagataaaaatcagttaaaatcatcaggtcttggtgattctaaattttccttattatcattagtttaaaaaagcagagattttcaagatggttattaattggttaagagtactctctgctcttccagaggacctgagttcactttattcttatttattgatgtacaatttttatataatcatgttacagccctacctggctttcagagtctttaatgtcaccacatttagttttggttttggtaatttcagtctgcatgcatgcataacacttggttggttggtctgtaggttggctggctgctctgtgtgtatgtgtgcgtgcgtgatgggtagcaggttccagactcatggcacacataaagcaagcagacacacaagcatgcacagaaactaaaatgaatcttttaacaagatcgacttttttgcttttttattacttatttttcagtaaaaaaatgtgtgtgtgctctgtgtgtatgtttgtgttccaacagaggcataagatcctttagagctggagttacaagcagttctgagcactcagtgtgcgtgctataaactgaattcttgttctctgaaagagtagcaagtggtcttaactacccaaaaccattgcttctgggtagttaatttttaatagttttatttgcttgctggtgctgctttttaaaattaaaacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatattgtttagaagactggaggtttctatactctagagtagtagaaaaaaagtctaccacaaccaatacaggctaatgattaagcttcaaaggtaacatcgaaaggaaagatatagtcaactaatacttagttcaaatgtatagtaaggaatgtttcctttctctatagtaagtcaacagagaaagtagagaaaagtgtttcatgcatttttaaaaaagtgcttactctttaaatatgaaatgatagccaaatacaagccatttgtgtttatagttggagttttagagttggctaatttgctactttgttagatttatctgtagtagtacaaactaggtgttttgtcttcctgtatttccattctgtagaagctgtttctggacagtttacggaaagcactcgctggccatggaggaagcaggcagctgactgagagtgctgccattgcttgtgtcaagttgtgtaaagcaagtacttacatcaactgggaagataattctgtcattttcctactggttcagtccatggtagttgatcttaaggtaatatgctgttctttcccttctatagactttaagaaaattaagtggataaccttcttgtataaatattctgctgaagataattgctaactctaaattttgagttaacttagatgttgtgttcagaggacctgcttttgttgttactgtgctcattagactgagaacaggaagactgatatgcactgggtttccttaatgtatagatagatgcttggatcgtagatgatatcgatagactatagtaaccagtatttagtgctttttccggcgactaaagtttattataatcaatgtgactaatgttgattatgtttatattccttgttaagtaaatacttcatgactatttaaaggccattgttttctattgggatttttatagaacctgctttttaatccaagtaaaccattctctagaggcagtcagcctgcagatgtggacctcatgattgactgtcttgtctcttgctttcggataagccctcacaacaaccaacactttaaggtcagatcgttgttttatataaccatgcatattatatatatgtattatataacataatattgatgtggttatctctataaaatgcagaaactataaagatgaataggtgtactttcattagtgtttcttttttttaaaagatttatttttatttcatgcatctggatgttttagctgcatttatatctgtgcaccatgtatgtgtatgggggtgacggaggccagaagatggcattgtgtcccctggaactgtagttctagacaattgtgaactgctgtgtgtgagtgctgggaactgaacctagatcgttttaaagagcagtcattggtcttaaactctgagatatctttctagcctcttactaatatttcttaactctaattcttgatgttaatttcaacaccttaaatttattttattgaaagtaacttactttttgctgtttttttctctctgtttgttaatgtactttttttttttttttttttttttttttttttggcagatctgcctggctcaaaattcaccttctacatttcactatgtgttggtaaactcactgcaccgcatcatcaccaatgtaagtctaaagctagtactgtactactaacaagtaaagtaaaagctagtactgtactactaacaagtaaaggtctctttgttgatttgggttatatgttcttttctttttaaggaagattctggttttatcaactgttctgaacttagacctttctgtaaagcagagcttccctaagatgatcccacgagcagttgatgtccagctgcagctgtatattcagtctctacctgaggcttttagtgagagggatggagttaatagaatcttttgtaaggaataagcctacaaagtgtcatttaaagttcaaaatctgttgagaacaatgccactgaaaaacaatttagtgctttctttcttactatctttgttaagttggaaggaagagtaattgtagtacagcctagctatgggcatttaaaatggtgaagcttcatttgattttaccttttcatccccttaattagaataaaacacatgctttaaaataaataccacaagagacaaaagcatttcagagaaaatagctgacttcattagaggtatttgtgctgtgtgtgtactaaatggaaagcagacaggaaggtagtagtagatgtggactgcagaatttaaaatctccatgtatggacattcttagtcatgtatgtttttcttagtactacttttacacattggcagatatgatacacttatgagtaacttgttcactttgtttctttttttcctcccttaaagtctttgatgactaatactttggagtatttgtcttacttctaaattctgttatgacttgtgaattaaaataatacccattcctttatttgccttggaattatcaaattaaacctaacattactcttttttaaaggtatttttgcaggggaaaataactgctgatcaagctacttagtgacatactcattttgcttggtggagtgctagtagcattttaggatgttgggtctctgttttagcctggccttgcaggacatccatcattcatgaaacggcaaccacgctctatctcctgcattatgaacaactaaatgcttaggaataatacagccctcatttgaatatcactgatagaggtataagttacacttaatccagttagttccaatgaggatagtattgtgaatctaagtgtagatagaatatgtttatatcaaaacctgtacatttgccagtgtaatgactcaggccatcgtctcattgactcagcacattgactcattctaagctttagttttaaatttaaaaaacaacaaaaaagatgattttcctatcccataagtttatatgtaattccaaaatactagttgcctaccttgattcaaaatattgaaagtattccacttaattagataactttatatgaatggttaacatttaataaatccaagtttatagtctttggatattctgtgattagttactttaattgtgaaatatttttgtctataattgaatacatagagcactttcaagcatggacttggcactgctgtaagtggctgagctgcttctttctgggtttcaagcatgcctggagtgttagttcctgcatgcctccgtccgtctgtgtgcctggtgaaagcgtgttctcccctttctgaggagtgctgcatgtatgaaggcagagtgtgtctgcatccggggacatttgtatataaagcacccatactgactagtctttaaatacatcaacatctgttgagtggaatagcttgtaaacaactcagataatgccaatgtgactttttgtttgtttgtttcttgagacaaggtctcaccatgtagttttagacggtctgaaactatgtagaccaggcaggccttaaactcagagagctccatctgcctcctgagtggtggggttaaaggactgagctactgtacccagcttccaaagtgactttcagttatactttagttatacctcatccttagagattgctgagtaaattgtgttttattagagtccacactaccaagacttgaggccaaaaaatactgactttaaagtacttttaattgttaaagactgtaacagtaaatatgcagatttatacagttgagttttatagagttttactggaaacttttagtaggaaaatgtttgttttcaagtaatatgaattctttcctagattcatggagtctagatctttaatttgttggtatatattttctttttaaatgctttggttcagtatacctcctcagcgcaccttttccatgtctactaagccagtttacagctttaaaaaattattatgttctcctaaaagataaaagttgtaatctttttgtgggtttatatagaatgagaaattatgtttggagttttatattgcttctgtgagatgtcctcatacacaatttataagtactatgtttaaatctaaaacattccaatttcttttagagattcttaaagtctattcactatttgaattttgatgcagtggtaattttttttttagtagtttctaaagtggtatttatactgtcactttttgaaaatgatgtgcactaagagagaaactatagttttaagatctatattacatctgtatcatctttataggctttttaaaggttaaattagatgtgcagctaggaaattttaaaaatatacatgtaagtcaacatgctacagataggacagtagttcattgcagatttttttcttgtagcagtttattgtagtttgccttttaatagttcatatattgaaggtaatctctggcaagagatggttaaagaagtatttctagggtacttgaaaattatttaaataaccttgaggaatgtacataattcacttatattagtcttaatatttttaataaactattgttaaggggaaatgtctatttcattgactagtttcagaatgcacacacttagtaactgactaaaacactaaagttttattaactcagggatgtctaatctttagtgcctattttatttgagaatatagcctttactttgaaataaatgaattaattccttatgaaaatagaaaattataaaaaattttaaatcttaagtctaaaagttaatatatagttgtcttagttagggtttctattcctgcacaaacatcatgaccaagaagcaagttggggaggaaagggtttattcagcttacacttccatactgctgttcatcactaaaggaagtcaggactggaactcaagcaggtcaggaagcaggagctgatgcagagaccatggagggatgttacttattggcttgcttcccctggcttgctcagcctgctctcttatagaacctaagactgccagcccagagatggtcccacctacaaggggaccttcccccttgatcactaattgagaaaatgccttacagttggatctcatggagacacttacttccccaactgaacctcctttctctgtgataacctcagcctgtgtcaagttgacacataaaactagccagtacaatagtgcatacatattactgtggtacagttttgcagttatcaaaaatgattacatagtaaggtggttgtggtggcttatgcttgtagttctagcatttaagaggctgaggcaggagaatcacaggttctagaccagtttggacaacatagtgaattccagcaagaacatgtgtcaaaaaccaaacagatgtaaactaaaccaaaactgaaaatagcaaccccccactcccagtagtttgataagatattaaaggagatgcttgtctatttagtttattgatttctgccaagattttatgcagtgtataggaagaagtcaggactcagtgtactctttttttttaaatcattgagcattttgttactttcaggtgattaacaaaacatagaaatctggttacactgatcactgatggccttgggcagatcagtgcctcaaatctgagagatgtgttatattttgtgatggttagtgttgtcaataaagtctgaagatgagcctttgagcatatccatgaagattgatatcatgattacgttaattgagataggaaggcccctgaccactgtgtggtaccattccctgggcagtgagcagagaaagctctttgttcctgcttatggatttgatgtgaccagctctctccagctcttgccactttaacttccttgccactagaacctggaattgtgagctaaataaattctttctccctgaagttgcttttgtcagagtatctaattacaacaacatgaaaagaaacggagacagtaaacaccaccagtgtgtaggaattggctaaatcaaataactgagagacagcataaccacaatagtttaacatttatatttcttaaattaatgaatttttaatgtgcatggttgtttagcctactatatgtcagtaggggctagaagagggtgttggatcctctggagcaggagctgcagatagatgcgaactgccatgtaggtgctaggaattgaatcagggtcctctgtaagagtagccagtgcccctaactgctgagctacttctctagcctctatcttacttattttttaagatgaagtctttctgtgaagcccaggatatcattgaagttcctcatgccttaacctcccttgtgtcaggattaaaggtgtacactactgtgcttgccttagtttttctgtaaagagagtttgtaactcaaaatactgtgagctgtgagaaacttaaatgttaagactagcttgattttttttttaaatgaagaataaactataagtaggatgaagctgttaagtcacatgtatttactatatgactgtgttatttaatatcagatttttaattaaagtattacaaattgaaaatttatatttagagcatattgttttcatgtatagcctatataagtagtgaaagtttatccagtcacttttctataaactgataaactttaatgctttttcacaattattatttttcaagcatttaaaattgaaatatattaattaaatttaaagcaaaagtcatttaaggatacacttaaacagattttataaatcagctagattggctaaatggaaataggaaaatatctatatagaataattattttataaacccttagctaggtctggggatgtagctcagtggtagagcacttgcttaacatacacacatcccagggtcctgactttaatgtctagctttgtaaaaacaaagatacttagctaggatcagctgtctttgttttgggtgaccatttagtcttccatgtgttgtgccatctgcttatcaatgtaaaagattattgatatactaatggctttattccatttactaatttcatgttaattgttgtttgtaagcacttgactaatggttttacatagtctttcaacattgtgttgaaccactaatctcatggaaaactgtgatgatagcattcttacctggtgaaaaatatataatgtatgcatgtgtttctgaaatttgttaatactaaacttttttaaaagataaaaattggttgaagaattttacaaatagtttttaaatttaatatggcattgttgagaaaggacaacctcatttgcacactcagtattctattttaacatgtgtgtctggttagtgtttgacttaaagatatcatttgaagactttgaaaatcatattgtatgtttgcatggtcttagaaagtttttcagaaaagtataaaagtgtttaaaaaaaaaagaaggtatacagcagtaaaagaatgtgtacagcccgtgtgatttttgtactctgatctctcgttttttcttcagtctgcgttggattggtggcctaagattgatgctgtatattgtcactcagttgaacttcgcaatatgtttggtgaaacacttcataaagcagtgcaaggctgtggagcgcacccagcaatacgaatggcaccagtaagaaactatgagctttgaattccacctgtgtactgcatttccagtcttctcattcctgctgatggagttaacgggttgactgggtccttccttctctaggaatgctgtattgccatgccattgctgcccagttaacagtagttatttttcactaaactttattttcctaaagttttctagaaaatgctaacatcttaatgaatgtcatctttcttgtgtttttggtttaactttttcttactcagttgttttaatttgtttcttactttcagaccttgggttagagtgagtgtcctgatgctgaatggtatacggaaaattagaaaccgagtaaaacagctattatttaaaggatttatgttttagtaaatatgatcatttagcaaaaattgataggaacttgacattgatgtttattgaaacttaacaaaggcttactttgaaattgtgttccaagagcttagttaataaagactataaatccatagagagtgggttttcatagctaatgataagattgtgcccatggtttccttactcatgtgtaggaagagcatttacatggcgactcttgatgttgactggtggtgctttgtcttctgcttactttccgatcttattggctgttgttgctcacgtggtcaggtgctagccagtcactgtgtcacagtgggcttctgtggctggaagtacatatgatccattgtaactacctcagaaaagtccttgatttctttgacttttttgaatatagttaccattatagtcacatcatgtcatttcaaatgaaaatgtatcatgtcttcacctgttggttttatctaataaactatgcatcttacacgaatggttaagcaggtggctctccagcatgcttatctttccaagatgctaaggacacagcactttcctttatacagttaggctcagtcctgcccagctgtcagaagcagtttctaaggatttaaaaaatatgccaggtgttcaaatgaggaagttttctatacaaggtaccattgtatttttatcctaaaatatttatttttgtgctaaaaataatagctgaaagggcatgtcattgattttttttttccttcagtgctgaagatcaataccaggtttcccataaacgcctaacatatactatactacaccccctgcctcaatggtattttattaaataaaatttaatattcaagcttacttagcttactttttgtgatggtatgtatacaatacctttaatgtaaaaaaattgttacagtatatatgttagtggtaacatatagagtagctatgtaaatatttcttaactagacattttctttaaattgtagtaattccttgaatctacccccaccttgtgttttgcactaggagggcatgctaactgtcaaacccaggagggctttcctctgtccagctgtaccactcactgatctgtgtctccagcctcagcttgctgtgtgctgggccatagctcagtgtaaagtgctttcttacctcttatactgataggaagataattggaattggtggaaaaccatatttgcttcctgttttatattcaacccaacacctctgccacttaatttttatgcacgagtgctgaaatgaaatgaacctcatttattcttttgaacggccacagatttggttggtagcctgacagatgataatctatacttttaatttcttagatttggttgttagttaacacttggaggacttacattatgctatggtcactgttttcttaaagctgtagctagtaaggatttcttgtggctcaatgacatgataaacatttgttttatttatatttttatttattatttttggtagtatcagtatacatttagttttcagagtcacttttaagctttttttttttttctttgagatacaggctatgtagctttggctgaccttgaactcactgtcttcctgcttctacctcagtggtctaaaagattcattttttttttattatttttaattatatgagtatatgtgtcggtgtgtgcacatgaaaggccagaggcattagatgtcccctggagctggagtcacaggtgattgtgagccatctgataggagttccttctggtaaagcagagtacactcttaaccactgagccacttctctagacctttaaagtctgtatatttgtatgtatagtattgtgaatgtatgtgtaatggctgtaggaaaactttctttctgttagtgtttccattagagaaaatggcaaattaatgtaacccagttgtataaaaacaggaagttttagagtttgggaaatctttaaggtaaacactattctttgttaatgtgtgaatagaccacagatatgcctggtgttaatgctaggatcatgggttgtgccttgtttacattgcctgaaatcattttggtagctcttaggaattgagctatgcctttgctttgctgtagacatagcaatgcagaagttctagctgagcataatgggcatgcctttaatctaaggtcttgggtggcataaacaggcaagtcaggactatacaagattggttgattgattatttaatatgtatttatattttttgagacaaggtttctctttgtagccctggttgcctggaacttactctgtaaacgaggctggccttgaacttaagagatctgcctgcctgtgcctccagagtgctaggattaaaggcgtgcaccaccattacctgcctcatagtaaaatcatgtttcaaaaatgttctgtctatgaaaaggtaaactattatgtgtttcaatatagtattgattttctaataaataaatctcaagtgtggggttgcttcccgcctcagtggtttatgttcctgagtgaaagacacccacacagcctctatattttaatacactttaaacagcacaatagctgagcgactgcctaatctctgtgatgttagattgtacctcccgccgataattccaagttactactcactaatttctgagttccatcttggccacattagttcagttagtcaaccctctgggccacattttcttggcccagagcctggggtgttctccttgcttctctattccatggtggcctctgtgtctctcctctctccatactctcctgaagcatggcggatgcctttcttcctcttccttgtggtcccaagtctgggaaacctaaaaccctatctttttcttctccctcactattgactgctcatatctttatttcccaatcagaattagctggggccaggttccctgatgctacatgtagaccctcttctgtagactgttttggaggacccaatgagtatttgaatacaggcagctatatttcaaagcttgacaactgctgatattttggggataagttacttggtagaaagtagtagttatttgaggactggagaggtagatggctcaacagttaggagtacttgttgctcttagagaagatctgagtttgattcccagctcccacaaggtggctcaggaaaatccttatatttagttctaggggaagatgatacccatataagcaaacaaaccgcacacatgcaaaaacaaatttaaagcttaaaaaactaactacttggattttttttttcaataagatgaaaatatgttgtagttgaagccatcccagttcctttctgactcttctacagagtacccttgaagatgttttgaatgaagttaaaacccagtttcctaagagttgttattatatatagcttgtgttggattggattttattgttttaactctttgaaagtttgtttgatttgttttgataactaagcaaactaagaccaaatgtggttacaggaattagaatgtcgcatggcccagcagagttaggtctgaagttgttttgacgcctgcctagtgtctgctcagctcctcagttgccctccttcactagcaggttagctgggtggatgatgacactttcactgcttcaacacagactcataagctcccagagcagcgccaggcaccgtgggcatgctggtatgctgtgtgccaggcaccgtgggcatgctggtatgctgtgtgcatttgtgagtgatttttgtggatgaatttatttgattgaactaaaaatttgtctatttgggttatttatctttcacaaaaccagtttaataaattttttccattaatatggccctttaaagaactgccttcataatgtttgtctggtaccatttctaggttttggtctaaagctgcttttgatcattggaactagctgctttcatatgatgattatacccatgtttttttctttctttttctttttcttttttggcactttagtagtaattttaactttttgaaatttttgtctgagagtaataatttatattttaaaactagaaatatgctttaattaaaatgtgaagttttaaattttggtcttagatgatatcttggcatagatgttgcttaccatgccgtaaagtcagccctaaagtttcaagttggcagatggttttggttcctaataaataacttaggaatttcttgtctgacatagctgactgtctttaatcagagcatatgtgtcagtttagatcctactaatttttgtagtacagaagataaattagtaaatgaagtctttttttttctacttaataaacagtttgttaagcagctgattgttcctgactttatataacccactaatggccattagattgaaagaggtaattggactttctcaagtttagatttcctactagtcaattatactatagagcaaaatttacatgttagtacctgacattaaaccaaaaattacttaaaaaacaattactgaatcagatgtattatgtattgctggttgtcctctgactgtgtacttcctgtgcagtgccatgtcactctccgtcacatcatagtgagtttgttcagtaaaaggcttcaccttgatttcctattagaccttgaaacatacacatgcatgcacatgcaagcacacacacatatctatagagcaaacattccacagaacttattaaatacatctgacaaacatttcctttagtgttggagagtttggatatttcatttcttaaatgcttaaaacttgagcactgtgtgtgttgggtgatatagatatagtcatcttcagttgttaaaagaaaatagcctgtctacagagacatttgctatggttgaataaaggcttcatagtctgccatccctgtatctttctatgtactcactgtaggcatccaggtcaaaagtagattgtgtgtgtgtgtgtgtgtgtgtctgtgtgtgtctgtgtgtgttagttaaaggaaatagactggagagggatagagcgacagtgaatcaagaatgcaattgttagatttttttttaaatcgactaacattcggaattatgttgatctatactatctctgtaattgaactacattttcaccagagttctgttttatgaatattcttaggcaaaaagacaaatgcatgcattctattaacttaaagaggaaatgccgtcaaaataaaagagcaagttcctaactaaagccatgactgcagagttgcctacagagactgtttcagcagctctaaagaacatacctttacttctatctgaaagtggatgtttattttcctttgtgtgatatcgaggattcacaatagtttttcatttctttgtgtgatatcgaggattcacaatagtttttcatttcttttagtccagccaagtgatgcatcttacagtgtatagtgtatttgtgtatgtgcatgtgatatatccagagatccatcccataattagcctccaaacgatgacaccattgcatacactagcaagattttgctgaaaggaccctgatatagctgtctcttgtgagactaggccggggcctagcaaacacataagtagatgctcacagtcagctattggatggagcacagggcccccaatggaggagctagagaaagtatccaaggagctaaagagatctgcaaccctgtaggtgcaacaacactatgaactaaccagtaccccagagctcttgtctctagctgcatatgcatcaaaagatggcctagtcggccatcactggaaagagaggcccattggacacgcaaactttatatgctccagtacagggggaatgccagggccaaaaaatgggaatgggtgggtagggaagtgggggggagggtatgggagacttttgggatagcattctaaatgtaactgaggaaaatacgtaataataataaatatttaaaaaaaaaagaacatacctttacttctatctgaaagtggatgtttattttcctttgtgtgatatcgaggattcacaatagtttttcatttcttttactccagccaagtgatgcatcttacagtgtatagtgtatttgtgtatgtgcatgtgatataagtatttgctaatttgaattctctagtatgtatattcatgtgtgatatagatacattatttttcctcttactattttcatatttgagaaccagtttttgaacccaagagtcaacttgatattatgcctctagtgttttagattattattattattattatatattactagattgttatataagaatgatataaatgctataaaacatttttaaaaaatgcaatattaaatgtatgcttgttagcttatgtttctaccagtatcatacatttggtggtatgaaatgttttttttcaaagcattttaaataatttcttttataaagtatagctattattctgaatctgatgtctgattgtttctaaggtgatgccatgtttttgatttgttattagagtctcacctttaaagaaaaggtaacaagccttaaatttaaagaaaagcctacagacctagagacaaggagctacaaatgtcttcttttgtccatggtgaaactgattcatgcagacccaaagcttttgctttgtgtaagtatttttaatgaaatgctttgaaattattccactaatctatttgaactgaaaggccaaaatacatttaaattatgagtaacctctaaaacattgctaagaaagccaattccaggaattctaatatacttagatcacattttctaaccgttccctccgcattgaactgtccatagtagcatcatttgcccttgttctgcattataatcagacctatttctggggtcaggtgggacaaatgactgtaaaatcggtgtgctcagcatctgaactgctcactctttttgctattgctaagcgagttaacttctatagctagctccctgtgtgttcctttgatcagccttctattatcattggctctgcctgtaaccatattagaagagaaagttaaaatgagagtggttagtatccagttattgccatagctctgctttttattcccgcaaatggtattatattcctgagagcttcactttggtgcacagagtaataaagaactgatgtaaatagtgtaaccaggtgagagtaaaggattaaaagcacaggctctggggaaggactgctttacttagtctcggcaccttaggcttctcatctgaaaaggtaggcagtaatatagttcctacctcagagagaccattaagagtgaaatagattgtgtaaggcttttaggaacaattcgtagtgtatagtaagcaataaaattagttactgctatttttagtaagatacagttagcgttagcattcttactgtccaagtaaaacagtttgaattgttcacaggatggtctgtttaacttttatcaagtctctatagtcctagactgttggggtcggcctgctgctctcatgtctgggttcgagcctgggaggcagcctggaactgaaaaagaagagggaaactaggtggacaagagagagatatggaaccaagacagtattctgatcaaggctcaaatttttaatggcagacacgctttataaaggaggggggaagcccattcctgccaaatcatccttggagccgagctgcaggtgaccacgtgtaggcggactcccagcaggtagcagcagaggcagtggctgaacagcagagtgatccagggaggcaggctccaccctaggtgatctccttagtggcatagcaaagtcaaggtctggctcagcttgcttcaggcttgggggaggctacactaggcctatcaagtctctagaccatcaggtaaagccttctgctttactcagtgtcaggctcatcctttggtgctttatggttttgcagctatgctcttcaaattactaaaatgaaggcattcatgactaagtggctgtggtttcaagaattctatgaaccccacgttttgagtgtgtgtgcacacacgtgtttttgtttgatttttgagacaaaatcttgctgtgtatactaggttggcattgaatttattatgtatgacatactgacctcagatttgttgggtatcccaggctggccttgaactagatgttgctgagtgctggaattacagaaatgtactgtcatgcctccactctagaattttaaaaaatatttacatatgaatagtttttctgataatgagagataatagagccagagtggatgaagttcctaaagtatgggttaccccaaaagaagacctattatctttttgtgttttttgaaaagtccacccaaatttgagagtttaatagaataaacagttaaatctttagtttggaaaagttttaaaaattttgttagtggactctgaaaattaactttgttcttttggtttctcgggtgtgtggcatgaactgtggtgacatctcactgtgcttgctacaggatgctagggttactctgtttacttggctgcagttttatgttcaccagtgaaccagggtcaccagtgattttcatgttaaataggttattgtttgaagaacaagggttgaattgtttgagggaaaatagtttttaagtaaaatttgctgtcttccaagagttatggaatcctttttacttcccttgatgaggatgattgaaccagaatcaggtagttttgtaaagcaggcaaaagctccacccccggcctactcctgcgttttgtgggctttgttttgtgtttgggggagttgagagggtgggtggggtttcctttgataggctaattgtcactacccaggacagctgcctagcttcatggacagtgctttctttgctgccatctagtggttaagtgactttcctcagtaacccaggaaagtaaaacaatattgtacacataaattctaaaccttagttactaggagaaatgtaaagatggtctccatcatgggatcttgttgaagtaatttgattgtgtcttgtgtttgtaccatctttgtcctggttcctgtcactctatgtgttcccagctactaccatttcttacattccccaatcatttctctgcactgtgttagaatggtctctttaaagacttttgtcatgcctggtccaacttaaatatcttttagctaacgttgctcttggataacaggtaagtggatctttgagttcatgaccagcctggtctagagtgagatctgggacagtgagggctatgtagagaaactctgtcttaaaaaacaaaaccacccccacccccccaacccagaatgtgaagattgacggggccggagagatggctcagtgcttaagtactttctgctttttccaaagtgcctgcctttggttcccagacacaggcaggcagatcactactgactgtagctccagctccaaggaagccaacactcttctgcctccatggccacctgcacccatgtcctgtctacacacatgcatataaataataaataatatataaataataaatacagttattaaaagcaaaactgaagtttgtttttctcctacagaatccaagaaaacagggccctgaaactcagagcagtacagcagaactaattacagggctcgtacaactggttcctcagtcacacatgccagaggtcgctcaggaggctatggaggtaaaggaagtgaattctgggcttttgaaagaaagactgtaactgtctctgatctttttctgagaacttaattttttaagcaattatttgactctttctatgtgctttctcttaaaaatatattttaaaaattttaaattgtttgtgtgtgcatatgaaaatcagaggaaactcaggtttctggtcttggatagcaaatacctaaccagctgtaggttattcatttgttttttgagacaagatttttacgctattgtcctgcctggtctctaaatcctaaaacaatcctcctccttcaactgtaatactagctagaattttagttgtatgtcacaagtcatgttgtatttgaattacattgtgtaaaaaatttttggaagtttgtagtttctttattccttactttctttttatgtctgcataatgggggtagggtgtgcctgcactcgcagtggcacgtctggagatgaggggagagcctgtggcgtttctcttctccgtccacctttatatgggttccgaggattgaactcaggtgctcaggcttctgtaactgttccttactgctgagccaggtagtggatggtagacgttcagtgtggtttctgtttgaggatttctacaaataatactattaaagttactgtatcatttaatatttccattagcagtgtattggtgttttggtatttctccattgttgatgacactcattattgtttgtttttaaattatagtaaacctactgtgttaacaaaggtgactttttaaaaaattatatttgtagctggatggttgtggtgcatgcctttaatcctagtactcaggatacagaggcaggtggatctcagaggcaggctaatctcaaccaagcctacatagaaagaccctatctcaaaacaacagaaaaattacattgacgtatttattgtatgggaggatgtgtgcatagcacagcatataggaagaggtcagagggtaacttgtaggagttggttctttcttcccaccactgggtcctagggattgacctcccgttgtcaggcttctactgacagcagtgcctttacttactgagccagctcatcagcttagagtttacttgtttttaaaattatctttaatctttttcttttttttagtccgttggttatccccctcctggtccgcccaccaacagttcctcctcccatacgcccctcccccagttttcaaaaggatgtctccacctccaacccaccccaagtctctagagggttagtgtgtcttctctcactgaggcaagaccaggcagtcctctgctgtatatgtgtccagggcctcatatcagctagtgtatgctgnnnnnnnnnnnnnnnnnnnnatggggtcaccctcctcctcagcttcttctagcttttccctaattcaaccccaggggtccccaacttcagtccactgattgggtataaatatctgtgtcttgctgctttttgggcctctcggaaggcagccatgctaggcttctgtctgtacatcatagcatcagtaatagtgtcaggcctttgagcctgcctttgagatggatcccgatttgggctggtcactggacctcctcagagtttactttgaagtgttatttttgtactgacaacctaaacatacacctttaatctaaatgaaatttatttttttataattaacatatacgactagtttaagacttaagaatatattcagcccagaaagtttcctttctgcagttaatactacccttattttgttacctcccttaagttaggaaaagaattttgacactcttgtattgtcacacatgttagttcccttttcctggttgttgatgaatattgcactggcttgttcactaatgggctcaattggtagacaacatgcacttctattgaatgtcagccttgtattcctttgccgtccccatcccttcttaccccgtgtctttcccttggctcctttgtaataattgatttgctttgttaatgtaattagtttgcattttaaataaatgaaataaaggtttttatttttagttcagcataattgctgtaattgtattgtgttagtggttggtttatctcaaggttcctcctgttttattctgtttagtgtcccattgtatgaatatagcacaacttgtttgctcatttatctgttgatgatcatttgtgttttgcttttggctatttagaagtacagcttttgctgggtatggtggtgtataccttcattcccagcattcaggaagcagaggcaattgtaaatttgaggctagcctggtctacatgtcgagttccaggccagcctgctacaaagtaaggctctgtcatcaaaaatgatgatgatgatgaagaaggaaaaaaattgatagcctgtaggtacacacacacacaatgtgaacagatttttttatttttcttgagtaaattctaactgaggcaaaaatcttactgtgtggtctcagaagagatatagcatagctataagaacactggaagaaagatagtacaagcatagaaaagtgtagtgtagtacatagaaagtaaaggtgtcttatttatgtgtaaggatgtgtatctgtgaatgtatgtgcacgtgtgtgtgggtacccagggaggccagaagaggatattggctccctgtagttgaggttacatgcaggtggttgttcacctactgagatggatgctaggaaccaaaggcaagttttctggaagagcagcagcaaatgctcttagctgttgagccatctctctagcctcagattcactggagagagagagagagagagagagagagagagagagagagagagagagagagagagagagagagagaaagggagagagagagagagagagagagagagggagggagggagagagagatgaagatctttttgcaaaggttcagtctaggaagtaaaagtgcatgaagtttctaaagcttcaggatatataaaacaaaatatgtaaagaaagaagctgtttacagtgcagatgcagtggtgttcctgagtactttcctaacatccggtgggtaaggatagggtggggttgttatcattcagtagaatacgacactgaattcagacagtactttttttttcccaagcatacctggaagatatttaacataggggtaggcttaaaactatcaaagtattgaaatattattttattgccatagtagaattaagatagaaatcagtaagaaaaaagtttataaattttaaaatgttgatactgtgttttcgtttacatactactgagtataatttagtacaactaccattaaatgccattttataatatcagagctaaacataaatgctgacagtttactccgggtcatagagccagcagaagtgcacatgtctacttacaaagcacacaaaatggtcagcagtgcagcttgtgttgtatcttcctccaaagtatgagccattcagatgtgtcagccgagtagacaattcctgttatattgatttaactgaattctatgcagtagtgaaaataaaatgaactggattggtggcacactcatttaatcccagctctcgggaggcaagagacaggatagttgtgagttcctggacagccttatctacatggagagttccaggtcacccggtgctgcagagtaagaccctgtcactaaaatgatgaagatgatgaagaagaagagaagaaaaattgatggcctctaggtcactaatacataaatctaagttgtgaacagagtgttcatttttcttgagtagattccaactaatgtaagacaacaacagtaacagcaacaacagcaataaccaaaaaccccaaaagaggctggtttacatagagagttccaagacagtcaaagccacatagacctgtctgaaagtaaacaaaaccagcatgagtactgatgagtgcagaagctgcatgagtctcactgacatgctgctcagtggaaataaccaaaggccaagtgcattctgacagctccgttacccgagcttcacaggcagagagagcagcttggtgagggcaggcagagagccgatgcctgggaagggggggctgaagggcctttctggtgtgggcggtgttgataggtggtggtgggacatgcagccagtgaaaaaatctctgagctttcctctccaaatgacctcctgctgtactctgtgtgtgtgtgtgtgtgtgtgtgtgtgtgtgtgtgtgtgtgtgtgtgtgtgtgagatcatcctagaaattgctacattgcttatattgtctttggaggatctattcaaatattttgattattttcacttcaataatcaattcttacatttcttgtcttgtgtataatatataattcaagattaaaaaaatacatgtatcttcctctaataatcaggaagaccttaattattcattagtaagcgaatgggtttatatttaagagagtggtatttcaacttggcatgctattaaacatccattcaaacctgtgtgagtcgttcagccgtgttggagaatgcttaggagataagtgtaatatgtttggagctagctgaagctgtcagtcccacactgtgtagaatttattcatcatcaacaaaccacaataataaggtgcttcccaacaaattgtatcatctaatgactccatagccatctttttaatgtcagtgtattctttgatattggcatgatgacatagtcacctttgaggtacttctcagtgtctatctgtcagataacatatagcagtatggaaaattaaagcaaaggagaacatgaaaaggtatataatttcattgaaatgcaaaaaactaatacatttttattcagattaaacaaaaaactttattaaacagggaatgtgtcacctaaaaaaccctaaaatatcccagtcttactaaatgccaaaccatttgtgagtgacagaaataaagctaggatttgggtctccgcttctgttctttgtactataccagaacactgccttctcttctttgtatgcataatatgaagtccttcaaaaacacagatgtgccttggcagttcaacaccctccaaaagagaacctcagtatgccttaggttcttttcttttcccatcaaacactttgcccaagtttctatgataggcctagagcccctgaagcagtggagctcataaagactgtgccccactgatgctagctctctcttgtcacaagagaaagcaactgctttaaattcccaaccaaattgatgccactgtatgaaaaacaatagaaaaccctaaagtaccaggaaattgtatcaagtatttgtacagtaatggtaaactgaattgcaatttgtactatctgttttttttttaagtgctaactataagttacttatttgtttcaggtagcagttcattgatgttttaataacaggggcttacagatcccatatgtatttttaccatggactgactgtactgagcacaatagaatttgctagggaatggggaagcattgtggaattgcagtctagcttgagcaggtttgatgaaagggtctttgctttaatagtctttgatagttttaatttataagttagcatatttatatggaagttacttatttaaaatgagttacttaattctggctagtcgtcattaaatactttaaaataaactgttattaaacataaagtttgctttgtttttgcctctctgtcaattttagaaaataacttttctgtctaaaatgtttatgtaacaagcaagttaatttctactatttcattgtgtgggttaatattgctgtgtgtgttaattttaggggagatactttgttctagagttattaattattgaaacctcattgtttatttcttgaagcagctttgtgtgtgtatattgttctgagttcattcacagctccctgtgtacgccatgtagagtaatgatggcaggggcagagggagttagttcggggttggtattctgactggctctcaaaaacatgtttttcactgttcttaagacagacccagctgagtttgttagcatttgtaaaacgagtgctccagtgttgttttcctaaagcactttcagtgccttctcctttgtacatttcaggctttgctggtccttcatcagttagatagcattgatctctggaatcctgacgctcctgtagagacattctgggaaatcaggtatatggattttcacattttaatttggctattgtctttaaatattagctgtataatatttagttcattgttatatttattgttataagtagatatttttcaattttgtttttaatttgaattgaaaatgttagaatatttaactgtcagagaactaacacatatatgcaaaaaagtttaaaaatggtgttaatttttatcagctggctacaagttcttctacttcatgtattatcctttgtggtgtacttctaagcagttacaattgtgtttgttgttttgagacagggtctaactatgtagccttggctagcctagaacttaactgtgtagatcagactggccttaaagtccaagaaatccacttccctctgcctctggagtgctgcgtctaaaggtgtgtcctatcatgcctggctataattgtgtgtgtgtgtttaagtttatttattattatatgtaagtacgctgtagctttcttcagacacaccagaagagggcgacaaatctcattacagatggttgtgagccaccatgtggttgctgggttttgaactcaggaccttcagaagaacaatcagtgttcttagccactgagccatctcaccagtcccataattgttgtttttaatagatttttttcagttataagactaaaagtattgacattttgtaacttagcttttcatttttaaactaagcacgtggctcagtagtacagtatatgatatgcattgaaggggggagctatgatctttgtcaatcttctgtatgcactagtggttttagtgagtcagttacagacaggcatatatgtataaataagaaaatatgtacaggatttcactatacctttctgaagctgagtagatggttttctttaataagcatgagggcactacattaggaagatgtaaatctataaacctaggcccctgctattgtctcatcatagacatggtgtgttaggtatgtggagaccgagttaaaatctaacctcttataatgacatagttattggagacatatgtaattaacttttaatttaacacatcataaatgcatttatttaactttatatatacatatataaatacgaaatagtgaagcatataatcaatttgaattgtcagtgagatattttatatttttcttttcataaagtcttcaaaatttgtagtgtgtcttactacagtacatatgaaaacacatttcattatggacaagcttcatttaaagtactcaagtggtcacacgtgggcggctcgtagctaaacagcacaattgtatagtatcatagagtatacagaacgaattagcaatcttgttctctaaagggtgggaaatggaccaggtgtcttggctcacccattctgttgtgagtctgtactttcacgtttggagcaagaaagcagttacagactgggaatgagggactgtggctgtgttccattgaaacctcctttatagatgttagaggaggcatggctttgtcctacaagcaacagtttttaggccctggctccagactactcttgctctgcagtctttgctgtgcatgtgaatttataatttttttttatccccaccgcaagaatagaattttttaaaatgtgttgttattaacatttggataaaacctgtaaacaagtaaaactaagcctctaaacgtacacctactatgaaatatgtcacgttatgtatgattacgtatatgtattaggttcgtgatgattttgtaacagtgaactttatgttactgcagctcacaaatgcttttttacatctgcaagaaattaactagccatcaaatgcttagtagcacagaaattctcaagtggttacgggaaattctgatctgcagaaataaatttcttcttaaaaataaggtaagcacagtgactttttcttttggttttcgagacagggtttctctgtgtagccctggctgtcctggaactcactctgtagaccaggctggcctcgaactcagaaatccgcctgcctctgcctcccaagtgctgggattaaacgcatgcaccacatctgcccggctgcacagtgacattcttaaattagaaatatctgaatagtaaggagatgtgttttcattttactgctatgataaacaccaggaccagcaacttgggttgggtgtatttgtcttacatgtcttgatggcaatccatcattgggggaagccaagacaaggaactaaagcagaggccatggaggaacactgcttactggtttgctctctggcttgctcattatacaacctaggaccactgggtgacaactgccgacagtggactgagctcgcccacatcgatcattaatggagaaaatgtcccacagacttgtcaacaggccagccttaaggaggcatccttttatctaaggttccctttctaagattactctagcttgtagcaggtgacaaaaagctaaccagcacagaacaagttaaaaagtttttattagctagattatatcctacttcaactcctcactcaatgacatacttaagagaaatgtaagtacagaaggtattatctggtagtccaacatttaaatattctaggttttaagttggtaaatggaaggttaatgaattctagttgacttaagtaggattctgggtcaggcctatgaagagtagaggctgctgcaatcaaagatgtctcaaatagtgttttctctttatttttaagtcctcatgacttggctctcggagctaatctagtccgggaaataatctttcaaaaagctaaagggcagaagttttaaatttaggttaaacttgtatgtctcccttaaagattttgtctgttagctgggtatggtggcacatgcctataattccagtactgttgaggccagcctgagcagagtggattccaggctagcctggagtacacattgagatgttgtttcaaacaaggcctgaggatgtagcttaatagtagagcactcaagttctgtagagttagggatgatttcatcttttaaaaaaagaccaggaatcttttttttttttaaattagaataaaattttttggtcctgaacagttgaaacattgaagttctggggaacaggaacgaacctaacgtttcttttaacatgtaatttttataatcaatttcaaggtttttctattatgacataattgacataatttaaagaatacttgatttaattaattttaatccaggcctagaattatagctataagaaaccttaccaagcatcttgatacaattttgtttagaggactgctgatggagaggtaaggttatttgtatctggcttatcttgtgtttatgtcacagaacaaagtttgtcctgaagattttagacttaagaattttgtgcctttggcatattgtctagcatggtcagtgttagtaatctagtagtgaatccgaggtgctttgtgagggctggagagagcactcagcagtgctgagtaccccgacaaggcaaaactgtaatctgtagattcgtaaagtcttacagttttcttgtgatagattttacatcatcatctatattgtacttggtttggaggttggacaactgagaggtgtttgaaagaaagatagtgcacaaaccttatttaccacaatggggtagtgagtgcttctaacgggaaagcttttggagagaaggttttccagggctgccttaaaatagaaagtcagttcccactaagcactctgtcagtgtcattgcttcaggaggatacgtcttctttccagcaggcagatagaagctcctgtcattctctctacctttatggagtaggatgtgaaatgtctgctactggaaataccactcagatgtcagttgatcatgatgagttcctgcgtgcctgtactcctggagcatctctgcggaaaggaagagggaattcctccatggtaggtaactccctctgtgactctcctgtatcatcatctctgctcttcctttctgagtggatgttggtaaatttcgattaaataatttagcacattagttacagactgctcagaatttagttgtagtgctgctcactgtggaaccctgagcaaattcttcataactctgtgccttagtttctcagattgcaggagatgatagcagggcatggtggaatacacctgtaatctcagtgttgcagaggctgaggcaagaggatcacaagttagaatttttgttttgtttttttaaagacaggatatcactgaatagctctggctatcctgtaacttactgtgtacaaaggttgacctcaaattgagatatctgcctgtaccaccatgcccagccttttaagttttccttttttttttttttttttaaatgtgtatgggtgttttgactacctgtatatctatgcactcatgtatacctgatgccccacagaggccagaagagggcttctggtcccatgaactggagtcccagatggttgtgagctgccttgtgagtgctgggaagcaaacccagttctctggacgggcaggccttgctcttagtgctcttaaccgttggtttatccctctgtcccagaggggacaagtttgaaggtaggtttacatagtaagactgtcttccacaaaatgaataatcagaaagcaattaataatagtagttaataacaaataataaaaccagtataagattgttgctccagagttttgaggattcgagtaggtagaatgtaaacagtacatgattatttgaccgtgtggctgaccactctaatcattctgatgtgaacaagccattcagatgtaggagttgaattaaaggaggctcaaattaattaaaaataaaacacagtagtttgcttaatttttggataagtgttgctaagatgttatttctttctctctctcggcttttatttttatttatttctgtatacatacatgtatatctgtattgacatagtcgtgctttgcagcacaggctaccttgaatttgctgtaatcctcctgcttcacccttgcaggtactgtaattaaggtcagtcgtgcttggcaagatttacatttttagactaggtcccaaatatgccaggctggctttgatcctcttgccaattccacacgagtgccaagattatagatctgtattgctatgtacagcaggacatttatttctgtatgtaaatgtccttaacataaatcaaaatatgagcagaattataaaatcatatggaaggttttgtctttcagacagagagccttgttatgcttaagtttcactgtatgtagcctgttgaggcagaaacctcaatgagccctgtaggagctgcaatgtgtgcttcgcctgtgtccttggcattggctttccaagtgtttctgcctcagtgttagtttgtgggtcattgtttcagtcagtgcttccgggtgtttgtttcttccctatagacctcttcctttgtcattatggttgacccacaagtggatcagttttactgcattggactctctgtgtctttttgtttgtttgtttgtttgtttgtttgagacagggtttctctgtgtagccctggctgtcctggaactcactctgtagaccaggctggccttgaactcagaaatccgcctgcctctgcctctgcctcctgagtgctgggattaaaagcgtgtgccaccacgtccagcttctctgtgtcttaattgtatatttgttacagactatctgcatttctggaatctaggataatatctattccaattgaaatgcagtaccattatatgaaccatatattggttcacatctgatttagagtaaggcacatcagaaaaagatcttattattagaaaggtaaattcttatttattttgtgtgctatggtaaatggtacattgttgagtttgtaaataaagtcacctaagttgcagatacatccctccttcctcccaggatagcacagcagggtgcagtggaaccccacctatatgccgacaagcccagaccaagctagaagtggccttatacatgtttctgtggaatcctgacactgaagctgttctggttgctatgtcctgtttccgccacctctgtgaagaagcagatattcgatgtggggtagatgaagtgtcagtacacaacttcttgcccaactataacacattcatggaatttgcctcagtcagcaatatgatgtcaacaggtaaatgtggctcttttttttttttttttctcttactctttttaaccatgttactttgactgacatctaattatttttacagtggagtctatttaaagaacagtttgaaagttttcaggacaaattcatacggtttacttgaaatccttttctgaacaaggtagatgtaattcagtgacatttgaaatttactgaatttttaatattcaaacttattggtaactggcactgtaagttgatgttagttatagattatagaaattactctgcttgaattataaatgggaagattttaaacacctaggcatatatttccataaacataggtgggaagatggctgttttatgttgtagaccttttggagttggggatcaatgaatactcttgcagaggttggtgagagcacgtgctcacctcgatcatcagaatcatttgtttcattccttcactctactctgtgtgtggggcaggctcccagatgtgaagatggctctaaacactaactgggtttgcttgctgtctttgcttaggaagagcagcgcttcagaaaagagtgatggccctgctaaggcgcattgagcaccctactgcaggaaacattgaggtatggcctcagcagctgcagcacctccccctccctatgttactgttagctatgtgatcagaacaacttgagaagcaaagctgagttatgtgcatattacaagtagggtattctcagaacctgcattacatgttgactttgaattcacccctaaagttgctccctagtgataattgacttcattttaggcctgggaagatacacatgcaaagtgggaacaggctacaaaactaatccttaactacccaaaagccaaaatggaagatggccaggtgagttgtttttttcagtgaatttttgtgtattaatagatctgttgcttcacttaagtaatccttgatgagctacgaagagtaggatattatatggagttgttttaagaatacctgtggtctgtctgtctgtttgcctactcttgtagatattagccacatgtatctgttagaatgtcacttttaactcatttaattaaacaagttagacttactttttcaattttatagtagccaaggttcagtatttatttactcagttggatagtagagatgtaaaaggttacatgactacaggaatattaaatatctctgctagaaaccacttagttgagagaccagttactcattgatgttctttgtcctttgttgaagtattcaaagaacgtttagaaaagatctaatagctgtagatagagaaagagaatatttctaagaattctcgtaacgtgtgtttgctttgagacaggatctggttatttacctttgctgcctagaacttaaagtatagaacaggctgtccttgcccttgcagtgatcctcctgccttaactttccaaagctggggttacagaggtgtgcctccctgtctggctcattatgctgtattcttagatactctaattaaaggggctgctgagcacataatcgagcgcactttaaggttgagtgcaattttaaactttggacattttatttaactattatcatcaagtgaatcattttattcagcaactaccaccaattctctattaccctagaaattaagaattaactggtttgtgtataactaatttgtattactatactgctttcattatcaggtctttgagacaaactgtttatcctccaattgctgtttttcttgttatggtcacttagagcaagtaaaagttgttttgaggaaataatacagccttagtcatgaaagtttttcttttgagggtgggagtgtgggtgttgactgtttaaatcagcatagaattcatatactgtagagttatctttcataaggtggtcaacctaatgattgtttttagtatagtcacagaattctataactgtcagtttatacacaatcaattttagtacattttcatgctctcacagaatgccccctcccaccaaacctgctccccattagctatttctagctctaacttgctgtatttcctacctctctgtctctaccgctccagccttgagtagctgctaatctatgttctatttctacaaaattaccttctctgagtattttgtccaatggaatcataggtgatatgggcctttgtgactagctttttttctccttaaattgtttaaggttcatcactacacatcagagatttttaaaaaggaatttgacacttcagggtgattttattctagctatgacaaaaatgtattaagtggctctctaatgtgtgtatggtagggattagagagatggctcagtgtttaagagcactggttgctcttcagaggatctgggtgtgagttctagcactcacatgatagcttagaatgggttgtaacactagttccaggaaatctaacatcctcctttatttagcttttaggcatgcacatggtacacatatatacatacaggcaaaacatttatacacataaaactaaaattaaaaaataataatgtatgtggtagtttcaagttttttttattattattataaaatgtacctttcctactggtagaaatggataagagtaatttgtaagatttttattcagtctatgttgaattcatgcttttcacaaaaatgttgtgtttaggctgcagaaagtcttcataagaccattgttaagagacggatgtcccatgtcagtggaggaggctccatagacttgtctgacacagactccctgcaggagtggatcaacatgactggcttcctttgtgcccttggtggggtgtgcctgcaacagagaagcagctctggcctagcgacatacagcccacctatgggcgctgtcagtgaacgcaaagggtctatgatttctgtaatgtcttctgaagggaatattgattcacctgtcagcagatttatggaccggcttctgtccttaatggtgtgtaaccacgagaaagtggggcttcagatacggaccaatgttaaggacctggtgggtctggagttgagtcctgctctgtatccaatgctgtttaacaaactgaagaataccatcagcaagttttttgactctcaaggacaggtgacgtcttctccactttgttttttacctttctttatgaatataataatagtttgaaataaatcaagactgtttctttcaaattatttaaattatagaccaacatgataattcacttacaactttaaaacctttcataattacagaaaaaaaatcatgtaacctagggatcaacttgcttctaaagaactcaggcctgtgggtatgcctggagttaggagtcttggctgtgtgcctcgtacctctgtgtatctgtgtgtttgtttacttgcctgtagtgtgcctgcgtgtgatggttacatcagtttcattgccctgataatggtttctgttcattgatgttagatcgctaatgggctgttttttggttttgtgtgtgtgtgtgtataggtattactaagtgacagcaatactcagtttgtagagcaaaccatagccataatgaaaaacctactggataatcatactgaaggcagctctgagcatctgggacaagcgagcattgagacaatgatgctaaatctggtcaggtaagcattctgtcctgaatcacagcagagtcttgttttaagaggtaagacctcgtatgccctgataatggggatgatgaagtagtttgccattgttttactacagacccagtgtgactatggcaataagataatcagaagttgtatatgttcctacctaagtaaaatttaaatattattcacgtctaaaattacatttacttaagtttacttaaagattaaatttagaataccttatcttttgtccatatctgatcattttttttaattccatgtttaattagatacgttcgtgttcttgggaatatggtccatgcaatacaaataaaaacaaaattgtgtcagttagttgaagtcatgatggcaagaagagatgacctctcgttttgtcaagagatgaaatttaggtgagttctcagaagagcaaagcagggtcttgtaagtattatgttaaacaaagtgtagaaaagtagcagagctttttgtgtggggaggggagggaggtacatatttgtgcatatttgttttttctgattattcttaaccaactttctcaaagctctgtgcccacaagcatttgtttttctgttttgttttcagtctttctttttttaaaaattctctcctttcctggaactaattaatttatggtcactaaaagtttctgtttccacattgcaaagggacagtgcaaagaaccagcatctgaattgtatctgtgtccttctgacttttattccatcacccctgatagcggtatctgttgtataaagtcaccctagcccctcagctgttttcactagtagagcgctgttttggttctcagcatatgcctacagttccttcagtcagaaagccaaggcaaaagttcagggccaatctgggatatacaactatatgataaaacttttgtctaaataatcagtaaactatgtgttaaaaacttacttgttcttttccttttttcattctgcaggaataagatggtagaatatctaacagactgggttatgggaacatcaaaccaagcagcagatgatgacataaaatgtcttacgaggtaaaataaaacagaacaaaatggacagagagagaggtggggaggggaaggaaaacggagaaggagagagggaaagaggcggtttttaaagttctatcatgttttactttactcatgaaaaccagtacagagatagctgctaggtgtgttaagttgttttgtaggtggtaagcttttgcatttgagatatttaaagttccttttattattttactggaaggacttttagttgaagcatgtgaggtagtcttaggaaagtggtattagcttaggaagtatggttaacagttattgagagaagatacataaagcattaggctgtattactttagataaaaacattgattgaggaacataattatgagtctttgtaaggcataattgcgtacatgctgtaatgacagatgcttgatatatatcagaaatggtaactgtgattggatgataatttcatccattttttgttcaggtatgacttggtaatatgtactatttactgattggttgattaattgagtttcttctatcatcatcatcatcatcaatttatccatttggccacttatttattcgtttatttattgatggtttttcaagacagtttctctgtgtagccctagctgtcttggaactcattctgtagtccaggctggcctagaactcaatgacctacctgcctctctacctctggggtgctgggattaaaggcgtgcaccaccattgctttttcatttttatattgtgatattggagcttgaacccaagacttgtagatgctaaactggattacattcttaaccccataattttgatttaatgaagatattatgcttaagattacttattcgtaagtttccccaccagttttaggtctttgtgtgtgtgttctgagcttagtatatttactgatgttatttaggttgtatttatagtttactaagtgaagtagagagcgccttagtttcctgtctaaaaggctcatagtttctaaatgacttttttttagagatctggaccaagcaagcatggaagcagtagtttctctcctcgctggtcttccactgcagcccgaagaaggagatggggtggagctgatggaggccaaatcacagttattccttaagtaaatgtcagccgccaaaaaacagcacaaaacacaaatacagctttctccctcccacagcagtgtaaccaaagtagctaaatattatatttaaaagtagacctaattgcttctaattttggccattgactgctctcatgaaaataacatgtctacttgtgaaaagacagaaccaagatagaaaaataatttgtgttgtgttttttaaagaaaacagtgggatagttgaaattttccttgtaatgaatctagattgcctgttaagtcatttaaaatgacaatgtctaactggtttggaccatgagttttgtagctaaatattaaaactgacttttgccagcagacaaggtgcattttctgtgcttatgtcaggaatgaacactgtactttgtcaggataaaataatgctaccagcaactcaataatgagccacgttgacttctgaccccagtattataaaagcagatgcttacagtggcccacataatcattcagaatggatggttagcttgctggttggtgtggccttcatggtgtaaggtcagtctctgtattttccaggtacttcacattatttatgaaccttttgaatgactgtagtgaagttgaagatgaaaatgcacaaacgggtggcaggaaacgtggcatgtctcggaggctggcatccctgaggcactgtacagtgcttgcaatgtcaaacttactcaatgctaatgtggacagtggactcatgcactccataggtgagatcaaatgaaagctacataaaaaactggcctagcatggtgcacaacttgaatcccattaaccaggaggaaggaacaagaagatctctatgagttcaaggtcagcctggtctacacagtgagttccaggacagccaaggctaccagtgaccctgtctgtaaacagacaaacaagcaagcaagcaaacagaaccaaagcagaaatataaaacctagagagctgggtgggaagggtggctcagtggtttacagcaccggctggtcttccatgggacctaggtttaatttccaggcctctgtggtaaccaggcatacatgtgattgatacccagacattaggcatgcaaaacactcatagacataaaacataaaaatctagagttgacataacatgcaaaatgaaaattgcttcagccaggctgtggtggtaaatttgcatctgtctatcctcatcaggcttaggttatcacaaggatcttcagacaagagctacgtttatggaagttctgacaaaaatccttcaacaaggaacagaattcgatacacttgcggaaacggtgttggcagatcgatttgagagacttgtggaactggtcacaatgatgggagaccagggagaactccctatagctatggctcttgccaatgtggtcccttgttctcagtgggtaagtttattgagaaagtagggtaatagaatgcttgacatacagctagtgcttcaaaataagtatcctcagaagtgtttattaagtgaattgacaaaatttaagaactggaaaaaattacataatggagagctgagactgtagctcattggtagaatgctttccctagcaccacagaaaatccatcatgattgtgcttgcctgtaatctcagcagcttggagggtgaaagcaggaggttcagaagttcaaggtcctctttgttaatagtgagtttcaagccagttagagcactgtaagactgtctaaaaaaataattaaccaacttgagtcattaaaccttttttcttaatgtgttttgcttctaactattgagaagtggttggtactcctacccctgactagttctttctttccaacccagtgacaaacgttcatggaatcaccaatgggaagaaatgtaaaacagcgttgtctcttatctttacgtatatataaagtaatagttaacctaactattagttgttaatagtactaaatctataatctgcgatttgtgctcaataactatctctgccttacacaccttaatttttacttgaagtattacattacatttgaaatttgcatttgaaggcatgctggatgtggtggacacactcataattctagcacgtagcaagtggaggcaagagatagaagactcataagtcatcgacggctacagagcaagttcaaggccagcttgggctgtataagtctgtgtctccaaacaaaatggactgataaaataccatagaaatacatgactatttgtccgtctacatttattttgtattctggggattgctgtcagggccttacttgttaggcaagtgctttatcactgagttgcaccctctgcccatcaaactacaacattcttggtaatacatttgaaaactttgaggaagcttttgttcattttcatttaaaaaagccatgttgatccctatatttttgctcatgcctttagtcccagcatggggaggcagaggcaggcaggtctacctgataagttctaggccagctatagcttacctagtgaatccctgtcttcccccccccccccacacacacacactttcttaaagtcgtatggtttattttatcaaaagaggaaggaaggaagaaagcaaggaaggaaaagaaaaaagactttagtaagagtaaacttctaattactaaaataattttttttttttgcctaaaaactgtaatgagagggtgaggaactggaaactggttcaggagtctttcagaagactggggttggattcccagctcacatggtcacttcacaaccacttgtaactcctgttttaggggactgggtgctctctctgcctccctaggcaaagcaaccatttacataaaattaacaacagaaatgaaggaacccacctgtagcagaggctggaagggcggtttggtgcttaagagtgtctgctgctctgtaaaagaagtggagccgaggtcccagcactcccaacagcaccaaaggagaggtgctactcatgtgcacgtgcgttgaaaatacacagttaaaaacagagagcctgtgagatcatggtttttgtatctaaaaataaagctcatattttttgccctataaccctgcactttacctgggccctgccttaactgtcttcagctgatgctgaggctcttctgtgtactcatctcaaatgtgataactgtttctgccctagagtacccttgctcctgctttctaaaatacttctgtggttgctttgatttgattcaattcggtattagtaaaattatttaacatgagctctatcgtcttagcaattttgttggtttgcttacttgctttatgacaagagatggtctcaccttgtgggctctggctgacctgaagctcactgtgtagacaggatggcttccgactagagatccttctgcctctgttttccaaatgctgggggcacaggcagcatctccacagctgactcacttacaattgtacttttatgcccatttattagagtactcctaaattattttcttcaaacctaaaatttttcacacatcttcaaatgtattatcagtaaatattatgaactttttagcatttaactgtaattaaaagtcatttagtagttttcttaatgaagagtgaaggtctgatgatgcaacctagtggtagagttctggtctagcacgcatgagaccctattcttgatccctcctaacacaagaaaacaactgttgatgtaagtctgtgaagctctgactaatatttctaagctttatagcacatgacttaaaatacctctttttcttcttcttctttttctttttctttttcttcttctttttttttcttttttcttttctttttttttttttttgagacagggtttctttgtgtaatagtgctggctgtcttggacttgatgtgtagaccaggctggccttgaactcaaagagatctctgcctgcctctgactcctgagtactagggttaaaagcatgcgctaccattcctggcttgacttaaaaatacctcttacgtatttacttttttggagataggatctctggtgtagcctagctggcctggaattcattgtgcagaactaggatatagcctcaaatgcacaaagtttctctgcctcctgttacaggggttaaaggcatccaacatcatacctcgcctcaattacttaaaattttttttgagattttatttcatataaataggtattttgcctacatgtatgtttgtgcaccatgtgtataaaatgcccaaaggggccagaagtggctgttagatgccctgaaactggaattaaaacagttctaactgcatgtgggtactgggaattgaacttgggtcctctcaaagagcagccaatgctgctagtcccccaaattatgttttttctttggcaattttgaacatataaacaatctctcttgatcacatgcaccagtgtttctcaaccttcttaatgctgtgactctataatatagttccctcgtgttgtggtgaccaccaaccataaaatcactttcattgctactccataactgtaattttgctattgttatgagtagtaatgtaaatatctaatatgcatgatatctgatatgtaacccctatgaaagggtcatccaattctcaaaggggtctcaacccatgnnnnnnnnnnnnnnnnnnnnnnnnnnnnnnnnnnnnnnnnnnnnnnnnnnnnnnnnnnnnnnnnnnnnnnnccccctccctctctctttctttctttcttttttctttaaaaaaagacaagatctcattatggcctgtaactttttttttttttaactttatctgcatttatttgatgctgaatttattcccgggccttgagttttgtttcttcagtttcttccaggatttctttttcttctgtgctgcctcttctttgggctttggaacaatctgttgcttctcagtgaggatcatctcagtgtggcagggggagctcatgtatgggtgaattcggccaagagctctgtaggttttttcggcaccccttaggttccttgttcacctggctgtgttcaatgactagagcatccacgtctaaacccagcattcttttttggccaccatccagcctgtttggcccactgtttggcctgggctgcacctaccaacaccaccattattccgccagaatggcacacattgcttctttaaagtggcatccttcagatacttggtggctttgtggatatgcatacccttgatggcctgggcagtttcccgagtgttcttaaagtgaacatgaaggtttggacctcttgatttgcgtgattttgtggggtttttttgggtcaagagagtagcaaaccatcttcacaggtctcttctggccgcttacaggaagagtagcttggaactttttaaaagaaaaacaaaacaaaacaaacaaaaaactcaagaccaaccttattagcagagctgttgaggaatcacggatatctactaacaatgtggtgggtttttctccttgtaactcttacgtaactcaacctggcctcaaatttccactcttctgcctttacttcctcagttctgtgattacaagtgtgtactatcactttctctaatgaaattagttaaaaatttaatttgattatgtaaatacatgttttaaaagccagctgtttagaattttgggggtttaggagaaaggatgagagtagaaaggcatttactatggggcctaaaagcaacagctactgctgtctctctttactattgtgctggaattgaaacagctgactttctgtgctagaaaagctcccccccaccccctcccacccccgctcctgagctggagcccaagcccggcaacttcagtttgtccctaaattcttatccttttttcttaactcataatggaggggagatgtcaaagatgtattgtgtaactacagggggcttctggggtatttatagtttggattattcaattttttcccttactccagtgtcttgttcttagaatcttgggaccaggccaggctgagggcagggctctggaccatgatggactttagtactgtttgaaggttgagggctctttttttatagctactggtattttctttgtcttctctcaatgttgggtttaacagtgaattacagttttaataattgtaaaacaaaacaaaaaaccacaaaaactttaaggaatttggaaaggatgttgtacaaataatagaactgttagcctcaatcctaactctagttgtatgtaaatctgactggattttgggttttaactatctagccgaccccctccattctgatttttaaataatcccttagtatttgcatttttgttgtttattttggccttggtcatattgtatttaatcatttctaagaatacagtttgttcaaaacgaacacttattttatgatgtaatttagccagatcctgatgtctttctgccttgccttctggtaaagccttaaatctctcatctttcactagttaatttttagcattagcagctattagaaacaggtattaaaagtcatctttaatagacaaaggtaaatgttaggaataataagttattgtttaccttgattattatgagttttagatctgccttttttctatccttttacaaaattttaaatctacctaagagaagtaaaattgttcacagaaacacaattgtgctttgttaccaggatgagctggctcgggttctggtcactctgtttgattcccggcatttactctaccagctgctctggaacatgttttctaaggaggtagaattggcagactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgaggtcacctttatctcatgttcctgtccttggttttctggtggttttcatgaagacgatatgtcactgtgtagcccagcctgtccttaaacctgtgctcttcctgacgtggctcactctcctggggctatagcccttctcttcacttttaaaaggtttgcagtttttacactaaaggttatatgcaaacatcttccttaaagaataaaaacattaatagatatcattaaaggcatcattgattaccacctatggataccgttgtggtttactccggtctgtccttttcccattcttttgtataaacatatatgtaattttagaagatgtatactttattgtaattgcttaattttaaaaggtaataaaaataaatctgtggtttacaacccaattcttttggtttggtcataggccttagatctttctgtggaagtggatgaagattgctgttactcttttatactgctgcacagtattaagtagtttagcgctgttactgtttgtgcagtgcagtagcatagcctttgactttgccataacttccttattattggggttttgaaacaggatctcacagcataattgtggctgtcctggagcacgctatgtagacgaggctggcctggaactcgcagagatccacctgcctcttccccttaagtgctacagtcatatgctaccacacccagaccaacgtccttattagtattctaacattgtcttttccacactcaagctgtttgcagtggaaatgatttttctaaatgtaaatggggctttttgtttctttgttttgttttggtgatgttgataattgtatttgagcccttctacatgctaggaagtgcctagccactaagcctattcccaaccttagcagaaatctttctgatgcttattttgtgagacatcagcagcagtctgctcttgtcagcaaaatgcagcacagattgttgcttcatctgaaccacctttacctcactcaccgtgttcatttcatagtcactctaagctccaaggaaaagtacatagttttaaatgttcttgcacaaggtcctatgggattagagatacctaattaattatgtttcttatgtctgtttttaagaaatattattttgtgtatgtgcttgatatatgtttgcggtatacatgtaaaggtcagagtatacttccaagaatcaaactcagatcaacaggttttcttggcaagtctctttatacattgagccatcttgcctactcagtccttcatttctgaccatgataaaaaatcaagaaggcagactaagcatatggctaatggctgagtggtagataacttgcctagtagaatgagcccttggttccttccatcctcagcaaaacacacacacacatacacacacacacacacacacacacacacacacacacacacacacacagttccttccatcctcagcaaaacacacacacacacacacacacacacacacacacacacacacacagagttccttccatccttagcaacacacacacacacacacacacacacacacacgcacgcacgcacgcacgcacgcacgcacgcacgcacacacaatctaagaagatataaggaagggagacatccataaatcagctgtaactttcattttagataaaaaatgactttcgaggggttggagaaatgactcactgattaacagcacttgatgttcttctaggggacttctctctcttcggttcccaacatccatatcaggtggctcatagctacctatcagtgcagttccaaggtatctcctggccttagagggcacctgaatgtgtggcatgcattcacacagcattcacacatataaatgaaaccctttagcttggagaaagagaccttagatccccaggtacataggattgtttacacttgagcctgtgacccactctgacaagtcaagattttgaaagtctactctctatgttcacaggaagaaaaagtggctaagaattctgaggggctgaggacatagttcagtgatggatgcttgacacaaatgcagaaggctttgggttagctccctagggaaagctggaaatagaaaagaaaaggaaaggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgttttgaaataaaatagcaataccagggaaaaaaaaaatctgggtctccccccctcagtacctatcggttgcctgtagttcttctagaagtggaaccttgttaaaatctcctcccattcacagaggcgtgggcacggtattgtctttgcaggtctcaagcaggcagcctgagagttcatgagagcattcctggtttgttgaaaagacactgttaagcagtagttgaccaggtcctcatgttttttacagtcagtcccccttttccttgatgtttcctgagccttaggcataacgttgtgttatacctaaggcataaccagacagcccatgctcactgacttagtctctgcgttttgaccacttgtagttctctctaataacctcaaaaactgtggactgatccctacctactagattagctaaggttgagcatccagaagtcaaaaagattctaagagctaaagctttttgaacatggtgctggcactcactaatgttgacattaccggcatgagctcagtctgaaggccacactgtggtggagagaggcctgacgcctacaagttgtccttgagcctgcctctgcctgcctgcctgcctgcctgcctttctgtctgtctgtctgtctgtctttctgtctctctttgtctctctctccatacaaatgagtaatctaaaaaaatccacaaaaaattctcaaatatgtaagtaatatctatggctgtttttatgttaaattctggtttcctccagattgtttttgtcatggttgctgttgtatttttgtagttttgaatgggtcctgtactccatgctggcctcaaacttgctaccaaactaagaatgacctcaaggtcattcttttagtcctcctgtgggcaccttctgagtt

SEQ ID NO: 542 - DNA, 3216 bp, Mus musculus
cttccaataaagacaggacagcagaacacacataccaaagtcagcaccgagcacaacaaggagtgtctgatcaacatttccaaatacaagttttctctggtcatcagtgggctcaccaccatcctaaagaatgttaacaatatgaggatatttggagaagctgctgaaaaaaatttgtatctctctcagttgatcatattggatacactggaaaaatgtcttgctgggcaaccaaaggacacaatgagattagatgagacaatgctggtcaaacaattactaccagaaatctgccattttcttcacacctgccgtgaaggaaaccaacatgcagccgaacttcggaattctgcctctggggttttattttctctcagctgcaacaacttcaatgcagtctttagtcgcatttctacaaggttacaggagttgactgtctgttcagaagataatgttgatgttcacgatatagaattgttacagtatatcaatgtggattgtgcaaaattaaaacgacttctgaaggaaacagcatttaaatttaaagccctgaagaaggttgcacagttggcagttataaatagcctagaaaaggctttttggaactgggtagaaaattatccggatgaatttacaaagctataccaaattccacagacagatatggctgaatgtgcagagaagctgtttgacttggtggatggttttgcagaaagcaccaaacgtaaagcagcagtgtggcccctacaaatcattctccttatcttgtgtccagaaataatccaggacatctccaaggatgtggtggacgagagcaacataaacaagaagctgtttctggacagtttacggaaagcactcgctggccatggaggaagcaggcagctgactgagagtgctgccattgcttgtgtcaagttgtgtaaagcaagtacttacatcaactgggaagataattctgtcattttcctactggttcagtccatggtagttgatcttaagtctgcgttggattggtggcctaagattgatgctgtatattgtcactcagttgaacttcgcaatatgtttggtgaaacacttcataaagcagtgcaaggctgtggagcgcacccagcaatacgaatggcaccaagtctcacctttaaagaaaaggtaacaagccttaaatttaaagaaaagcctacagacctagagacaaggagctacaaatgtcttcttttgtccatggtgaaactgattcatgcagacccaaagcttttgctttgtaatccaagaaaacagggccctgaaactcagagcagtacagcagaactaattacagggctcgtacaactggttcctcagtcacacatgccagaggtcgctcaggaggctatggaggctttgctggtccttcatcagttagatagcattgatctctggaatcctgacgctcctgtagagacattctgggaaatcagctcacaaatgcttttttacatctgcaagaaattaactagccatcaaatgcttagtagcacagaaattctcaagtggttacgggaaattctgatctgcagaaataaatttcttcttaaaaataagcaggcagatagaagctcctgtcattctctctacctttatggagtaggatgtgaaatgtctgctactggaaataccactcagatgtcagttgatcatgatgagttcctgcgtgcctgtactcctggagcatctctgcggaaaggaagagggaattcctccatggatagcacagcagggtgcagtggaaccccacctatatgccgacaagcccagaccaagctagaagtggccttatacatgtttctgtggaatcctgacactgaagctgttctggttgctatgtcctgtttccgccacctctgtgaagaagcagatattcgatgtggggtagatgaagtgtcagtacacaacttcttgcccaactataacacattcatggaatttgcctcagtcagcaatatgatgtcaacaggaagagcagcgcttcagaaaagagtgatggccctgctaaggcgcattgagcaccctactgcaggaaacattgaggcctgggaagatacacatgcaaagtgggaacaggctacaaaactaatccttaactacccaaaagccaaaatggaagatggccaggctgcagaaagtcttcataagaccattgttaagagacggatgtcccatgtcagtggaggaggctccatagacttgtctgacacagactccctgcaggagtggatcaacatgactggcttcctttgtgcccttggtggggtgtgcctgcaacagagaagcagctctggcctagcgacatacagcccacctatgggcgctgtcagtgaacgcaaagggtctatgatttctgtaatgtcttctgaagggaatattgattcacctgtcagcagatttatggaccggcttctgtccttaatggtgtgtaaccacgagaaagtggggcttcagatacggaccaatgttaaggacctggtgggtctggagttgagtcctgctctgtatccaatgctgtttaacaaactgaagaataccatcagcaagttttttgactctcaaggacaggtattactaagtgacagcaatactcagtttgtagagcaaaccatagccataatgaaaaacctactggataatcatactgaaggcagctctgagcatctgggacaagcgagcattgagacaatgatgctaaatctggtcaggaataagatggtagaatatctaacagactgggttatgggaacatcaaaccaagcagcagatgatgacataaaatgtcttacgaggtacttcacattatttatgaaccttttgaatgactgtagtgaagttgaagatgaaaatgcacaaacgggtggcaggaaacgtggcatgtctcggaggctggcatccctgaggcactgtacagtgcttgcaatgtcaaacttactcaatgctaatgtggacagtggactcatgcactccataggcttaggttatcacaaggatcttcagacaagagctacgtttatggaagttctgacaaaaatccttcaacaaggaacagaattcgatacacttgcggaaacggtgttggcagatcgatttgagagacttgtggaactggtcacaatgatgggagaccagggagaactccctatagctatggctcttgccaatgtggtcccttgttctcagtgg

SEQ ID NO: 543 - protein, 1072 aa, Mus musculus
LPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDESNINKKLFLDSLRKALAGHGGSRQLTESAAIACVKLCKASTYINWEDNSVIFLLVQSMVVDLKSALDWWPKIDAVYCHSVELRNMFGETLHKAVQGCGAHPAIRMAPSLTFKEKVTSLKFKEKPTDLETRSYKCLLLSMVKLIHADPKLLLCNPRKQGPETQSSTAELITGLVQLVPQSHMPEVAQEAMEALLVLHQLDSIDLWNPDAPVETFWEISSQMLFYICKKLTSHQMLSSTEILKWLREILICRNKFLLKNKQADRSSCHSLYLYGVGCEMSATGNTTQMSVDHDEFLRACTPGASLRKGRGNSSMDSTAGCSGTPPICRQAQTKLEVALYMFLWNPDTEAVLVAMSCFRHLCEEADIRCGVDEVSVHNFLPNYNTFMEFASVSNMMSTGRAALQKRVMALLRRIEHPTAGNIEAWEDTHAKWEQATKLILNYPKAKMEDGQAAESLHKTIVKRRMSHVSGGGSIDLSDTDSLQEWINMTGFLCALGGVCLQQRSSSGLATYSPPMGAVSERKGSMISVMSSEGNIDSPVSRFMDRLLSLMVCNHEKVGLQIRTNVKDLVGLELSPALYPMLFNKLKNTISKFFDSQGQVLLSDSNTQFVEQTIAIMKNLLDNHTEGSSEHLGQASIETMMLNLVRNKMVEYLTDWVMGTSNQAADDDIKCLTRYFTLFMNLLNDCSEVEDENAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQW

SEQ ID NO: 544 - DNA, 238484 bp, Homo sapiens
agaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacataggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggatgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagacctgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtctttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtgtattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacatacacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaaaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttggggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtttataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgatttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttatctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattttattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaaatataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattttattttgtcaaatttttaatcagctgggttttagattcagtgagcacaagtaactgtaactttcattttaatttattatttcccttagaaacatctcctatcttttgtgaccatgtctccttttccagtatgtttcttgaattaggatttcatagagcttttgtggcctacacgaattgaccacagtaatccattacacatatttttctttagcatcttgtttgaatttacttacggttgtcccagccctaagtagatgataaaatatgatctcatagtcctaaaatgtggattgatttttttatgaagatatgtgttttttcttccttctgtaacctgtgacagattctgtagtagttaccctgttgttgaaacagtttttctcaaataccagtttcatcaaataattccactgttaaaagctcataatttctttcttcttcccattttctaaaatcgattgacgtttcctagacttcagagtactccagctgtcctccctctgtacctttgaacatataacatcttttgtctttctcaagtgatcccttcctctctctaaattcctatttaacatctccattctaagctgtttcaaactaacatactcagttcatggcaactgatctggatttttcttgattaactctgaactctctgctggtgtttagcatttatttatttatttatgaatgaataaatgaatgaatgaatgaatgacagggtctcattctgtcacccaggctggagtgcagtggcgcaatctcggcttactgtaacctcccccttcccagttcaagtgattttgctgcctcaggctccccagtagctggaattacaggcatgtgccaccatgctcggctaatttttttgtatttttagtagagacgaggtttcactattttggccaggctggtctcaaactcctgacattaggtgatccgcctgcctcggcctcccaaagtgctgagattacaggtgtgagccaccgcgcccagcctgcatttataatcccagtttgtatttgtttgtattgagttgtgaaacaacttctggttatagattgtgaagattgttcccccttccttttttttgagatggtccttaggtttattagataatattctagtatgacattgaaaagacatgaagttacctttttgccttattcccatattttagataatttttctcttgttctattttatttttaactggcatacaataattgtacatgtttatgggtacatattgatgtttcaatacatataatacatagtgatcccactagggtaattagcatatccatcatctcaatatttatcatttctttgtgttgggaatattgaatattctcttgttatttgaaactatataatgttaactgtaggccaggcatggtggctcacgcctgtaatcccagcactttgggaggccaagacgggcggatcacgaggtcaggagatcaagaccatcctgtctaacatggtgaaaccccgtctctactaaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagcatcttttactgttacaaggttaatggcagactctaataaatgccatttctgtttgccttagactttagtttttatgaggattaggataaaatcagaaataatatatttaagtatagtataatctgggaggtaaaatggaagactattgttgatcttttagtctttcacttttcagatgtgtgttgattggtagcagaaagtgaaactaacttttatgttctgaatatcttttctgttagagaatatttggagaagctgctgaaaaaaatttatatctctctcagttgattatattggatacactggaaaaatgtcttgctggggtaagtaaattgatcttaagtaggcaggctttgtgaatttaatcttgagaatgatcttatgtcccaaagtacagatgtggaccaagaggacagtcctatggacttttgtctgagacatataaatatgagttttgttaatatagctgacctggtgacagacaatttttcatgagaaaattttctcatcttttgtaaattaaacagatattaagtttacttataaaatgttatgtttcagccacgtatctgtctctcaggtttttaggaaaatattttatgaagagatcactatttgatttaacggatctctcagagagttgtgggagagtgcgattcagaagtccaagagtaatcttgtatttcctcctatatgaatatgattttaatattctacttttgaaatttatgtaaatgagaacttaaaaattaaacctattaaggatagatgttaccttgagaacacttgttttatgtagacacacaaatatgcgataggtatgtggaggaggagagtaccaaacaattatttctctggtttcctgtaagttgttaccacagtgtatttcaaccatgacttaatttgaactttttcaagagtatttctattgtgtaaagaaagtatttctatacatcattatccttaattcttcctggaacatggtaagagtttatataaatatataaattaaatacctctgttttaatgatctgcctaatccatgtgtattgaaattaactcatttcttatgttctctcttcctttggctcagaattcagaattttgttttgattcagaattgcttccctcttcacatatgttgcagttctctatagtgaaactagttgaaagagaccttaatatatgaggactgatagtgtggttgagaagtgttggtggaagcattggggtagggcattgaaaaaaaaattatattgacacaactgtgtatccctagggaaggctgtaagcgaaaaaatgtaagcataatatgtatatatatttttcttttgagacagagtctcactctgcggcacaggctgaagtgcagtggcaccctctcggctcattgcaacctccacttcccgggttcaagctattctcatgcctcagcctcccaagtagctgggattacaggcatgtaccaccatgctcagctattttttttgtattttcataagccatgggggttcactatgttggtcaggctagttttgaactcctatcctcaagtgatccgcccattttagcctcccaaactcctgggattacagatgtgaaccactgtgcctgccctaagcataatattttaaattttcttattgaccgttgaccatattccaaaattgtggagacagtgtttataagttttctacttaaaatcgaaggtgagctagttgttttagcatggtattttccgttaacttgtgatatgctattgttcatgtgtaaaatggagtgaaagagcaaaagagctgttacataggatgatggaactgggaagatgggcaaattttaaacttttcttgaatcagttttttccagtggtcttattactttgactgcaaattaccagtatatcagccacacccatgactgaatggtggggcgtggggtcatatattgccttgttcagtttcacagcttttctccattaacatttgtaattgagaggtaataatgaatgtattttggagaatgattaccgatattattggcctctgtttgatttaatactctttgaagatagcctaattgaaatgctaataagtgggcctagtataacttatgtaatgcataaaatgtatattatcttgccgtgctctactgttgaaaaatgtgtatgctttttcattaaatttactatttaaaaagtaatgctatttatattattgaacaattgttttatttccttcagtgattttacagatgtttcttgattcttacttttaaatcaaagtaaattgaggcagtttaagaagaacggagctcacaagtatacgtttgttatacatagttggaatatttaagtgaaagaaaaatacttaccaatatgttatgagtgcaattttgtagaatttgaggaatcttaagtatttttgttcctgtgaatatgactattatttaaaagatttaatacttcttagatttttatttgttagagttaacatctgtattgtttggttagcctataaacaagaaataggcattgtaatgtgaattcacaggtttttgtgaagtctgtttatgtactgtccctatgtttcagtgtatttgcatctgagagtgcttggattgcagttacagaattgagcgtagcatacaattgtacacatttttgttctttgccatcttgctcagtgttattaaaattcttatccgcatgtagttatcaagactgttaggtgaaatagtaatgtggaacagcatacctacaggatagcttatccattgattgtgtgttaattgtaaagtatatatttacaaagtagagatttcactgttaacaccgaagttatcaaacttggtgtcaataacaggaccacctggccttatgttctcatggtgtgatgtaatataacctatagtgaatcccctaaactgtttaacctcaatctaatcagaccattaggtttaaattttagcttacagaaaatatacaggccgggcaccatggctcacgcctggaatcccagcactttgggagatcgagacaggcggagagcttgaggtcaggaatccaagaccagcctggccaacatggcaaaaccccatatctgctaaaaatacaaaaattagccagatgtggtggcacatgtctgtagtcccagctacttgggaggctgaggcaggagaaccacttgaaaccaggaggcagaggttggagtgagccaagattgtgccactgcactccagcctgggccacagagcgagactccatctcaaaaaaaaaaaaaaaaaaaaaaagaacgaaaatatacaatacagtaactagaagagcaaatcaacctatgtcactggaaaataattaaatcaaggatatggaacattctgtaaggcagctggcccacttaaagtcatgggaaataagagtggtgaatatgggccaggcgtagtggctcacgcctgtaatcccagcactttgggaggccgaggagggcggatcacttgaggtcaggagttcgagaccagcctagccaacatggcaaaaccccgtctctactaaaaatacaaaaattagctgggcatggtggcgggcgcctgtaatcccagctattagggaggctgaggcaggagaattgctttaaccctggaggtggaagttgcagtgagctgagattgcgcccttgcatagaatagtgaaactaaggaaacatcatgttgtaatcggtgaacttttttggatccttattgaataaaaatgcctatgaaagacattttgggggcagtggtgaaatttgaattcagacttggtattagatgatacaagggaattgtttatttttccttggtgtgttaattgtattgaagttacattagagaaaattcttttaagagatgccaaggcacatggggtgaagtattctatttataatttactttgaaaagatttcaaccaaaataaaattactttgagtaggtagtgtctgttttggtcagtctgcacaaaagcaagtgtgatggctcacccaggaatttacttaaatgtcaagacagatgacacaatgcactcatcaatcaatatgaattaagtcgattctgtaattgtagaactcacagcaaactggggattcccagggaagggctcgtttggtgaacaagagagcaagcaggaatgggaggactggtaaggatggcagggggattgaactttaattgtgattatggggtcagagatggaaccatcctctttattaaactatctatagacagatgtagcaaatatgatgaaacgttaacagttgttaaatctaggtggtgtgtatgtaaggtgttcattatttttgttctgtgtgtgtgtttgaaaattttcataatagaaaatgtttacaggtaaaattaaagtttagaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttagtgtgtaaatccacatgggactactgaagtaatatgaatattagaagttttgttttttgtctacataaaaataaaaagttaatggaaatgaggtttttttgtttttgagacaagttcttttgcccctcacagcagctttgacctcccaggcttaggtgatcctcctacctcagcctccagagaaatgagtttgtctgggcttgcgtagaaattttatgcattaatatctttgacattttaattgcgtaatattgtgatattgatatgtgcaattaaataagagcactgttatgaatgtgaaagtctaaatttcagataaaaatatctgccgtgagcaggctttaaaaaacaatactaggtatgaacttttggtttggctttttaaacatattatccctttaaatgaaactacccaattagatggaataattaatgagagtagtcagaattcaaatactttcacaactctaccctttatcacaagattttaggttaccaaaaaacaaaacaaaaacaaaaacaaaaaaacctaagtgatgtgaaaacacaaggaggtgaataattgcaaagtagaattctccagaaagtggactgcattttaaatgtatgtaaaatactgccatttattgagtatttatagcatttcctttgctgtctcatcctcacagtaaccttgatgatacttccctcattttacaggtgagcaaactaatactcaaaaaagttcaggtgatgtgccaaataatggaggacccaaaatttctaagtcaggctggcttcagaatttatattagtttcactataccagattgcttccctatctattttagccacattttgatgaaatctgttttataaaatatacttctgtttttaaagatgtatcaaaaatataatttaagcttttattgatgactcaaaatcatcctgagcattagttgtgatatgctacctacaggtggagaaattagtataggtagtgctctatgggatagaattataagtgacagtagcaagtagctgcaaattgttgttatgcacatgatttgcctttctaaggcaagtaaagtcagatgggttattaacttaattagaaactatagcacaaattatttagtgattcgtgaatcgaagactaataccgaatagagaaaaacaatcctctttgttggtgcctgcatctttggctcgtcagtgttgtacgaacagtggactttgattattcagatttactgattcctttgttgttttccagcaggtgtgaaagacaacatacatcaccatttgagaatttgtgttacggttttttgggggaattgattaacttcagagtcctgcaatctttttaatcaacaatgacatttctataattaagatcctaggcagcaatatttttcaacctcaatgcaattcttgatccaaagaaaattaaagttttatttaatggtatattattgataatcttgggtaatatttacatgatagaaaaatgttttcatgaaatcttttgagcagtaacgttttatattatgaataataatacagtggttgagtcagcaaggtaacaaacacctagagagtaggagggtggaaaattgtatttaataaaaaacgcaaacccttttcatttaggtgactgctaggccggccttactatttgaaacacctgttaaattaaaggtagaaagtggtacaaaaaaacccaaatgtcttgtagtctatcaatgcatgaactgccttatagaacacaacaaatgtgccaccttggaaaattctagaaaatttctagtcaccaaaggttttactttatgggattttgcagcattagcacatgtaaaaataagcaacttttgtttatttcctgaatctagttcactgttgccagaatagaaaccaagtgtctaaaattttattagctttcagaggacagaccactcagaaatggcatctgtgaaataacattgtttcagacaactgcattttcagttccatttagcttgtgtcagaaataggagctgatcttattgaaggatcactcacctaaaagaccattatgatggtttagtttaggttggaacatcttatgctgtcatcgtcatagtattaggtgacttaaaatatgtgtgtggcttgaatggtagttctttctaaagattgatcttatgttttatatataatagatgaatcagtatcatgaagatgtttcgtgtttgtccattctccccgtcaatgtttctcctttaagattaagatttggtttttatatttctgacctttacttttctttaggggaagataggctatagatttatttattttatgtttttgagacacagtctctctctgtcacctagtctggagtgcagtgatgtgaacatgtctcactgcagcctcgacctcctgggctcaagagatcctcccacctcagcctcttgagtagctgggactacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaatattgatttgtttgtgctgattcattcatagtgaattgtttcatctcagttttggaatccttgattgcaaagttatctttagtgtggcctgtattttctttgagaatccttgtagccttgggctgagggagtgttctagtgatggttttgcatttgcatttgccaggtgcccagttctggagctatttttttcttaatttctcagtcccagcctgtatgggcagtataaatttgaaccctaaactcttagaaggtaaacagctctaggtgacttttttcactttatccaaagtttaggcagagcagttaagcttctttgtgctggtaggtttttttctttttttctttttgtggggagtgggggcggcagggggagtgcattgttctttctagttcatgttttatgcagggcccaagttagaatcctgaattattagggtacaaggcgtttatatccagtctccatgtggatgttaagccccaagctcctaggttaaggagatcaaaaacctcactcatctttcctttgttgcagggctgggtcatgtacttgtgcacttaactctctggttttcagttttcttcttcttttctggacctatacatttaaaatatctttcagtatgcctagtctttctagctgttttagtgataggttttctactgttcatttcttttgctcagactacgctttatttgatttctctgcttcggaaatgatgtttaaccttcacaaaatacctgctctctataagggtaccagactataaaagggacaaaatttttctcccatttttcacaaacaaccacaagagtcaacttttcagaagttggtattgctgatctatgatgttgtgttttctgaggagccgtactccatatttctacgctctttgcagcagctgtggaatttttagcattgaggacaacctcattcccagcttgaaatgctgagcttttcttaccctgatgataggaagagagttcatgtaagtgcttagaatagttgtactgttagctgtagtctaattaaagctaaagtgagtgaaacgagaatttgagaaggaagaataggattgattacattcttatcaactgaaggtttagtgtgatgattaataactcctttgcaaattgcactaaatgattgaaattcaagttaatacatataaattataagaccatatagtatttgtgccttttcaccatatctctattgctgcatttataaaagtttacaatttaattgtgctgcttatattttttatgtctattaatatgaataatgagtatgcctcattaggtagcatgatttaatagattagcaatacgaacttttgaaaatctgagtgctgtggttgttggtgtaaaatggaagaaaagtttaatgccttttattaacatttaggctaagtgaatttcttttatcagtttaaaaatatctacatatttgttaagtgttaaatgtttctacgtttgtgataacttcatattcaacataggagaagctggggtttaaacagatattcctgtccttataagcttatgttctgtgaagtagggatattaagcaaataattacataaatacatgtacaaactgtgaaaagtgcaatgaaaaaaggcttactcggttttcaaatacaaagtaaatgtaccctgtgaatataaagtttcattcgtgtttcaaaaatctagttgataaaagtagaagttagtaaaatcaagtttacttattatagttttagtcttaattcaaattatacttttacttgtaattggaaatatgaatttttaaaactattcattgtggaaaaatggaaaaatacacatagaatagtacttcaaatccccatgcatctcttactctgctttaactgtttctggcatgctatggtttctcttcttcccttttcagtaatttaaagcaaaccccagacatcatttcacctgtaaatatttcagtatatatctctaatagatagatttttaagcatttaactataatattgtcatacctatcaagaatcataattccttaatatcatgcattgccaaatttgtgggttttttcattatctcagaaatggcttttttgttttgttcaaattaagatacaaataggatgcgtactttggaattggttgatatttctcctgagcctctgttaatcagtatcatttcttcatttcttcaccttgctctccattttttcccatgctgtttatttgttggactgcgttatttgcctttctacattctgtatttgggtttcattggattcacgttcatttggctggggggggacaagaatactttactgatgatgctatgtggttcctaatgaatcacatcaggaaacatgtcctattattgacttttaatgttatgatcagtgattggatttcgatgttatcagcattatgtattcattatacagtttcccataaatttttcctaatgtttttagtaatcactgatgatcactgcctggattccacttcattgggggctgcaaaatgaaacgttttctagtctgtcattcattctttattttaaaattgtgacttctatgaaagatttttgcttcattgtgtgtttagttatcttgcaatacagtccatgtagggaatgcaggatacagacttgacttccattattcgttatcagaatgagttggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggaaatatttagacacctcaatcttaaggataaggatgctacgatgctacgtttactgaattatcatggtttcttttatcatatcccttgtttgttatgttcctttaggtttttataagaaatatttattgccttatttttatatgtgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcttcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtagtaggatatcaaagttttattgcagaatggaacgaggagattgtgatgttatggtgagaggatgaattgagccagagatttcatttctgacatttctgttttcagctctctactgactgactttatagcattacaaagtcccttaaccttccattgccggttttgtctccttgtagaacatgtcagtagtagttccacatggggatattataacacctaatatgtgactttaaagcttgggaagtactttacatgattatgtggattgaaataaacgatcagaaggaattgagatatgttctgtagtaagcagtgatgtgttaatgtaaatcagataccaatgagtattcataaactgagtatgatctgaaggaattgagataaattctgtggtaagcagtgatgtattcatgtaaatcagatatcaatgaatattcataaactgagtatgaatatctaaatttcattttacaaaaaaatgttttttagtttttggcattattagaccctggctaatttagatatgaaaccgtatacagttcacacatatttttatttgtaacttaaggaattgtcaaacaataatatttttaatatctgacctaaaacagattgaattatattagcttcagaaacatcagttctgcaatgtagttttcaaaatacgtgtttttgttttcttaatatttctttaaactcaataactatctcaccagagatgtaaaaaggcaatacctatataaaggaataatataaagctgtgttctattcatactacccttgttcataatttatgattttaggtcattaccattgtgaaaccaagcaacaattaattcagtaactttaataaaggaaaatataggggtgattttagctgttatgccaagatacaaacatgtggacagcaattattttagattataataaaccaccattgaattaatagttgagatttgcaagattttgatatctattattaagcgttgagcagttgagacactgaatggtaaaatttagagatctctatgaattaaagttaagaagtattagtgggattttatgatttttcataactattcagtgatgttttggaaacaagtctagtccaggttgcctgtgaatagctgtttaaaacaatagaaatgttcaatccgtaataattaactgaaatgtctcttctgtccaaataagagaaactaattgaatgtgtggataaatgactttcttttatactgaagtaactttcccattgaatgcggctccctcatgaacataaatttagagtatatgctgataaatatataaagtataaaaccgatattaaataggccagcaaaatatggctcttggtgacagtggtaaaaggaatgcaccctttcagtaatgagtagtaaaggtagtaatgtgttttaaatacaactcaacaagcctttgttgagaaactatgtataagaagccatgctaagtgctgggattacaaaaattaataaaatatggaatctgtccctaaggagctcatggcatggtttatgagacaagtgatgtcattatcaagttatttgcagaaaaaaactatgataaactcaaatagggtgagtgtaaagtgagagaggaagtatatatttgtttgaggggatgagagatgagcaagatgtgaaggtacaagaataggtcagatcattttaataaaaatatggccaggcctggtggctcacacatgtaatccccacactttggggaagccgaggcaggaggattgcttgagccagggcaacatagagagacccccatatatacaaaaaaaaattagctgggtgtgctgacacgcacctgtagtcccagctacttgggaggctgaggtgggaggatcacttgagcccaggaagaggttgaggttgcagtaagctgtgattgtgccactgcattccagcctgggtaacagagtgagatcctgtctctgtctgtctctctgtctctctctctctctctctctctctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagttgtggagatccagatgatggattggggtagggtaaggatggggaccagtttgataggtatttaaagaagtggaggctgggcgcagtggctcacacctgtaatcccagcactttgttaggctaaggtgggcggatcactgaggttaggagttcgagaccagcctggccaacatggggaaactccgtctccattaaaaatacaaaaaatgggctgggcgcggtggctcacgcctgtaatcccagcactttgggaggctgaggcaggtggatcacgaggtcaggagaccatcctggctaacacggtgaaacactgtctctactaaaaatacaaaaaattagccagtcgtagtggtgggcgcctgtagtcccagcttcttgggaggctgaggcaggagaatggcatgaacccgggaggcagagcttgcagtgagccgagattgtgccactgcactccagcctgggcaacagagtgatactccgtctctaaataaataaataaaataaaataaaaatacaaaaaattagccgggtgtggtggcacgtgcccataatcccagctactcgggtggccgaggcacagcagaatcgcttgagcctgggagatggaggttgtagtgagccgagatcacgccattgcactccagcttggacaacaagaccgaaactccatctaaaaaaaaaaaaaagaaatggaatacatagcatttgatagtcaatttagatatatgaggttagagagatatcaccaaatattacagaataagctggttagagcagaaaagggaaggaaaggttgatggcagaagagagggtttgaccaggaaaatgataaattcagttttagatcttctgagtttgaggtatcagtaggatgtccaacaagaaacttgtagaactgaaagatactttggctttgagagtagattatggtatataacacatttaagatgtcataaaggtaaagttgttgctaaagagcactgtgaagagtaatgtcattatttggaaatcagtggagggtgagagcaaagagaattcaaaggggtacttttaaaaactgatttggagagttacttatttgcaagtccagaaaaaagactcatctctctcttagacacttacatagatgtaataaaaacctttatcccttcattaaaagtcaacaggagaagttctttgccgagggaccattgccagtaaaatcgcttatagacaggtcattttttccaaacataaatctttttctagatgtggacaataaacttaaagaagaagaaattaaaatacccaatatatttatatggagaaatgtttactgttacttgcgttaaaatgcagtctactattttgaacactccaattagcaaaataaagaaaatgaacatacttttatgatgacaaagataggatgaaggcactttcgtatgctgcttggtgatagcagcatttggcccaaccctagtgaaaggcagcttggtaatctttatcaagggccctaaaaatattcatctctttgactggacacttctagagattccttatcttaaataagcagtgatgtgggaaaagatgttgatatgaaaatatttgttaatgttatttataatagtgaaataacagaaataacctcagtgttaaaactggaaaacattaaataaccagtcacttaatacagtgacttaaatattatgaggggcatcaaagcatactgaaaagaccttggttttaaagcccaattcaatcatttattagatctgtaaccttagacacacagtttgttcatctgtaatactctgaaaacattaagattcaaaaagaattaagtgtatcatactaaaaatacatgatatgttttaatagtttgtgtaatagttactattgcatatagagccatcaaaaataggccaggcacagtggctcacacctgtaatcccagcactttgggaggcctacgtgggcggatcatgaggtcaggagttcgagaccagcctgacgaacatggtgaaaccccatctctactaaaaatacaaaaattagctgggtgtagtggcgcacgcctgtaatcccagctactggggaggctgaagcaggagaatcgcttgaacctgggagacggaggttgcgtgagccaaaattgtgccattgcactccagcctgagcgacagagcaagactccatctcaaaaaaaaaaaaaaaaaaaaaaaaaagagtttttactgatacagaaataattagggatactatggaaaagaacaggtttgatacagcttatatgatctcagttatgttaaatatatttgttttctacatgcataggaaaagtggtagaagtaaaaccaccagatgttaactgtgattgtctctgaatgatagaatcattgatggttttaaaaatttcccataaacacctgtgcttttgctttttttttttttttttttttggacagagtcttgctctgtcgctcaggctggcatgcagtgacatgattatagtacactgtagccttgaaatcctgggctcaagctatcttcccactcctgctttcgaaagtgctgagattgtaggcgtgagccatcgggcctggccctgtatatgttttccaaattttttaattatactttaagttctggggtacatgtgtagaacatgcaggtttgttacataggtgtccatgtgccatggtggtttgctgcacccatcaacgcatcatctaccttaggtatttttcctaatgctatcccttacctcagcccccaccccccgacaggcaccgatgtgtgatggccctctccctgtgtacatgtgttcttatggttcatctcccacttatgagtgagaacatgtggtgtttggttttctgttcttgtgtttgctgaaaatgatggtttccagcttcatccatgtccctgaaaaggacgggaacttatccttttctatgtcagcatagtattctgtggtgtatatgtgccacattttctttatccagtctatcattgatgggcatttggattggttccaagtctttgctgttgtgaacagtgctgcagtaaacatacgtgtgcatgtgtctttatagcagaatgatttgtaatcctttgggtatatacccagtaatgggatggctgggtcaaatggtatttctagttctagatccttgaggaatcgccacactgtcttccacaatggttgaactaatttacactcccaccaacagtgtaaaagtgttcctatttctccacattctctccagcatcttttctttcctgactttttaatgatcgccattcttactggcgtgagatggtatctcattgtggttttgatttgcatttctgtaatgaccagtgataatgagcttttctttatatgtttgttgtcttcttttgagaagtgtctgttcatatccttcatctactttttaatggggttgtttgtgtttttcttgtaaatttaagttctttgtaggttctggttattagccctttgtcagatgggtagattgcaaaaattttctcccattctgtaggttgcctgttcactccgatggtagtttcttttgctatgcagaagctctttagtttaattagatcccatttgtcaattttggcatttgttgtcattgcttttggtgtttcagtcatgaagtctttccccatgcctatgtcctgaatggtattgcctaggtttctttctagggtttttatggttttaggtcttatgtttaagtctttaatctatcttgagttaattattgtataaggtgtaaggaaagggtccagtttcagttttctgcatatggctagccagttttgccagtaccatttattaaatagggaatcctttccccattgcttgtttttgtcaggtttgtcaaagatcagatggttgtagatgtgtggtgttatttctgaggcctctgttctgttccattggtctatgtatctgttttggtaccagtaccatgctgttttggttactgtagccttgtatagtttgaagtcaggtagtgtgattcctccagctttgttctttttgcttaggattgtcgtggttatgcgggctcttttctggtttcatatgaaatttaaagtagttttttctaattctgtgaagaaagtcagtggtagtttgatggggatagcattgaatctataaattgctttgggcagtacggccattttcacgatattgattcttcctatcgatgagcatggaatgtttttccgtttgtttgtgtcctctctggctggcatctggcaggtgcccctctgggacaaagcttccagaggtaggaacacgcagcaatctttgttgttccgcagcctctgctggtgatactctggcaaacagggtctggagtggacctccagcaaactccagcagacctgcagcagagggttctgcctgttagaaggaaaactaagaaaggaatagtatcatcatcaacatcaaagaccaaaggtagataaatccacaaaaatgggaagaaaccagtgcaaaaaggctgaaaaaaaacgagcacgcctcttctcctccaaaggatcacaactccttaccagcaaaggaacgaaactggacaaagaatgagtttgacaaattgacagaagtaggcttcagaagatgggtaataacaaactcctccaagctaaaggagcatgttctaacccaatgcaaggaagctaagaacctggaaaaaaggttagacgaattgctgactagaataaccatcttagagaagaacataaatgacctgatggagctgaaaaatacagcatgagaacttcgtgaagcatacacaagtatcaatagccaaatcaatcaagcagaagaaaggatatcagagattgaagatcaactcaatgaaataaagcgagaagacaagattagagaaaaaagagtgaaaagaaacgaacaaagcctccaagaaatatgggactatgtgaaaagaccaaatctacatttggttagtgtacctgaaagtgatggggaggatggaaaaagttggaaaacactcttcaggatattagcaggagaacttccccaacctagcaaggcaggccaacattcaaattcaggaaatacagagaacactacaaagataatcctcgagaagagcaaccccaagacatataatcgtcagattcaccaaggttgaaatgaaggaaaaaatattaagggcagccagagagaaaggtcgggttacccacaaagggaagcccatcagactgacagcagatctctaggcagaaaccctacaagccagaatagagtgggggccaatattcaacattcttaaagaaaagaattttcatcacagaatttcatatccaggcaaactaagcttcataagcgaaggagaaataaaatactttacagacaagcaaatgctgagagattttgtcaccaccaggcctgccttacaagagctcctgaaggaagcactaagcatggaaaggaacaactggtaccaaccactgcaaaaacataacaaattgtaaagaccatctatgctgtgaagaaactgcatcaactaatgggctaaataaccagctagcatcataataacaaattcacacataacactattaaccttaaatgtaaacgggctaaatgccccaattaaaagacacagactggcaaattggataaagagtcaagacccatcactgtgctgtattcaggagacccatctcacatgcaaagttacacataggctcaaaataaagggttggaggaagatttacccaagcaaatggaaagcaaaaaaaagtagggttgcaatcctagtctctgataaaacagactttaaaccaacaaaaaagatcaaaagagtcaaagaagggtattacataatggtaaagagatcagtgcaacaacaagagctaactaccctaaatatatatgcacccaatacaggaacacccagattcataaagcaagtccttagagacctacaaagagacttagactcccacacaataataatgggagactttaacaccccactgtcaacattagacagatcaacgagacagaaagttaacaaggatatccaggagttgaactcagccctgcaccaagtggacctaatagacatctgcagaactctccaccccaaatcaacagaatgtatattcttctcagcaccacattgcacttattccaaaattgaccacataattggaatacaacactcctcagcaaatgccaaagaatggaaatcataacaaagactctcagaccacagtgcaatcaaactagaactcaggattaaggaactcactctaaaccacacaactacatggaaactgaacaacctgctcctgaatgactactgggaagataacaaaatgaaggcagaaataaagatgttctttgaaaccaatgagaaaaatacacaacgtaccaaaacctctgggatacatttatagcagtgtgtagagggaaatttatagcactaaatgcccacaagataaagcaggaaagatctaaaattgacaccctaacatcacaattaaaagaactagagaagcaagagcaaacaaattcaaaagctagcagaggacaagaaataactaagatcagagcagaactgaaggagatagagacacgaaaaaccttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggcgtgcacccgggaggcagagcttgcagtgagccaggatcgtgcaactgcactccaacctgggcgacagagcaagactctgtttaaaaaaaaaaaaaaatcaatgaatccaggagctggttttttgaaaagatcaacaaaataaatagaccactagccagactcataaagaagaaagagaggagaatcaaatagacgcaataaaaaatgataaaagggatatcaccaccgatcccacagaaatacaaactaccatcagagaatactataaacacctctgtgcaaataaactagaaaatctagcagtaatggataaattcctggacacatacaccctcccaagactaaaccaggaagaagtcgaatccctgaatagaccaataacaagttctgaaattgaggcaataattaatagcctaccaaccaaaaaaagtccaggaccagatggattcacagccagattcagctagaggaggagctggtaccattccttctgaaactatttcaaacaatagaaaaagagtgaatcctccctaactcattttatgaggccagcatcatggtcataccaaaacctggcagagacacaacaacaagagaaaattttaggctgatatccctgatgaacatcgatgcaaaaatcctcaataaaataatggcaaactgaatccaacaagcacatcaaaaagcttgtccaccatgatcaagttggcttcatccctgggatgcaaggctggtttcaacatatgcaaatcaatgaaagtaatccatcacgtaaacagaaccaatgacaaaaaccacatgattatctcaatagatacagaaaaggcctttgatgaaattcaacagcccttcatgccaaagactctgaataaactagggattgatcaaacatatctcaaaataataagagctatttatgacaaacccacagccaatatcatactgaatgggcaaaaactggaaggattccctttgaaaactggcacaagacaaggatgccctctctcaccactcctattcaaactaatattggaagttctggccagggcaatcaggcaagagaaagaaataaaggctattcggttaggaaaagagaaagtcaaattgcctctgtttgcagatgacatggttgtatgtttagaaaaccccatcgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaactgctacaaagagaataaaatacctaggaatccaacttacaagggatgtgaaggacctcttcaaggagaactacaaaccactgctctaggaaataagagaggacacaaatggaaaacaattccatgctcatggataggaggaaccaatatcctgtatgtgttttatacttttttttgaaaaagcaagttattaaaagaaaaagctcacaatcattgatgtccaaggcatatttgctgtttatggaatttttctttcctagcagacaactatcgagttttgggtttatgttaggtgtctttacctttcattgcttacagataatattggagcaaaagtaatacgtaaatggaaagttattttgctctgagttgtatttgtgttaacttattctagagttaatttttaaaaattgtgttttttccagaaacagcatttaaatttaaagccctaaagaaggttgcgcagttagcagttataaatagcctggaaaaggtaagttacaacctctctggtattaaaattttgtttttgatgtaaaatttgctgttgttagcatcctgaatcaaaaagttatgacttgagtgatagtttcacattcattttcaggaagaatacattgtaatattattatgaaggaagttagaagtttgtgacattttatttactgtattacaaaaaatcactgtaaagacatgtggttctttatttataggcattttggaactgggtagaaaattatccagatgaatttacaaaactataccagatcccacagactgatatggctggtaaggatacgattgatttttttttttttttttgtcttttaaatgcctacttgtgacataaaaacctatcatcgttttccaagttatttttgttataaaggtgcttttacatcttctattgtcaactggtgtcaaataggaaatactgtttttctcttacatttctaaattaggcccaaccctcttcctttccttggagcaaacaaagtagtttgaaatgaaggtcagatctttagagctgtgataggatggggtgtttggctctttgttgtagagaagcatgtgctctgaagctttattttgtatttagggagatgtgtataaagtagtaatattctcacctataatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaatcatttaaattatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatgacaactggtaattctaggaggctcttaaaatttttttaaatatcacctaggtgattgaaaaaaaaaagaactgagtattaatcctagggttttactgaaatttcaatatgcagtttgttttgcaaatattttttttttcattttttgctgcttttggagaaatactcttagctggctgaacatgagatggtttccttcatggtttgcctgtagatggagatgttcagaatcagctgaatgatttattactttgtagaagtattggaccgggaatttatacattaaagggtaaataaatgaaccaggtaatccttgagagtctgtgattgcgtgttactccacttaggtgtatatctcaacttttccattatgaggacaccatttttcatggtagattgttttggagcccttcaaaatagtaggtttgatgataaatactgagtgtcaacttgattggattgaaggatacaaagtattgatcctgggtgtatctgtgaagttgttgccaaaggagattaacatttgagtcagtgggctgggaaaggcagacccacccttaatctgggtggtgcaccatctaatcagctgccagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgcgaactgtttagagagtttgcaaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaaaaaaaataaaaaataaaaaaataaaatagaaaatgatgagctcagggattctgtctcctgtcttcagaagcagatactgagcctcaaatctgctaagattgacctgagtgagacccttatctcctgtagaaaaagagctgaaattgtgaaaaaacaaacacaaactcttatcatgcaagtggctgacctgcaacaaaaggtgcatgtacagcctaaccaggtgtctactgttaaagtgtgggcattgattggaaaagaatgggaccctgcaacttggaaagggcatgtgtgggaggaccctgatgaagctggggactctgagtttgtaaactctgatgaaccttttttgccagaagaaacagcttccccatccccagtagtggcaacatcccctccctgagccatgctgccatcagcctttccacttttgtctgaagagataaaccctgcgctgcctgaggcaacaggaatggcctcccctgaggcagttgccaggcaagataatgttgattctcctcagaagccacccccaacacccctgtttgcttctagacctataaccagactaaagtcctagcaggtccctagaggtgaggctgagagtgtgacccatgaggaggtgcgctacactcgtaaagaactgcttgagttttctaatttatataaacaaatcttacttggagagaccttggtcatgtttcacttccacaacatatgacactggtctattacattaatgatattatgctgattggattctgtgagcaagaagtagcaaacgcactggacttattggtgggacgtttgggtgccagaggatgggaaataaatccgagtaaaacttagggaccttctacctcagtaaaatttctagggcttcaggggtgtggggcctgtcaagatattctttctaaggtgaagaatattgctgcatttggcccctcctacaaaaaagaaagaggcacaatgcctagtgggcctacttggattttggaggcaccattcctcatttaggtgtgttactctggcccatttatccagtgacccaaagaactgccagttttgagtggggtccagaacaggagaaggctctgcaacaggtccaggcagctgtgcaagctgctctgccacttgggccatatgacccaacagatccaatggtgcttgaagtgtcagtggcagataaggatgctgtttagagcctttggcaggcccccataggtaaatcacagcggaggcctctaggattttggagcaaggccctgccatcttctgcagataactactctccttttgagatacagctcttgacctgttactgggctttggtggaaacggaatgtttaactgtgggtcttcaagtcaccttgtgacctgaactgcctatctatgaactgggtgtgttctgacccatctagccgtaaagtgggtcgtgcacagcagcattccatcatcaagtggaagtggtacatacacgatcgggctcaagcaggtcctgaaggcacaagtaagttacatgaggaagtggctcaaatgcccatggtctccactcatgccaccgtaccttctctctccccacctatactgatagcctcatagggagttccctatgatcagttggcagaggaagagaagactagggcctggttcgcagatggttctgcacaatatgcaggcaccacctgaaagtggacagctgcagcactacagcccctttctaggacatccctgaagcatagtggtgaaggggaatcttcccagtgggcagaactttgagcagtgcacgtggttgtgtactttgcgtggaaggagaaatggccagatgtgcgattatatactgattcatgggctggagccagtggtttggctggatggtcagggacttggaagaagcatgattggaaaattggtgacaaagagatttgaggaagaggtatgtggatagacctctctgagtggttaaaaactgtgatgtttgtatctcatgtgagtgctcaccaacaggtgacctcagcagagaaggattttaataatcaagtggatagcgtgacctgttctgtggatgccacttagcctctttccccagctacccctctcctcgcccaatgggcccatgaacaaagtggccatggtggcagggatggaagttatgcatgggcttagcaacgtggacttcactcaccaaggctgacttggctatggccactgctgagtgtccaatttgccagcagcagagaccaacactgagcccttgatatgacatcattcctcagggtgatcagccagctaccttgttgattatattggacctcttccatcacggaaagggcagagatttgtcctcactggaatagacacttactcctgatatgggtttgcctatcctgtatgcaatgcttctgccaagattaccatgcatgggctcaccaaaggccttacccaccgtcatggtattccacacagcattgcctctgaccaaggcactcactttacagctaaagaagtgtgccagtgggctcatgctcatggaattcactgtttttgtttgtttgttttttgagatggagtgttgctctgttgccaggctggagtgcagtggcgcgatctcggctcactgcaacctctgcctcccaggttcaagcgattctcctgcctcagccttccgagtacctgggactataggtgtgcgccaccacgcccagctaatttttgtatttttagtagtgatggggtttcaccatgttggccaggatggtctcaatctcttgaccttgtatctgcccccctcggcctcccaaagtctaggattacaggcatgagccaatgtgcctggccacactggtcttaaccatgttcccaaccatcctgaagcagctggattggtagaacagtggaatggccttttgaagtcacaattacaatgccaactagaagacagtactttgcagggctggagcaaagttttccagaaggctgtgtatgctctgaatcagtgtccaatatatggtactgtttctcccatagccaggattcccgggtccaggaatcactcaccatcacccctagtgatccactagaaaatttttcttcccgttcttgagacattatgttctgctggcctagaggtcttagttccagagggaggaacgctgccaccaggagacacaacaacgattccattaaactggaagttaagattgccacctggacacactttgggctcctcctacctttaagtcaacaggctaagaagggagttacagtgttggctggggtgattgaccctgactatcaagatgaaatcagtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcccttaattctgtccctctagagaaccctgactaatacagtagggtgttttttgttgttgttgtttattggaaaaatagaaataaataaataagctatagattcagtagtactcaagtgaatttacgttttaataatcacaactgtagctttctaagtgtttactggttatttgtgtatcttcagggaattgctgatttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagctttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtattttttttttttttttttttgagacggtgtttcactcttgttgcccaggctggagtgcaatggcacaatctccgcttagtgcaacccccgcctctcgggttcaagcgattctcctgcctcagcctcctgagtagctggaattacaggcatgcgccaccacgcccggctaattttgtagttttagtagagatggagtttctccatgctggtcaggctggtctcgaactcctgacctcaggtgatctgcctgcctcgggcctcccaaagtgctgggattacaggcatgagccattgcgcctggctaaaaaatgtatttttaaaaatgtattacaaaaaaaaaaaaaaaaaaaaagctggccatggtggcaggctcctgtgatcccagctactctggaggctgagccggggagaattgcttgaacctgggaggtggaggttgccatgagctgagatcatgccactgcactccagcctgggcgacagagcgagattccatctcaaaaaacaaaaaaacaaaaaaaataaaatagtattctcacccttttctactcacattccttctgagctggttagtgttattggctggtatgtatccttccagtcacatctatttacccatatattcaaatgcaaaatatacatacgtagggtggtggtggttgtattttaaaatgaaattattttatgcacattactctgcatcgttgtttatctaagaaaatattttagctgttcctcaaaatagttgatagagatctgacacattcctttcagtattaggtaacattctgttacactaatgagcctcatttactcagccatttcactgaatgggtggatattcagatgttttcagttttttgacacttagctaagccttaagtaaatatcttgttcatatatccttgttaactgatgctcttaattctatagactagaatctaaaaactaggggttcctgtgtcaagaacatttgcatttaaaatttgtaatagttattactagatttacattccccaatagttgcagcaggtcagagtttcatccccactgaattgcctattttcctgcatttttgtcaggattagctgttgttaaatctttaaaattttgccacactaataaggtgagatagtatctcatctcaggtattcttaccttctctttcagaggtaaactgtgtgatgtgatggatatgttattaccttgattgtggtactcattttagaatgtataagtttatcagaacatcatgttgtacaccttaaatatatacaatttttatttttcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggtttgaaaacagttcatatgtttctttgccatttgcatgttttcttttgcaggtgcctgttgacttcctttacctattattctgttatgttgcttccagttccttatgaattcgcggaactttttgtatattaagagcagtaatcctacatttttagtctgtaaatgtttttccagtcacctgtttcttttgactatagtatctttttttaaaaagaaatatttgaaatgtacaaagaatgtaacagtttcccatactgctattaacatttttatattttgctcatcttttgagaaatttatatatgtgtccacgaaaagagtcaaactctataaaatattttaagagatttattctgaaccaaatacgagtgaccatggcccgtgacacagccatcaggagttcctgagaacatgtgcccaaagtggttggggtacagcttggtttgatatattttaggaaggcatgaaacatcaatcagatacatttaagaaatacattggtttggtttagaaaggcgggacaactcaaagtgggggcttccaggccataagtaaatttagacgttgtctggttgacggttgagtttgtctgaagacttgggattaatggaaaggaatgtccaggttaagataaaggattgtggagaccagattttgttgtgcagaggaatctctcagcagacttcagagagagagaaggttgtaaaatgtttcttattagacctaaaagagtgcctggctcttagtcgattaatctcctggatctggaaaggaaagaaggaaaacaaagggaaaaggggattctctatagaatgtggatgttttttccccacaggagactttgcacggcaaatttcaaggtatggcaaggaaatatattttggggctaaatattttttccttgtctcataatgttatgccagagtcagattgaaaagtaagtcacgatatatagcgtcaaataaaacccatctgatgagaatttatggtttgtagggcatgacttcctagaccccttaggtaggagtttgggcaagttaaaaaatcagagctaagtcctcacatggcttttaaaaattgtgaataagtaatacttccataaattctgacttaattacgaatcccactaatttcttttttttctttcccagggacagccactgcaaagggctaaatgtatattcttccagtctagcttctatatttttatgaggatggggagatagacagataggtatatagttcagtgtttctcaaagtgtggtctttagaccagcagcatcagcgtcacctggaaatttgtgagaaatgccagttcttagtttctaactaaatacttagtttctcactaaaaacagccatttttattaagtccttcaggtgattgtgatgcacattgaagtttgagaaccattgttcatctaggtcattgtctttaactgctgtatggtgttccctaaattgaatataccattttttaaaaaagagactaagtcttgctattatgttgcccaggctggtctcaaacttctgggcttatgcgatcttcttccacctcagccttcagatagctgcaactataagcatgcaccaccgcacccagcttgaatgtaccatattttaaattccatattgtcaagcatttaagttacttttctttaaaaaattaacgttattgcaaaggaaacaattggcagagtgaaaagacaacctacaggatgggagaaaatatttgcaaagtatgtatccagcagaggattaatatccagaatatacaaggaactctgatatctcaacagcaaaaaacaaaacaaaacaaaacaacaacaaaaaatttaaaaatgggcaaaggacctgaatagacatttcttaaaagaagacagacacatgaccaacagatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaagaatgaaattctgtattttgaggcacgtggattgaattggaggacattatattaagtgaaataagccagggacagaacattaaacactgagtgttctcattcatatgtggaagctaaaaaaaagttgatctcagaagtaaaaagtagaacagaatactacaggctgggaaggatagggtgcggggagggtagggaacgatttgttaaaggattcaaaattacaactagataggaagagtaagttctagtgttgtataccactgtaagatggctgtaattaacaatatgttacaaagtttcaaagagctaggaggaggatgttgaatgttcccagcacaaagaaatgataagagatgatgggtatgctaattaccttgatttgatctctgtatagctatgaaaatgttactatgttcttcataaatattaatacatcaaaaaatttaaaattaataattaacaaaagataaagggccctgaactctagttttagagctgaattgtatccagtcagatagtttctatgttatttaaatgttcactttaaatttggagctgaaatatatttggaaatctttacttttagtatgttcatttgtgtatgtgaggtaaacttggttggctattggcaaatgtattgggtagctgcttaataaaacatttccttccagtgcttcagctttctgatgcttagaaaatatgtataattaacataatatgcattatcacttttgaaagtaactaattattcgaacagttatttgtgccaaattagtaatgtgaatttgggaactatcagtcttttctatggcccggaataatttaaataatagaaattatctgattagatagaaatcattgtaaaatcatcaaggttaggatttcctttgacttttgcttatcattagttttaaagaaaaaaaataaattgacataatggaaattttcactgtacatcaggaagggaattcagtggaaaagtaagcttcctattcactcttgaccttcagtttatactttttttcctaagtcaagtactgctactggtttcttatgctctttctagaactagcctgtttattgtctatttaaaataactcattaatcaccttttatttgagctcccttatggatctgtgtagtttttctgtctctttaaaattttgtatgcggtaaaatgcacgtaacatcaaatttaccatcttagccatttttaagcatacagtttagtagcactatctttcacatcgttgtgcaatcaatctccaaaacctgttcatcttccaaaacaaattctgtatctattaaacagctctccgttcttccctaccctcaactcctggcaaccgtccttttactttctgtctctctgaatttgactacctcatataagtggactcatacagtatttgtctttttgacatgggcttattttacttagcataatgtcctccagttccattcatgttgccttgaaagacaggatttcattctttttttttatggctgaaatagtattcatccatgttgtagcatgtcaggatttccttcctctttaaggctgagtgatatattccattgtatatatataccaacattttatttatctaaattcatctgccaatggatttttcagttgtttccaccttttggctattataaataatgctactgtgaacatgggtgtacaaataacttcaagaccctgcttttaattcttctgaatatatatccagaagtgtaatttctggatcatatggttattttatttttgattttttgaagaatttctgttgtttttaaagtcacttttgatggtttgttctttgctagaaaatatatatttcagttttatcagtgcagagttgtatataatacttacatattttgtacaattatataaaggttatattatatttccatattctcatataattatctttagtatccatgtttgtaactgtttactcatttctctttcctcattcacgtttactattttattggtctttaaaacctaggctttgattttgtttcctagcatttaaatttttctgtttcattaattttagctttcattttatttatactgttatttcttgaggcaatggcttggttcatctattttcagtttttaaaaaaactgtaaagtatttgtaaggctctaaattttattttattttttagttataggaatttttaatatattctggttattcaccccttatgagatacattatttgcaagtattttctcccactctgtggattgttgtttcatcttcttgatagtgtcgtttgatacacaaaagtttttattttgatgaaatccagtttatctgttttttcttttgttgcctgtgcttttttggtatcatatacaagaaatctttgccaaatccaatgttgaaaatattttttttcctatattttcttataggagttttatagctttactgttaagttttggtctttgatctattttgagttaatttttgtatatgatgtaagaaaagggtccatcttcattcttttgcatgtggataatcagttttcctagcatcatttgttgaaaagaccatcctttctctattgaatggtcttagcatctttgtcaaaaattggtcatatgtgtgagggtttctttctaggctctctattccattggtctgtatgactgtgcttatgctagtaccacattgttttgattactgtagctttgtagtaagttttcaaataagaaagtgtgagttctccaactttattctttttcaagatagttttgactattatgcggctctttgagattccatatgaattttaggatgggtttttcctttttttttttgagatggagtctcgctctgttgcccaggctggagtacagtggcgcgatctcggctcactacaagctccgcctcccagggtcacgccattctactgcctgagcctcccaagtatctgggactacagggacccgccaccatgcccagctaattttttttgtatttttagtagaaacggggtttcaccatgttagccaggatggtctccatctcctgacctcgtgatctgcccgcctcgacctcccaaagtgctgggattacaggcgtgagccaccgcgcctggcttttttttttttttttttgcaaaaaataccattgggattttgatagggattgcattgaatctgtatattgctttgggtaatattgttaccttaacaatctaggaacgtgagatatctttccatttatttatgtttaatttctttcagcaatgttttgtagttttttattaagtttttcacctccctgattaattcctatgtattttattttggatgctatcgtaagtggaattgttttcttaatttcctttttgtatttttcattgctaatgtatagaaatccagctgatttttgtgtgctgattttgtattctgtgactttgaatttattagctctaacagcttgtttttggtgtgtatgtgtcatctttagggatttctacatatatatcatctgtgaatagacatagttttgcttctttctgtccaaattcaatgaattttccatctttttcttgcctacttgctctgtccggaatttctagtattatgccaaatagaagaagaaaaagtgggcatcctcatcctgttcctgatcttaggggaaaaacgttcaatctttcactattgagtatgttgttagctattggtttttaatacatggcttttatgatgttgaggaaatttccttctattcctagcttgagtgtttttttatcataaaaggtgttgaactttgtcaagtggtttctctgtattgattcagatgatcatgtggagtttcttcttcattctattaatgtggtatattacattgattttttcattgttgaatcatcttgtgctcctggagtaagtttcacttggtcatggtgtgtcatccttttaataggctgctgattttgttgagtttttcatcagtattcctagggtgtattagtctgtagttttcctgtagtatttttgtctggctttggtatcggtaatgttggaccatagaactaatgaagagaagtgttcccttctctttaatattctggaagtgtttgagaagcattctttaaatgttgggtggaatcaaccagtgaaagctatctggtcctagccttttctttgggagctttgtgattactgattaatccctttactagttatagttctatttagattttctatttcctcatgagttagtttcggtagactgtgtgtttgtagaaatttgtccattttgtccaggttatccaaattgttggcatacagttttacatagtatcgtctcataattctttttatttttgcaaaatcagtagtgtcaccactttttttgttgttgttgagggggtgggggggatagagtcttgctctttcgcacaggctggagtgcagtgacaagatcttggctcactgcaacctctgcctcctgggttcaagtgattctcctgcttcagcttccctagtagctgggactacaggcatgcaccaccatgcctgtgtaatttttgtcttctttacagtagagatgggggttttaccatgttgatcaggctggtcttaaactcctgacctcaagtgattcgcctgctttggcttcccaaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggccgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcagaaggatcacttgagcccaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttgtactccagcctgggcaacagaggaagacaccatcttgggaaaaaaaaaaaaaagaagttcagaaaacagcttgtttgggaaggactgttttttgtattcctttaataattcaataaagaaaatagaaaaaggatttttttttaaatttgagaaacatttaaatgatgaccactacttaaattatgaaattgaaaaccacaaatataaattatgcattctttatagtatgagttttagaggctgttaatttgctataatattagctacatctggaatagaagaaacttcatatattatcttatcgctatatttgaattctgtagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaaggtaacatgcttattctttctctactacaaactttaagaaaattaaatgaattttctagcataagtattatgtcaaagataattgctaacattaaagttctgactcttcgttgataagttcataggacttgcttttgttgttactgtgttcatcagcctaaatggactgagaatatgaagaaaacaccattttcttaaataagcataaatatacagacttgggtttaaaataatgtggcaattagggcctgaaatgaacctatatatggtataggaagaaattgtatcagggctgatgaaccacagtatgggtgctttgtgctgcttctggcaactggattttactgccatttgtgtgggtaatgtgttgatgttattacatgttagtaaagaaatactgcatgggtatttaaaggcttttgttttctgttggggtttttatagaacctgctttttaatccaagtaagccattctcaagaggcagtcagcctgcagatgtggatctaatgattgactgccttgtttcttgctttcgtataagccctcacaacaaccaacactttaaggtgagagcattggtttttatctaactatatttactgatgctgttatcctttataaacaaaaagactatagagattaataggttcacttttatcggtatttctcactattatgtattgatgttcgtttcaagaccttaaaaacttagtgttttttttttaaactttctatttgctgttctttttggcttcatttgtattactgagtatttttctcatagaaataatctgcttttttttttctttttctatagatctgcctggctcagaattcaccttctacatttcactatgtgctggtaaattcactccatcgaatcatcaccaatgtaagtccaaaaggtattgctaaattactaaaaaaatttttttctttcttttctttgcgtatttctttttaagaaatgcactcttggttttcaaaaaggttctgaatttagatgtatgaaataggaaaatttctccatggtgattctatttgataattgataaatatttgtatttttcatattaagtcttgaccgaagggaccatattaaggaagatggagttaataagatgctttggaaagattaaatctaaaacgttttattcagatcagaagcccttgagaaaaatgtcactgaaaatacagtttaaaattttcatcccgaagcttttcaaacatattatttcagcatttgatacattgacttgccaccttaccatttaagttaaaagtaatagtatttatgttgtagtctagtatagcacattgacaaaatgatgggactatatttgatggtacttttaaatcttttgatcctaaattcattcatagtgtaaaatttcatttttcttaaacaaaatgaaatattaacatactttaaagtaggtattaacaagatacaaaagcatatcagacaaagtaagtgaaatcattaaaaggtacttgcgaaaccttcaactctgtctgatgtggagacattaaatagacagcaaaactatcagatttggactgtggatttttaaaattctgttcttgtaataatgaacaaccctattttgaaagttttcaagtgttattttccattgttccacttttatcaaatgatactcacatttatgggtaaattggttgatgctttccttccttaaaggaggctgtaatcattgataacttagtatatttgacctgtttataatcaaattccattttaagactgtgcctctggtgagttgaaaataacccttcacctcatttgccctggatgttgtatttatttaaaataaatactgcccatattctatccattcctgcagtggaaaattaactattgataaagctatttggtgatacatttaatttttctcagcaggtgtttagtgagcattttgggaggacagtcctttgttgtgcaggatgccttgggcattgcaggacctttaagatcgtctggcctcatttcattaaatgccagttgtgctgcatctccccatccctagtcattatgaacaaataaacatgcctgagggaatgatacctcctcccttagttgagtatcactgagttaaattgtaggtaaaagtaacattgaatatgctttgttccaaaagggaaagtttaatgaagattgtaaataaggtatgtttgtattaaaaacttaaaaaaaatcactgtacttttgtcagcgtaatgagccagggcattgtaccttcaaggtttactttcaaggccattaaaacaaaaagatgatttctcccctcaagtttatgtgtaactcagaaataagtcattattgcttttttccgctgtggctcagaacactaaaaatattcaaagagtggatagctttgcataaatgcttaaaatttgtatacaataaacccaaatatatacttttttgatactttgtggctagttactttaattgtgaaatatttttgtctacaactgactacatagagcactttcaagcatggacttggcactgctgtaagtggctgagctgctcctttctgggttccaagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgactaatttttaaatattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcatagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtacatgctatagctggtatattacttatttctgttttttccttacgacaatttatcgtaatttacatatggatagttcacatactgaaaatgagatgattgctttctactgagaggttgtagttgaaaggaattgtttccaaggcatttgaaaattatttaaatctcttaaggaattgccacataatttgttcatattatgtaagtgttgccatttggctataaacatggtattttcaaggaaaaaaagagtaagtctactttaattgactggtgttcaggaagggcacatttagtaactgctcaaaatactaaacttttttgccaaccacatgatgtctagtttttcatacttattttatttgaaaatgtgtattttactttaaaatgaatatattatgaaaaatgaaaactatgaaaattactaaatcttaagcctaaagttattttatgtggtgcacctggtaccacaatacggtttcaaaagctattaaaaaaagacacagtaatttgaataggatgttatatgggatgcctttcttagtttatcagtttctgacaagatcttacgagatgtgttgggtaaggaagacccttcactcaatgtactttgttattattcagctttttgttactttaggctgattaacacaagctgtataatttagtaagtataaggaaatcaagttgcattggttgctttgggcaagtcaaaattgctgagagttggaggaatccattatactatcagactaaaaattgatcatttgtaggaactagattaaataaagtaggagttgagggaaaaatgtaaacaaccatactgtcccaaaaaagcatttcttccctcccagttttgggattcctccctgaatggagttcagtattcaaaatgtgtatcataagttggttttatattttactatccggcgaacaggatttgtaatccacagtttgggttaaggtaatataactcgatgctattcaaaatattctgagaattccaagtgaagaaattaaaatgtcgagacttcaattagcttagttttgaataagaaaaaatctgggactgaaatgtgagagatgtgaggctattcaatccctcttatctacaatttgaatgtattattcttccagattttttaaatacacatctggagtattataaattagaagcctacattttaggtcatttaatgcatagtctacatatgtagtgaaaattcatccagtcagttttttattaaatgatagactttaaagatatagtgattttcacaattgtcattttttaataatatatcaagtaattcattttaaagttaaagatacacttccaaataaaataggcactaaaaactagacatcagagttaaacagggtaaattgaaatagaaaatacataaaataattgtttaaaaaatatttcactaggatcagtttgtctttgtttatggtaattgttagtctcccatatatcatgtcatcattgcatatcaatttataggtttacttaatagttttatttcatttactaatttcatgttgtaattatcattgttgtctgtaaacatataagtaatggttttccacatacacttttaatactgtgttgaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcagcaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaactacttgaaataagttgtttaaaagttatttattgacctgtttattccagagatctgggaaatcagaagtttatttgacttttttgttttaagtttactaccttttctggtagaaagttaatgacctccaataataggacttgttggggggttaatattcacttcctatttaacttcaatatccactttaccagctgcccataattttctgtgaataaggactaaaaatgaaactaaatgattattttgaacagaggtaaaatttgattggtagtctaaatatgttctctacacttagaagttattttacttcttagccctagttataagctgattctcagagctacatattattttaccgaaaagccataactagagaggatttcctcttttggctcaaggacacctgtaataagaatttagtttttatttctaattattttctgaaaatatcaatatacatttaattttcaaaatcattcctaagctgtttatgtttttgaaatgttatatgtatgtatatttgtacataatgactaaaggacagcttttgggctgatattaccaggagagaaaataaatagcaaatgtaatatgaaacaatttttagaataagaaaattttaggttttgaatggctgttagggtaaaatctcacccttcataaacttggtgagttaacagtcagataaccagtatggaagtattgaccttctactctttgccaggcaaaggtgctaatgccagggaagcatggtgaactaaacatacacagcacttcccctcaccgagattccaagcaaaaggtttatagcttttgcttgaaaatgtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattgcctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctctttttttttcttcttgagacagagtcccactccgagtcccactctgtcacccaggctggagtgagtgcagtgatgcaatcttggctcactccaacctctaccttccaggttcaagtgatctcctgctttagcctcccgactagctggggttacaggtgcccaccatcatgccagctaattttgtgtttttagtagaccatttagcaccattttgggcaggctactcttgaactgtgacctcaagtgatccacctgcctcagtctcccaaaatgcagggcttataggcatgagccactgtgcctggcctcttttagctctctttaaaactgtgtgtgtgtttgttgggtctgtttttatagctaaagaaactgaagcttaaataaagttatattaataacaaatgcatggttaatgaacagtcaaccagagttagttctgaggtttcttgacattcagttcagtgtctttatcaggttctttagttgtccttcttcactagcaagttagcttgatgaaagcagtagctttgtctggcttaatcaacactgaatccctaacgtttgaacaacatctgatacatattgggcatttagtacatgtttgcagaatgaatgaaggaatgaatttcttacttgatgtggtttcaaaatcctcgtacaggccgggcacagtggctcatgcctataataccagcacttagggaggccggggcgggcaggtcacttgagaccaggagtttgagaccaactgggccaacatggtgaaaccttgtctctactaaaaatgcaaaaaaattagccaggcgtggtggcaggcacttgtagttatagctactcaggaggctgaggcaggagaattgcttgaacccgggaggcggaggttgcagtgagccaagattgtgtcactgcactgtcagcctgggcaacagagcgagactctgtctcaaagaaacaaaaacaaaaaacaaaaaaccctcctgtttctgatttgcttctcttctggaaagaccaacctgacaaaaatttttaaaattaaaatgccatattaagatctgatgttagtgatacagatataatactatgatgtaataattgataaaagctattaaactgctgtgtttgtataccctgtttctattaatacaatctaagatagtattattattttatgttgactttttagttatttaaactctttggccctttttatatgaatgttgagccataacttctcctttgtacctttgtagtatttttttaatatttgaaatgtttgtcttagcactgattttactatttgcaaactaacatctcctgctttcataaaattcaaaactgccaataacagatatatgaattttcacaagtatttgttatttctcaacattttttatcttaagtggcatgctggctcaccagatctttcttacatgcctgttattcagtcacatggtctaaattaacaagtggtttgggcctttaatagatatctgaagactctggttcatgaatttcttcccagacatgattgcctctcatctttggccagatcacatgtaccagcttctattcctactaatacctgcaatatagaagatcaactaatgaatgaatgaatttttttcttacatttctaattaagaaacacattgcttctttagcatgtttttcctcactttctgtaacccactaaaattaaaaggtatttgagatgaattaaatttattggaatttctgaagtcatacatttcatattaggcaaccatgttggaacagaatttacatgttgatatttgggattaagaggtgacataattaaactaatatagtcatacatcacttaatgacagggacatgtcttgagaaatgagtgcatccttagtgattcagtcattgtgcaaacatcatagagtctgcttacatgaacctagatggttatatagcctgctacatacctaggatatatggtctagcctactgctcctaggctgcaaacctagactaaacagcatgttactgtactgaataccttaggcagttgtagcacaatggtaagtatttgtttattcaaacagaaaaggtgcagtaacaatacagtataaaagaaaaaaatgtataggacacttaacacaaatggagtttgcaggactggaagttgctgtgggtgagtcattgagtgagtgttgagtgcatgtgaagcctaggacattacactactgtagacttaaaatttttttaaatttattttacttttaatacttttgcatttttctcatactcaggatctatactgtagactttataaacactacacttaagctatatcaaatttataaaaaatatttttatatgataactttacagtagcttttaaaatataaacttttaaattttttaattttttgacttgtaataacacttagcttaaaacactttgtatagctagctgtataaaatatttttctttatatcctgtaagttttttctatttgaaaatgttctattttaatttttattttgaaaactgttttaagatctgggacacaaacatacacgttagcctaggcctacatggggtcaagatcatcaatcagtgttactgtcttccacctccacatctgctcccattggaaggtttttaggggaaataacgtgtggagctgtcatctcttgtggtaacaatgccttcttctggaatacctactgaaggaccttctgaggctgtgtttcatagttaactttttatctttaagtaggagtataacaatacaaagtatactatagtaggctgggcctggtggctcacgcctgtagtcccagcactttgggaggccaaggcaagtggatcacctgagatcaggagtcgagaccagcctggccaacatggcaaaacctcttctctactaaaaatagaaaaaaattagctgggcgtggtggtgcatgcctgtagtcccagctacttgggaggctgaggcaggagaattgcctgaacccgggaggcagaggttgcagttagccgagatcgcgccactgcactccagcctgggcaacaaagtgagacttggtctcaaaatatatatattataataaatacataaaccagtaacagttatttattctcatcaagtattgtatactgtacataattgtatgtgctatactttttttttatatgactagaagtgaagatttgtttacaccagcatcactacaaacaataacgcattgtgcttggacatcacgatggctatgatactaagtgataggaatttttcagctatgttacatattgtctatcattgactgaaatgttgttttgtggcatatgactctatttacattttttggaaatgattcttaaggaaaaattctgatacctgctcattgttctctgatcttgtgttcctgtgcaatggctgcatcagggaagagccatttgatagttacacttagttacatcaaagtaaataaattcgtttaatcaaagtttcagcttgatctgaggtgaaacacctcaacttagagtgaggaaaaaaatacagttgaaagagagcaaacagtaaaaccagaatttattaaatcatttagtaaaacatttgctttggggtcagggggcagttataaaaagcaaactatttggaagttttgctatttctcttctgtagtgacattcttgagtataaatgtgtgcattaaatagctattcttccccccaaggactaaaacccttcggtgttcttgggtataataacaaatgcatatttcacttaaacattgaggatagttcatttgtgttgtagatatgcatgtctgcttcttaactttgaaagacagcctgtttacctggacatttgtattatgggtccacagttggtacacagtcttgttatttctgtattatatatatgtttacataaagacattcattcagaatcagatagttttgtgttcttttcaaggaaaaaaggaaggagatgttttataataataggtgatgttagctctggaatataattgttggatttttggttgaaaaacatttataattattttaattcatcatatgtctctataattgaaacatattttctgtaagtttacctttctgagttctttctgttttacaaatgttcttcaggcaaaatgcatgcattctgtaacttaaaagaggtggagtgccgtcgaaggaaaaagcaaattttacaattaaactagtaaatacaaagattgcctacatgtttcattaattctaagaagcacttatttttactcttctctaaaattgggaatgtatcttattttaaatggtgtcttacaattgacagcagtttttcattccttttgggacatcaaataatgatgcatcttacaattgataatgttgtagagtctatgaaatactcgtatgtatgtctggggaatgtttgttaaataaattacccagtgtgtatatttgtgagaactataggccaaatcttttttcccttatgtttttacattttagaaaatagttttttacatagatgttttacaacctgatactaagcttttagtattgtaatagattttcattgttttattagattgataaaaaaaaatataaatggtgcaaaaacgattttcattgttttgttaagcttaataatactgaccttatgcttactattgagtgtttctacttataccacacatttggtagtataaaaaatagcttttttcaaaggtttttcataataaatttcttttaaaaggttggatagctattatcctgagtcttatgtctgataccatgtttttgttttgtttttagagtcttatatttaaagaaaaagtaacaagccttaaatttaaagaaaaacctacagacctggagacaagaagctgtaagtatcttctcttgtccatggtgaaactaattcatgcagatccaaagctcttgctttgtgtaagtgtttttttatgaaatgtctcaaaattaccacactaagttaattgggtttagctgaaacgccaagaccttgaggataatttttagctcaagagcacttactgatcctttctgatcatacctgaaaactaagacgtctctaagaaaactaatgtataatgaatactaatataattagatcagattcttaattgcccttatcatttcctaacatttctctttcttcttaatttccctatcattaaactaacatactttgatgagatctctgttctcatcctattactaagttatatattattcaggtataatcctggtatgggggatagaagtgaccatcgatcacagtgtctacatctatactgttggtttaaaaaatctccagattgcttttgccagtttagcttttctatccccctttctttgtgttatcagctttctgttatcattggctctgcctacaaatactgtattggaaaaagaatgaggtgaaaatgggtgtggttagtacttgagttagtgtgattatcattattattattattttgagacagggtcttgctctgcttcccaagctagagagcagtggagcagtgatggctcactgccttcgaactcctgacctcaagccatcctccagcctcggcctccccaagtgctgtgattacaggcatgagcccccatgcctggctagtagtcagttattgtcataactactcttactgcctcagatgatattaaatttctgagaacatcactctggtacacagagtaattaggaacaacgcaaataataaaaatgagtcataatgaagtgattaacagcatggacgctggagactacctactagctatgtgatttggatgactatttaatctttctatgccttagttttctcatctgatatattgggatcataatagttcctatctcagagatactgttaggaaaattgaaatagtacatacaatgctttaggaacaatgcctggtgcataataagcactaaataaatgttagctattattgctattaataagatacaatttaacactaattaatgcaccaaatgtaatagttctatattgtgtctttcataggatgacatgtttaacctttgttgagcttcttcagtccctggagagcagcatcaagcaaggtttcttatcgttttgctcagtaactggctttttaaaaagtgttaaggtgctttcgattttggtggcatattttttaaattactgtaatacagggagtttgtaactacatgcctatgattccaagagttctatgaaacttcgtgaattttttaaaaatgtgtatttatgagtaatttttcttggagagtggagaggagagaagaaggaacattcccaaaggatcagtgaccccaaaagaaggcctgtgatactttaagcctgaaaaacccattcaagtttgaaagtctaattagaataaacagatctttggcatgaaaaaattccataaaacctgtcagtgaaactctataaaaaaatgaagttccctttctcttcattcctttgttatgtgttacaagctatttgtggcattatttcatcatgaaggtcacataatactagcagtactctgtttacgtggtgataattcacattcaaagcaggcaccaaactcaccaatgccttttctactaaatgttgcttcaagaagaatttaagcaaaacttgccattttccaaggatcatttaaaatggaaattatttgctttgctgccatctagtggttaataagttttctcaaggtaaccataagtacattaaaatagaagattcgttgtaaatatttgaccattttgtcttttacataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttctttttttttttctgagacagagtctcactatattgcccaggctagagtgcagtggtgtgatctcagctctctgcaacctccgcctcctgggttgaagtgattctcctgcctcagcctcccaggtagctgagattacaagcacccgccaccaaaccggcttgtacttttaggagagatggggtttcttcatgttggccaggctagtctcgaactcctgacctcaagcactccgcctgccttggcctcccaaagtgctgggattacaggcatgagccaccatgcctggccaaaccatatattcttgaagtgcaaatatatgcttccaagttaagagaaacattttagtctctaaataggtaggcattcggcagggcgtggtcgctcacatctgtaatcccagcatgttgggaagccgaggcaggtggatcacctgaggtcaggagttcgagaccagcctggccaacatggtgaaaccccatctctaataataatgcaaaaattagctagacgtggtggcgcatgcctgtaatcccagctactcgggaggctgaggcaggagaatcggttgaacccaggaggcagaggttgcagtgagccgagatcacgccattgcactccgtttcaaaaaaaaaaaaaaaaaggtaggcattcacatttttacataacgttaattttctttgcttagtacactatatttttccacgatgaaaaggaccgaagtatgggtatctgccgatgcaaattctagcctttgctttgttaccagctgtgtggatttgggcaggacctttgtatgggtcaagagggctgtacaggataatcatgcaatccttatccaacatgtatgtcctttacctttgatcacaatcatgtataagctcaaaaccagtaagttccaaaccagagatacgttctttagccagtttactattgttggaaaaaaaattattcctcatattgttgatgtaatttttaatgggaattcgtggtttttgttttcattaggattttccctggacattattcacattaatgaacaagtatagatgtggattaaaagaatccctaacaaaagaagttttgatttaataaaatatttattttattgagataaaaatactatacccacataccataaaattcaccatcttaaagtttacaattcagttgttttcagtatatttacaaggttctgcaaccattaccactatgtaattctagaacttttttttctttctttcttttttttcttttttctttttttcttttttccagatggagtctcgctctgccacccaggctggagtgcagcggtgcaatcttggctcactgcaaccaccgcctcccagcttcaagcgattctcctgcctcagcctcccaagtggctgggaccacaggcgcatgccaccacgcctggctaatttttatatttttagtagagatagaatttcaccatattggtcaggctggtctcaaactcctgacttcaggtgatccacccgccactacctcccaaagtcctgggcttacaggcgtgaaccaccgcgtccagcctagttctagaacattgttatcacccctaaaagaaacttggtaccctttagcagtcactgtctatttcttcctccttctaatctctctcgatttatttattttttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagactgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttctaattgcagttgactttaaaatttttaaaaatattattattaaatattaaaaatactaatttttaaattgagacataattcacataccctcaatttggccattttaagtagttcttttttttaaattttattattattgtacttttaagttttaggttacatgcgcacaatgtgcaggtttgttacatatgtatacatgtgccatgttggtgtgctgcacccattaacttgtcatttagcattaggtatatctcctaatggtatccctcccccctcccccctaagtagttcttattcacacagttgtgcaactatagctactctctaatccataacatttttatcaccccagaaagaaacttgactccccattccctcatccctaccaactactaatctattttctgtctctatggatttgcttgttttagatatttcatataaatagaatcatagaatatgtggccttttatgtctggctaccttgacttaatgctttcaaggttcatttatgttgtggtatgaatcactattttcttcctttttattgccaaatatttcattgtatggatctgttttgttcatctagttatcagttggtggacgtttggtgttgtttctactttttagctattacaaataatgctgctatgaacatttgtgtaaaagtctatatgtggacatatctcttaagtatataggagtggaactgctaagtcgtgtggtaactctgtcgaacttttgaggaactgtcaaactctttttctgaagcagctgtatcattttatattcccagtaacaacatatgaaggttttaatagttctgtatgcttgctaacacttcttataatgtgtctttttgattgtagccatcctgatgtacatactgtacaaatgtttatacatacccagtaaaaacgtttataaaaatattttagcacttactacgtaatcattgcttccatttgtgtacattgctattggtcccgtaaattgatacatttcttgtagtctttttggaaggctatttggcaggagctatacaaacatttcatttttttatgcaaataattcaatttctatcactttaaaaatcttatgaatataactcaaaaggaaaaagctgcacacataggtacttattgctcttaattataatagaatattaagagagctttatttactgggaggagaatgggttaatattcaatagtgagaatgctgttttaacttggtgagctgttaaacatttattaaaacttatatagatcacacagcaatatggaaaaatatgaaatgtcaagtgagtatactgcatttatggctttgttaaaacatggaaaatacaaaaaaaagaaggcaatatgaaaagaaaattaaagcctggaaaaggctaacacattttctttcaatatgtatttttaaagttttatcaaacaaaaatatagagaatttgtcacttaaaaaaactagtgccagtaaatcgtaccacgtttttgtacaatagtagcaaaattgaattttaatttgtgttgtttttccttgatatgagagctataaattatatagctttttaagattctcaacaattaattgcaattttcattaaatatctcaaagtaattacaataaaaatgtttgaaataagataatatgggtctggcctttaaatgttgatatgttgaccaaggactgaaagaaatgtccagagcttcacagtttctgctgggttgggggtggagggatggtgggaggaatgtgaattgggattgtagaattggagttgagataagatcagttcgaaggaagagtttgtgttttttttatatctttgatggttttaatttatataataatctatttatatgttatatattgtaaatgaattatttaattcccgttagtgttctctgagccagattccaacttcagttctgtggtcaattgaaatactttagaatggataatctgctatgaaatactgaatccattttgcttcctctctcttgattttgaaaaataattgctcttttctgttacaagagactttgtggcaagtgagacagtttaagtaaaaacttaaaagataagtaaatcttttgctgtgtgtattaattttggcaagccttcttacttggggattagctttttgtttcatagagttctttaatatctattgaaattattttgtttgtttcttaaagcagtttttacagttatatattgttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaactttggtgtgtcttttatacttacagcacatctcaatttgaacaagccacacttaaagtgctcaatagccacgtgtggctggctagtggctaccatgttagacagtgcagctctggagtagggatcaggaaacttttctctaaaaggccagatagtaaatattttagggcttgtgggtcatatagtttctgtcataaccattcagttctgcctttggagcatgaaagtggccacagacatgtgaatgaacgggcatggctgtgtttaactaaaactgtatatttacaatagcaagtgataggctaggtttggcctgtggatggtagcttgcagacccccactgtggagcactgggtttatagacagtctctgctgtgcatgtggtttattgtttcttcttatgtctactgcaaggatgagatacatggatagaaacactgggagtttaatgaaacatagggggcttatagataaatacttgctttttttctataacctgtagacttatttcctttgattataatgctattgacactttgataactgtttctctaaaaccttacaagaaaaactaagcttctctaaacttgtattcattatgggagaatgccattcttatgtctggttatatctgcattaggttattgatgatgctagtaacaatgaactttatgttactgcagctcacaaatgcttttttacatctgcaagaaattaactagtcatcaaatgcttagtagcacagaaattctcaagtggttgcgggaaatattgatctgcaggaataaatttcttcttaaaaataaggtaagcaaaatgacatatttaaaaaatggaagaatatttggaatggtaatggtgagagattactaaagtgttttatagccaaattaggttctatttcagcttctccttcctcccaatgttctcaaaaggaaatatgtatgcagaggacaatgactggcaaatcagcattttaaaaattattctgaggctttggccttagaaccacactgttgatgaattctagttctagttgagttaaataggtctctatggggcaggcctaggaaaagtgggggctgctataaccagagtagcttgaggagcatattgtatctttactcttaagttcatacataagacataattcatacataaaatttattttaacatatagcttctgtaatttaagaattctattatggcgtagatttgggagtacttgatttaatgggtttttgtccagttctagaatcatagctctgagaaatcgtaaagacctagatctcatggctagactagtccagagaattatctatcaagaagcaaaagggaaacagttgagggtcctcaatctagatttatttcgattcctccaataagggtttcacctcttgaaaatatcaggagactttttcattggggtggagtgaaatgttttgattctgaactattgaaacatggtgaggttgtggaagatagagaagagccttaaatttcttttaacatatagtttctgtaattaatcaatttaggaattctgttatggcctagttttcggagtacttgatttaatgagtttttatctggtactagaagcatagctgtgaaagaccttaaatgtatgaaactcatatccttttcagtatttacagcttgttattaataaattgtctctttagaaatagactaatggtgaagtgggtttattcacatgtgacttatttgatatgttaatgtagtggaatttggcattattccaaagatacagaaagagattagacttcagactttcatggcctcgcctatggtataatctccagaatgtgagtatgaggaatccagtaatgaattcatagtgccctggtaggcatagtcactcttgtgacatacttggtgtatatacataccagagttaattactggtccagaagaacttaatctcaagagccaatttctggttatcccaacatggcacagtataaaatcttatggaaaaaaaatctttgtcattgagatcaaattatagttttcatacagtagatttatattgttgatgttttactcatgtttatgtcagacttaatttatatttgtagaatctactgtttctgatgatttagagaatgggaaactgaaagaaattttaaagaattaagtaaaccttgtttgttctaatgggtttctagtgaatctccttcaagttggggcatagagattgagaggagaggttttttaggagagtctcaaacaggaagacaactcaaataagtgtttattcctcttggttgtcagtgcttcagtaaagcttatttatttatttttttctagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggtcagcttcttctgtactttttctgtatcattttatgtgctctgtttgttttctgaatgaaatttggtaaatttcatctaggtaatatagtgtaatagtgaaaaactgcttagaatctagttctattactgctctttgtggaactttgggcaagttcttaacatccttgttcctcagttcctcaactttaaaatggggacagtaatagttcctgccccagagttgttaaagagggttaaataaaaggatgtgtaaatagcacttgacacttacaagctatatctgataattataattattataaacctccactccataaaaaacccattcataccacagaagtatagaattcgtaccggctaacaaaggtacagatttacagggataaaaacaaagtattttgcttcatgttaaagataagtgtttctgtgatttgtgtttgtgtgtataatttcttttaaatataaatcatatttcaagtgaaaatatcacatcattacagaagagtttattttccaaaccaaaacttttttcattcctaatttttaatgcaaccttgttaaggaagaaacacctaagcagtatgatatttactaatgtctgttttacttgtagaatttgcatttattttatcaattattttctccatttcgtgtttggagaataagtaattcagaatcaaatgtatcttctacagcaatatttagttcttgtttatgcccttgtttcaatgagtgctgcagtgtacttattttattacttccctatagcaagtagatagaatttcctgttacttcctctttttttgtcatttctaattgactgggaggtacattatattgttactgcagtagatttacgttatggtgtttacctgtccatgttagaatcagtttacatttctggaatctggaataggataatatctatttgatttgaaattgaacagatggtagcattatgttggtccagataatctcatttctcatttggacaagatattttggggtttgaaaaattcctataatgattaaaggaaaaagctcttgtgagttattgtatgcggagacacacacacacacacacacacacacacacacacacacacacagtttattgcattgttagattttatacataaaattacccaagttgcaaatatatgtcttccacccttgactctcaggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggtaaatgtgaatagtggttttttttactcagtctgcctcaaagcacatggcatctgattttgagaatgtatttaaggtcactactttgtaagtttacaggggaaattcaagtagcttacttgaaatccttttctgaacaaagtaagatgaaaataaaaagcatttgaaataaattgttagtcttccactgagttgttaatatgctatacattttaaaaataactggcagtagatgttactatcagttatgattatgtaatttactctgcctaagttgtagatagtgaagttttacaaacattggcgtatgttttgagtaaattgtaggtgggaatagctattttattctgtggacattgtagagtccaagataagtacctttcctgtgaggttagtgaaaggaagtttttggctttatcatttgaagcatttgctctgctcttcctactccttttgggtggagcttatcaggttctccattggcaggcagggctctaagtgcagtaacttgatttgctgttgtatttgcttaggaagagcagcacttcagaaaagagtgatggcactgctgaggcgcattgagcatcccactgcaggaaacactgaggtatgcccttagcaacagaaacacccctcccaggcgcccaccctcaatttggaagcctcttgttacatatgtgtgatcaggaatagcttttgaagtaaatccaagatacgtgcatattacaagtataatatctgagtatttaatatacatcaagtttgaaacttggctgtagctgattgatgtttagctctagactaagttgctttcaagtgataattgccttcattttaggcttgggaagatacacatgcaaaatgggaacaagcaacaaagctaatccttaactatccaaaagccaaaatggaagatggccaggtaagtctgtaaagttgacttttgtctgttaactgatctgctaaatatatgtacttcactttgataatctttcaagagtcgctcagtaaagtaaacatatagctgtgtgaagactgatatttagttgtggtttatctagacctgtactttgtaatgtggtagctactagctatgtgtgactatttaacttaaattttaacataattaaaattaaataaaatttagttcctcaatcatatagtaaccacatcgcaagtaccagtagccacatatgacaattacttactctattggacagcagagagagaaaatgttcctgtcatcacagaaatactgggcagcactgctagagactgtttgttgcagagaccatttctttaccttttcttgctctttctcccttcatcagggtgtttcacagaattttcagaaaaggagcaacagaggtagagataaattaacatggaaacaattcattttgctattttgttaggtattctaattaaggaatgtcttaggcagtagattgatcccatagagtaaatgaaattttaaaatgtggacagttcattcaactattactattgactatattatctgttactttggaaattaatgatcagttagtgtttgtgtgtatttgatttgtaatgttcatattgctctcattattaggtgatttataaaaactggttgttcctccatggtgtttttgtcatgcttaattacaataggaaaaagttatatttttacgaagcaaatgtgtgtacctaatacctttatttggaggggacatgtagctttagaatgaaagcttttggggggataactgttttatataattacataccatacagttcacccatttaaagtgtccaattcagtgactgtttttaatgtattcacagagttgtgcaaccatcaccacaatcaagttttagaacaatttcatcaattgagaaaaaaaccccgtaccctttagctatctctgcctctaaccaccccccacccactttcttgcctctcttcccccaacgtctctagccctaggcaaccatgaatctactttctgtctttgtagatttgcctattccggatatattctgtaaatggaattatagaatatgtgggcttttgtgattagcttctttcacttagcatgatgtttccaaggttcatccatgtgaaatcaaaactttttaaaagaaatttgacactcggctgattatattagtgtatgataaaaatagatcagtggctctttaaaaatgtatatggtaattttatgggttgattttaatgtatattttacattttttgtacttttgtcatggaagaaatgttggataaagcataatttgtcaagtctcaactaattaaggtttaattcatgctttgcacaaaaattttgtgtttaggctgctgaaagccttcacaagaccattgttaagaggcgaatgtcccatgtgagtggaggaggatccatagatttgtctgacacagactccctacaggaatggatcaacatgactggcttcctttgtgccctgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggtaaagtgttctcttatttttcacctttctctatgaatagagtgacttgtttgaaataagcctttttctttcagattatttaaattaggtactcacagtttttaaaaatttccaaaaaattgcagaaagaagagtcatctcaatgtaggggtcagcttgcctcttaggaactctggtgtgtatgtgtgcctaagggtatacgtgccctgtgtatgggtacgagtgtctgcgtatatctgtatgcttatttggctctatgcctgtgggtgcacttactctgtgtgtttagatcagtcagtttcatctctctagggggtctgtcttctgggcattgatggcaaatcattaatgtatttgttctttctttaggttttattgactgataccaatactcaatttgtagaacaaaccatagctataatgaagaacttgctagataatcatactgaaggcagctctgaacatctagggcaagctagcattgaaacaatgatgttaaatctggtcaggtaagcattctactgaaatgtagcagaaacattttaagagataagaaaaacctcttacacactgatactggtagtaattgataaaataactggccattctttactgcacacaaactagggtgtgacagtaaggtagccagaagttgtgtacgttcttttctaaataaatatcttattgttttcaaacttacatttaattcgttttacttgatgactaaagtatttagaatgccttctcttttgtctatatctgataatttttttattgtttctatgtctatataggtatgttcgtgtgcttgggaatatggtccatgcaattcaaataaaaacgaaactgtgtcaattagttgaagtaatgatggcaaggagagatgacctctcattttgccaagagatgaaatttaggtgagttctcaaaagagcaatgtagggtcttgtaaatcttaatatgtccaatgaagtacagaaaaagagtagatatgcggttattggtagaaaggaggacatgaaaagagagcaatttacatgtttgtttttctctacatctcttctcaaatttccctaagctttgtgcctgtgacaatgctccctttttctaaaactgtgctatacttgagctaagaatttgattctatttccaatctgataccataactaagggccatgatggaggataaatatccatgttgcttgttcccttctggcttttatgtctgtgatagcagtatctcttttataaagtcgtcatgtcacttaggttatctggcaaattatttgcactataagaaatcttacgtgactaaaggtgtgtgtgtggcttcaaaaacattgtttgctgtttctcttttctccaccattctataggaataagatggtagaatacctgacagactgggttatgggaacatcaaaccaagcagcagatgatgatgtaaaatgtcttacaaggtaaaaaaagaatgaccttcaagtattagtgggttttactgtgagagttataactacttaattacagctttatacttgtattttgtgtgtatttaaacttttgagatgtcaaacttttgtgtttgaaatatgtaaagatgctaatctttattactgcttttttttgactgatagactttcagtaaaattaaatgtgaaagagtgatatgtttgggaagttagtgttgtcagtttatgaagaatagtctacagttattgggaaataagatacataaagcctcagattgcatttgtgttatgattagatagataaaggtattatttgaggaactcattgtgttgaatctttgtaagaaataattgatttcctgattcaagcaccagagacagaaaaaaaaggaagtaatcaagtctgctttaatgatacttattgacacatatcagaaaatgattaaacactatggactgtataataagcattcacatatgtttctttgaccaagcctagctttataatacagtcttctctgtcagggattggttccaagaaccactccccaaacccctgcccacatcttactcccatgaacactaaaatccacagatgctcaagtccctgacttaagatgtcatagtatttgcatataaactatacacatcctcccatatatttttaattatcttcagattacttataatatctaatacaatataaatgttgtataaatatttgttataccatattgtttagggaataacaacaacaaaaaatctgtacatgttgagtacagatgaaaccctccttttttttcccccaaatattttcaatccatgggtggttgaatccatggatatagaactcactgatacagagggcccattgtacatgcttctgatttaaggtagccattttgccaagattactttgtagaaagtaagtattaccttctccccatttgagatgattttgtattctgggatctgcatattaactcaaattatttgggttgtgctaataatttgtttaatgaaataggtagttcctaaggtttatatctgttagtaagaggtttatttgaggggaagtgaaagaacttgaaagattcatggtctctaaattttttttttttttttttttttttttcagagatttggaccaggcaagcatggaagcagtagtttcacttctagctggtctccctctgcagcctgaagaaggagatggtgtggaattgatggaagccaaatcacagttatttcttaagtaaatttcagtcaccaaaaaacataaagcaaaaagcaaataaagccccccaccacacaaaaaaagcaaagaaataatacccatgacaggactaggataggaaaataactgtgttttgtgatttttttaaagaaagtaatatgatcagtgaaattttgcttataataaaacccagattgcttcattaagtcatttacaaaagtgacattgtctaagctgtttggaccactaattttatatactaacattaaaagtgacacatttaccaggtaatattgcatctatttgatgctaatgttatgaaaggtatactaggctatatcaggtaaaatcatgtccaacatagcacacttcataataagccaccctggctgattatcgcgagagaggagagaaacagttaacccagggccattcacaccatgcacatatgattgttttggaatgtctggttagctttctagttgatacggccttcactatgtaaaggtcagtctttttatttctcagatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggtgagatcaaatgaaagtttcatatagaaatacaaaacctagagaactggcatgtaagagaagcaaaaattacttcagcaaggccatgttagtaaatttgcatctgtttgtccacattaggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggtaagtgattagagtaagcggggaagaaaagtgcctggcacatagcaaatccttcagaatatatttgttcaataaatgtttgttgaatgaattgataaaatttcagagccagaagaaagatgtttagttaggtgatttttcagctgtagggaagtggttggcaccactagacctgactagtgttctgtatcatttcatcctactaaaaaattccatttaaacgcattaaaaatcactgatctactctggtgtcttcatatatttgataaggtaattaggttaaacctaattttagttagttgttgcaatgctggaattggaatccacgatttgtgcctgtttactacctccagtttgctattcttttccccataatgtctcatacagttttttaaaaatttaagcactatatttgcatttgatattatgatattgtttattttaaaaactgaaagcgtcatatggctatgtctctctcttaatttaatgaaaaattttcctaaaatcacatcattcttaatacatgctaaaacgttgagacgggttgttgttcctttccagtgttaaaaggctatttgctttttagtgtaccaaaactgatttcagttatagtaaattatgactaataaggtaatctgtccttgttaacaagcctgtatttgttatacctgtacttaaagtaaaattcaaactccttaccctgtcctacaaggctctacctgatctgggccctacctcatctctaacatcatcttatgctattttctttcttgttcaccagagccacaccagctacctttctgtccctccttgttagacttatttctgctttagagcacccttgctgctgccaccacctgaaatgcttctcttctggtattttattttggtgagaacacctggcatgagatctaccctctaacagatttttaagtgtataatacagtattgctgtctgtaggcacaatgctgcacagcagatctctagaacttaccttgtataactgaaattttatactcattgattagcaacagccccaaattattgaaacctccttgaagcctaaatttcagaaatgttcaaatgttttgaaaatggatattctgaattatcttattagcatctacctataattagcactgaaaatagtaattttttaaataaagaatcagttaagggccgggtgtggtcgctcacgcctgtaatcccagcactttgggaggctgaggcgggaggatcacaaggtcgggagatcgagaccatcctggctaacaccgtgaaaccctgtctctactaaaaaaatacaaaaaaatcagctgggcgtggtggcaggtgccaatagtcccagctacttgggaggctgaggcaggagaatggtgtgaacccaggagggttgcagtgagccaagatctcgccactgcactccagcctgggcgacagagcgagactctgtctcaaaaaaaaaaaaaaaaaaaaaaaaaagaatcatttagttcaagtagctttaattcgttgagttttatattaaatgactttgagaaggaattttctgttaggccagatctcacctaccacattattgtaatccttggatcaggcaagaattagagagctatgagccatgatcctggcctttgttgttactgcttgaggattgaggcatctttttatggctacccctattatctataaatttcttcttatcatgtgattaaacagtgatttaccattagatcattttttcttgagtgtaccccaaactgttttactacagagagttataaaggatgtcatttaggtaatagatagaaatttcagccctcatccttgtgaccctagctttgtatgtaaatctggctcatctctgggttctgaatgcccaattccttttcttcctggtttctcaaaaatcctatagtctttctgtttttgttgtgtctctgcctagtatatattcagtattcgctgagttccccgactgtatgagaagagagtagaactcttctgatcatcaatcttatttctgctctgtgcaaatgcttgtacaaatcaaactaaattctttgctgtcatcttctgtttctgctctctttcattttgtgatgtaatttgagctgaatcttggagattttgtctcctagtaaagcgtaggcctctcttaatagcttttaccggttaatccttggaattaacagctatcatagacattgtatatagtcatctatcataaacaatgtacactgttaaatctcaggataaatattaatcagtcatcatttgccttaatttagcaagtggttgtcaactttgggtttacatttttgctactctttagcttcctacctaagaataaaaatgggattgtttgcactaacctgattttgttttgttctcaggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtttgtatcattcattttgtgtgtatgtgtgtgctgaggtatgtcaagtaatgattatgtacagaatgtgcagggctgattgtcttcttttaaggtaaaatatatggagcaggtataataaactcctattcgtgcatttctgtaggtatatggtgctacctatctacaaaaactcctggatcctttattacgaattgtgatcacatcctctgattggcaacatgttagctttgaagtggatcctaccaggtttgtcatcttttcacatagaaccgctgttttttgtttttttttttttgtttgtttgttttactaacactgcatgaagcaaggcaccttctccccttgatcattaaaattagtttttaattataaaagttatatacaaatacacgtttctttaatgatatctgtaatttttttttaaggtatccttttatttgccttagatccagggacaaactagagaaaggtgtctttgacttccacctccagagactgttactagttaagtctgttcccctgtcctttttccatgcatttacatattcatatgcagtcacttgcatgcatactctttttctaactcacttcttctatgatgaggagtgacttaggagaagggaaagaggctaataggtaatgcaggctgcagtttatttatttgtcatttttttaaaaatttgagacagagtctcactctgccattcaggctggggtgcactggcgcagtctcggctcactgcaacctctgcctcccaggttcgtgtgattctcctgcctcagcctcctgagtagctgggattacaggtgtgcgccaccacgcccaggtaattttttttttttttttgtatttttaatagagatggtgtttcaccatcttggccaggctggtctcaaactcctgacctcaggtgatccgcctgccctggcctccaaaaatactgggattacaggtgtgagccaccatgcccagcccagagtgcagtttaaaccaccatttctgtgaagctttctctgcttgttaccaggtactacccacgaacaaagaaatatgctttgttctgtgctgtgcaccaccattgtaacaattgtgacgatttatgagtttctctctcctctagactgtttgctcttttacatttttacatctttatatccttccatgaatatttagcatggtgtctgccttatagtgaacattttataaatatttgttaagtgaatgaattttaacggaatatcttatgcttgctttttctaagccacatgttaagatgttcttgtctgtctttcagttaggactttattttttacttttaagttcagagcttcttgatgattgttcttcctaaataatcattatttagcaactgtgtatcagttgatatttttggctctgcatttgctgaagtatcaactgtaatatctattcagaactccagcactaagccaatttttgttaaaatagttaaaaacttaaaagcaatttttatatttttatttacttcttattttttgaaatggggtctcactctgtcacccaggctggagtgcggtggcaccatctcggctcactgcaaccttcctgtgcaggactcaagcgattctcccatctcagcctcccaagtagctgggattacaggcatgcaccaccatgcaaaatacaaaatttttgtattttggtagagacgaggttttgccttgttgcccaggctggtctcaaactcctagactaaagagatccacatgctgtggcctcccaaagtgctgggattacagatgtgagccaccacgcctggccaaagcaatattttgtaaagccttgtattttcttgccattaagcactttcagtttttttcttgacaacttctcatgtctactttttttttttttttttgcaattttcaagtgtacataatacattattacggattttatgttaattttgtgccctacaattttactgaatcttattattaagcaattttactttctaaaggttaaagaattacttagagagtgaaccagctgcttcaaataagtttactatacaaagtgctgtggtccagataagagaactagatggcaaacaatatactcaggttgcttaaaatcaaactgaggcccactctgacatgtcaagagcttgaaagtcaacactcctgtgttcacaacatgaaaaaagctaaaaaactgaaaatcagcagctcttagatccatcagagaatttaagtccactccaaaaactggagagacaggtaaatgtatacagagaatcacagtttaccaggagaagaagctgctggagccagtaactggtaggaaagcttagatcataattgacgagttgctggaggctgagcatggagtgcctagagagttaaaactcctaggggcctagtcttgcagggacccctgcacctttgtaagttttacctccagaagcctcatcaggctctcatggtgaagataggagaaaaatccctttatgctttgggcaggggaaggggaaaagtagccatttttaaatatgaccacagtgttctgttatccctagcaaaggtttgccctcaggagaaattactttaccagagctttatttgacttagaagttagccacctccagccccctctagcgtttctgtaagaagagagaaaaggctaagaaactctttgagtctggcctggtggctcacatctgtaatcccagcactttgggaggctgaggtgggcagatcacgaagtcaggagatcgagaccatactgtctaacatggtgaaaccctgtctttactaaaaatacaaaaaattagctgggtgtggtggcacgtgcctgtagtcccagctaccaggaggctgaggcaggagaatcgcttgaacccaggaggtggaggttgcagtgagctgagatttgcaccactgcactccagcctgggcgacagagcgagactctgtctaaaaaaaaaaaaaaaagaaactctttgaaggtcacactttaaggaatttggcccaataaaacaatggagatataatcagattgtagagtacttcccttccccagtatcccagttaacggggaaacccagggacaacaaaagagacagaaataagagcactagaggaaatgggcgcctacagttacagcgaacattaaacataacctaacttctaggcagattaacagaatgcctcacactaaagtccaatttacctcagttcctatgacccaatacatcttgtctggctttcaacaaaacattacaatgcatgctaacaaaaaatgaaaaattagtctgaggagacaaagcaagcatcagaatcagactcagatgtggcaagatgtattggaactttgaaattgtcaaactgagagtttaaaataactaatatgctaagggctttcatggaaaatggacagtgtgtaagaacagatgggtaatgtaagcagagacatggaaattaagaaagaatcaaaagagaaggctagagaaaaaagctgtaacagggagaattcctttagtgggcttatcagtagtctgggcaccactgaagaaagaattggtgaatttgtagttatatcaagagaaacttcccaaactgaaatgcaaagacaaacagaagaataaatgaaaatgaaaatacatcaaaatttgtggggtttaataaaagcagttgcttagcagtgttaaatgtatgttagaaaagaaaatctaaaatgaattatctgagctctcaccttagaaaactagacaaagagcaatacctaaagcaagatggggggaggaatcagaaatcaatgaaattaaaaataggaaaaaaataatgaaacgcaaagctagatctttttattttttaatttttatttttttgtgggtacatagtaggtgtttatatttatggggtacatgaaatattttgatacagacatggaatgtgtagtaatcacttcagggtaaatggggtgtccatcacctcaagcattgatcctttcttttttcttttttgagacagagtttcactcttgtcgcccaggctggaatgcagtggtgctatcttggctcactgcaacctccgcctcccatgttcaagcaattctccttgcctcagcctcccgagtagctgggattacaggtgcccaccaccatgcctggctaatttttgtatttttagtagagacagggtttcacaatattggccaggctagtcttgacctcctgacttcaggcgagccgcctgtcttggcctcccaaagtgctgtgattacaggcgtcagccaccgtgcccggcctatcgtttctttatgttacatacaatccaattatactcttttagtgatttttaaatgtacaataagttcttgttgactgtagtcaccttgtgctatcagataaccagatctcatttatattcttttgtacacattaaccatccccggtctccccttccccaccccccactacacttcccagcctctgggtaactatcattctactctctatctccatgagttcaattgttttaatttttttagcttccacaaataagagagcgcacgatgttgtatttctttgcctggcttatttcacttaacatcataaccttcagttccatccgtgttgttgcaaatgacaggaatctcatgttttgtgtctgaatagtactccgttgtgtatatgtaccacagtttctttatccattcttctgtggacagacacttaggttgcttccaaatgtaggctattgtgaatagtgctgcaacaaacatgggagtgccgatatgtcttcaatatactgatttccttttgtttcagtatatacctagtagtgagatttctggatcatatagtagttttatttttagttttttgaggaacctccaaatggtcctccatagtattatactaatttacattcctgccaatagtgtatgagggttcccttttctcacttttctccttgtcaccatttgttattgcccgtcttttggataaaagcaactttagggtgacgtgatatctcattgtagttttgatttgcatttctctgataatcagtgatgttgagcaccttttcatgtacctgtttgccatgtgtattttgtttgtgtgtttgtttgttttgagacacagtcttgctctgtcacacaggttggagtgtagtggcgtgatcttggctcactgcaacctctgcctcctgggttcaagtgattctcctgccacagcctcctgagtagctgggattacaggtgcctgccacgatgcccagctgatttttgtatttttagtagagacagggtttcaccacgttggtcaggctggtcccaaactcctgacctcaagcaatccacccgcctcggtctcccaaagtgctgagattacaggcatgagctaccatgcccagccatggaatatcttttttctttgctttattttcagtctgtgtttttccttatagatgatgtctgtttcttgtaggcaacagattgttgggtcatgggttatttttgtttgtttttaatccattcaatcactcttacgtcttttgattggagaatttagtccatttacattcagtgttattattgacgaggacttactcctgctattttgttatttgttttctggtggttttgtggtcttctcttcctccttttcttccttcctgccttccctttagtaaaagtgattttcacagatgatatgtgttaatttcttgctttttattttttgtgcatctgttgtatgtttttgatttgaggttaccatgaggcttgccaataatattttatgagccattcttttaagctgatgacaagttaacactgatggcataaagcagcaaacaaagaagcaaaaagaaaactaataaaaactctacactttaactttatccccctactttttaactttttgttgtttttatgtataccttattatactgtctgtatcttgaaaagctgtagttatttgtaaaaggttcatcttttagtcttctcaagatagtagttcataccacaattacagtgttataatattttgtgtatttactgttaccagtgaattttgtaccttcagatttcttattgcttgttaatgtccttttccttttgattgaagaactccctttagcatttcttctaggacaggtctggcattgataaaatccctcagcttttgtttgtctaggaaagtctttatttctccatatatgaaggatattttcactggatactgttctaaggtaaaagttttttttttttctttatcacttgaaatatgtcatgccactctctcctggcctctaaggtttccactgagaagtctggggccagacatattggagctccattgtatgttatttgtttctttcctcttgctgcttttaggatcctttctttatccttgacctttgggagtctgattattaaataccttgagttaatcttctttggtttaaatctgtttggtgttctgtaaccttcctggacttgaatattgataaatatctttccctaggtttcataagttctctttttttttttttttttttttttttttgagatggaggttcactcttgtcgcccaggctgcagtgcaatggtgcaacctctgctcactgcaccctccgcctctacctcctctttaaggccagtaactcttaaatttgctcttttgaggctgttttctagatcttgtaagcatgcttcattctttattcttgtctcctctgtgtattttcatataggctgccttcaagcttgctaattcttctgcttcatcaattttgcttttaagagactcttgatgcatatttcagtatgtcagctgcatttttcgtctccagaatttctctctggttctttgtaattgtttcaatctcttcgttaaatttatctgataggattccgaattccttctccacattatcatggatttccttgagcttcctcaaaacagctattttgactcctcggtctgagaggtcacatatcgctgtctctccaggattgatcactggtgccttctttaattccttcggtgggtcatgtttttctggatggtcttgatgcttatggatgttcattagtgcctgggcattgaagagttaggtatttttgtagtctttgtagtctgggcttgtttgtacccacccttctggggaaggctttccaagtatttgaaggcacttgggtgttgttatcttaagtctttggtcactgcagctatatctgctttaggggacactccaagcccaataacgctgtggctcttgtacactcatagcggtaccaccttggtggtcttgcataagatcctggagaattccctgggttatcaaacagactcttgttctcttcttctcttcccttactttcctctaaacaaacagagtcagtctctctctctgtctgtgtgtgtgtgtgtgtgtgtgtgtgtgttgagctgcctggagctgggggaggggcgacacaagcagccctgtggacaccagcactgggagtgcactgggtcttgcccaaggcctgcagtactgctgcctgactaccacctatgttcactcaaggcccaaaggctctacagtcagcaggtagcaaacccagccaggcttgcgtcctttcgttcaggcagtgagttctccgtgggtccagagatgccattcaggagccagagcctagagttgggtacatcagagatctacctagtgctctattctgctgcggctaagcattaagctggcacccaagctgtaagacaaagtccttcccgctcttccgtcctcttttctcaagcagaggagtcttttcccatggccgccatcgccccaggcccatggtgagtgctgcctggctaccactgatgttcactcaaggcccaagggctcttcattcagctcatggtgaatgctgccagttctgagtctctcccttaaggccttggggctcccctctaacccagggcaggtccaggaaagttttccaggagccaaggcctggaatctgggaccccaggagcctacttagtgccctaccccactgtgtcaagctggtacccaagttgcaacacagagtcccctttattcttacctcttctttcctcaagcagaaggggtctctctccatagccaccacagttggtaatgtgctgggtcacccctgaagccagcatgtctccaagtctcacccaaggcccacagcaagtactgcctggctatccctcctggttgttcaggggccaagggctctttagtcagcaggtgatgagttctgccaagactgggtccttccttttaagacagcagatttccttctggcccagggtttgtttaggagtgttgtctgtgaggtagggcctgaaatgggggcctcaggactctgcctggtgccctctcctactgtggctaagctggtagttacaagacaaggtcctctttactctctccactcttgtatttgaacagagggaaggcatctctgttggagctacaagctgagctgagctgcctgggtttgggagaggggtgatgtaagcattcccttggttgccctggctgtctcactaggtccaccccaagtccactggctctgagcccagcacagcaccaggacttacccagaaactgcagtccttgtgggcctagactgcctttcaagtttatttaggacctcagggcactttagctcttggtggtggggcttgctggaactcaggtttcaacagctgggatgggtgatttacctctggctaggtctgttctaagttctccatccttgagcaccagctgagctctgccctgtgttgctttctgctatgacagggcagcatttagtcctaatgcaaagtcccataatcactgtgctgtccgtcccccaaatgcagattttctttgcacaccacggggccactgccaggaggtgaaggaagggtggtataggtaagtcaagacagtttttcctacccgcttcagtgcctcttccttaatatgatgttaagaccaggtattgtgatcacttacctgattttcagttcttatgaaggtgcttttttgtatggatggttgttcaagttggtgttccaataagggggacgatccctggaggcctccattcagccatcttgctccacctccagttctcaagctagttctttgaaaatcaacttgggaaaagttttatacacaggaacacttgaataattgaacacaaatgttcattgtagttcagaattagtagaatattcaacaggttaccattggcatgtgggaagcaagagagcactgtggctagaaggtattgttttagagggaaacctgaaatggactgcagtgtacctgctgctatgctgactcaaaaaaaaaatttcacaaagtaggcaattgtcagggtttctagcagtctctttgagccttgttaaagaaattgttaatctcattcatacctaccaactcctagacctccatatcttaagatttggattactgttgtagcttaactgttctccctgcatataatccccatatttaggctgtctcttcaattagccacatattgcaagttcattttcctcctctggcttcctaacaaccatcagccattctccaatagataccaaccaggtgtccttgtgattcagttcaaccgtgacactgtttacctggagagagcatcagatttcccataggataagggctgagtaagattgctaccacttcagatgccaattacaagccccaggttgttacctgtgcttctcacaacttcaccttgagttggattaatttgctagaaggactcacagaactcaggggcatactttacttttgtttgcctacttactataaaggatatcagaaaggatacagatgaacagccagatggaaaagatgcacatagggcaaggcatgtgggaaggggcttgcagcttccatgctgtctccaggtgcactaccctccaggcacctctatgtgttcggcaacctggaagctcttcaaactctgttcgttgggtttttatggtgacctcattatataggcatgattgattaaatcatgggtcattggtgataaactcaccttcagcctctctcctctccttggaggttggggagtggggctgaaagtctcaaccctctaatcgaaacttggtctttctggtgactagccccgtcttgaagctccctaggacctcccagccaccagtcatctcattatcatataaaagacactcagcacttccagagattccaagggttttaagagcaatgtatcaggaatcaggagcagagaccaaatatatatttatcacaatacccttgaattattgtattgagtacttagtgtggaatacctggtctatatgtctttctcctttttgaaaaggtcaaaaggcaattgttgaatcctcagcacctgatactaagatggcagatagtagatgtgcactaaatatttattggattgattacctgccgcacctactttctctttctgaaatacccttacttcttttgtctatgcaaattctgtgcctcctttagaactcacctgttcaatgaagtatttcttgctttgcagtccatgctaatttctgaactcttactgtattcatatgctgtgccacacagcaaactctaaggaatctacagcaatgacgtaagtgtccaaagcatttctgtaatacgttaattaatatagaaacaaaattactaattaacctgttaaaaacaaatatttactcagtacttgctgtggtaaggcactgtgctagtctttaaggggacataggtaaatacttccttcaaggagcttacagtttagtaagagggataaaacacacaacagataagtggtgagtttcataaggggtgtattttgagagttcagattaggctagttagagagtaaaggtttgtggatttgattactattgggtaaaatttaaactacataaagtaggcattattagtcctgtattattgatgagaaaaaatgacacccagagaatttaaggattgtgaccaactcataatgattgataactgatagagctgaaatttaaacctagtaagtctgcctgcggaatctcttcctttaatcacaacatcagagtttagaggtggtactgataagagttagcaacactgggccgggcacggtggctcatgaccgtaatcccagcactttgggaggctgaggtgggcagatcataaggtcaagagatctagaccatgccggccaacatggtgaaaccttgtctctactaaaaatacaaaaattacctgggcgtggtggtggtgcgcctgtagtcccatctacttgggaggctgaggcaggagaattgcttgaacctggaggcggaggttgcagtgagccgagattgtgccactgcactccagcccggcaacagagcaagactccatctcaaaaaaaaaaaaaaaaaagcaatactgattggatatggggaataatgaagtagagcaggaaaaagtgacatcagagatggcctgaatgatgtgattaagaaagtgatagtgctattgataacatagagcacatgataagacataagagtacgaggaaaaatcagttaatttggggcatactgatttttagataccagtggggaggggacatctagcagttagaaatgtcagactggatgtgaaatgcagttcaagataggggaaacctgaatggccacaaaatatctaaaagcatgtctaaccttagtaggaactgtggaaatagaagttaaaaacatgagctacctcatgttttactcaactgctagattggaggggaataagaattcttatacagtactagttttagagctatttggcaatatctagtaaagttatatctgcatatactcaataactcagaaatttcatttttaggtagctgccttagagaatctcttatgtgcaagaatgttcattgcaatggtgtttgtaaaggtgaaaaatgtttaatgttcattataattagagaatagataaatcatggtatacaatagactattatgcagtaaagtgaactatatcttcatctatcaacatggataaatctcagaaacataatgtagagtgaaagatgaaagttgccttttgttactattgatgaaaaaagtaaagacctacatcattcagccgggcgtggtggcttatgcctgtaatcccagcactttaggaggccgaggcaggtgggtcacttgaagtcgggagtttgagaccagcctgaccaacatggtgaaaccctgtctctactaaaaatataaaattagccgggcgtggtggcccatgcctgtaatcctaactacttgggaggctgaggcaggagaatcacttgaacccgggaggcggaggttgcagtgaactgagattgcgccatcacactccagcctgggcaacgagagtgaaactccatcccccgcccccaccccccaccaaaaaaaaaaaacacctgcatcattcatatgtgtgtgttaattttttcatatgggcatatacacatagaggattgtgaattggaaaaatacatgatattcttgttttatctgtcccctctctcccccttttgttgcttgggtattttaaagcatatctcagagatcatgtttctaacatatacagacttaaacacacatacacgtgcatgtgcagcctgagtatttccacacaaattaaagttaataatcctgaataatatatctaagactagttttctgttaaatttttttcagttatctcaaagttgtctttttttttatttttatttttgagattcagtcttgccctttcatccaagctggagtgcagtggtgcagtcttggctcactgcagcctccacctcccaggttcaagtgattctcctgcctcagcctcctgagtagctgggattacaggcacctgactaatttttgtatttttagtagagatggggtttcaccatgttggccaggctggtcttgaactcctgacctcaaatgatctgtcagccttggcctcccaaagtactgggattgcaggcgtaagccatccagccctgtcaaagttgtcttttttttttttatagttggttgtttaaagattccaatgaagtctacacgttgcacttggcttaatgtctgtataagagtctcttttaaggagtgatttttgttatttgttttaaacaaaagtgttaggattttatttttatttttttgtaggttagaaccatcagagagccttgaggaaaaccagcggaacctccttcagatgactgaaaagttcttccatgccatcatcagttcctcctcagaattcccccctcaacttcgaagtgtgtgccactgtttataccaggtatgcttacagttagagattaccattattaatctaaagttaaattatgaagaatgctttatcaaagaaggatctagctgctgatggtgtgtggttaactataatactgagtcagtttggatgaataatacattgagaattgttggaattgtctttgaaaaaaacttaaatattacttaggcaacagtttgaagtaagagaatactttaaaatactaaattttacttgcattgggagcaagtttaaaatgcagtgaatccattgggtatgatggatgtggctgaaatgaacatattatggatttttgttgttgtcatctattaacctaaattatttacagggtgtttcacagttgaggcgggtctcctccttgctttttgcattgtgaattgcttgatcatctgtgattttggtttcttcattaatgtataattagtttgtgtcaggttttcccaggatagactgattgttctgtttactttatgtagcatatttcttaaaagagatactgcatcatcattcagaccaaattattagaccttctaacactagcactgcaagtaatgcgtctgaactcagaaaatagccatagtcatggccttcttttttagggaattcggtctatgttcttttatgtcttctactgtgtttttgaattgcacattgcagttttaggaattatttattccaagggaggtcctgcaaatgcatattagccttttggaaactgtgattctggaagaaacattagtgggtctggaatttgggataggggtggatataagggaaatacacagttatcaaaacccatgtctttgtgtctctctctttgcagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctgtatagttttttcaactagttaagtctgagtctaaagggtagtttagttataatatgaaacttaatacagtgaatatcttctcaagtttgggctgtattcaggtttctctttaaattttatttagtaattgttctattgatgaaactaggcagacaggaaatagcacatattaaaaatagtctgggtcagcttcttggttggcctagtagtaactggtttcagagagcaagtgggtttctaaaatgacagaggctttgactttagctggttaaaagtgaatggggactgactacatgattacatggtctaggagattgtagtagaatttcttcatgtggttgtcatcctaaaagaaaaatctttttgtatcatgagcaaagttggagaccgttttgagaccatgattctaataatgtaaaaggaacaggtcttagcacttatttagtacttaggaaatatttaatgaagaaataaatttcccatccctcccacctaagtaaacaagattcttgccagctttcacagctaagaaaggaggaaaatagtgaaaatagatttttaaacactatatgtggtgattattaaacagtatgttatgctttttagagcacttcacagtaaaatatcctatattattttaataacaaacctggtttattatgttaaaatttcacataaaattattatctttaaaaacatgaattaaaggtggtatcagtgcattgtttaagtattgggtaaaagcattgttgaagagcagagacagcatgctgtgttgttattaaataaggctttattttttaattagtaactggtaacagggaatgttacatttactgattagaaagaaagataggaaaaaagctttggtctcaagatagtattttattgagtctgcttcccaaacctagtttatttcttttggtttgctcttttgtttttattcatcttccctcttctggctttttcttgcccctttgcctttggcagtaacagaaaggtaccttcctgctcttctgtgttctgcctggagggatagtagtccctttgggacctactggggaaatgttgaaagggaagtgagtatattgctagctaataaacttccctggacttcagctccttttttgagttcatatcttggcctttaagccttttcaaatcatgtgttaaccagctctattactttatataccttccttccttagttgactggattaaggttatttaagaatagccaactgtgaacatgtgtcagatttataattaaatcattttctcatgtgttgttttcacttctcctgatggttttaggataaagataaaatgattcccaaagtggatattctcgtatggtgagagaattctaagaactaatttatgattctaaataaatctcaccctttttcagtaaatctgcttctccaaactgaagtagtttacacacagttttaaggctataaatgatagttatataccactgttactaatacatttgtatatagtctaaagtttgaaacaaagctctgtgagctaaggggctgtgtcttgttgttttactgctatttcccaatgcctagaatggtatttgacctgtaggtacacagtaactctttggatggatgaatgggtgggtggatgaatggatgtctaactaacttaaagcccaagttatgggttatggtgttggatgtccagaattcccagaataagatgccatctatttgtggattaaataattctaacatggttttaaaaatatttttaaaataattattctgcctaggctagtccaatcaagagtcttttaattttgaaagaaatctttggtctagaaagagctctgagagatgaaaccaatatgtgcctggagttttgggggttttttaggtggctttttttttttttttttttaagatattttgataaatggtcaactgtaatatgtgaaaagttttaagcaggcctacagttttgttctgtaattttctctgcagtttcttcactttaataatattaatgcttcttactagttgagctgataaccttcttctcccaaatgttgcagagcttttaacctcctctgattagaaccatttcaggaagtagcctgcaaacattgaaaaatatgtgaaatgttaagagtaatcttttttagagagagaggtctttaattcagaatttctaaagtgaatttttatatttatccatataatttttatttctttattcagtaggatcataattaaatgccaggtgttggaaaaagaacttaaagtcaattgaaggatacacagagaagaattttacataccaagaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtaggcaacttgccactccctactgaataaagctacagtaaaagaaaaaaaggaaaacaaaaaatcagtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaacgaaaaagctttacatataagtttctaagctgtacatataaattatctaagctttaaatatagatttttaaaattcaaatcaaaatttaaatttatagacatatacttttgttgtgtccattgaagattttatttttgattatattaagtaaatttgcctagctatgatcaaattgattggattataaagacgtttctaatgcttcagccttctaattctcagcatatgtgagtttaacataatgtacaccatcattgttgaaattaatttgctgcttctaacactcttgttcagtgttatactaatgccattttgtagtgtatcacataattaaaattcaggctttctgtgtttctctagagcatgttttctagcctttctaacactgctttatttattaagattatgtctaaaattgtttcttgaaatgtttttttttctactagagttattttcaaaaaatttttttttaatttctgggtaacaccaagttttggaatgtatttctcagcacaggtaatacgagctcctcatggaaacaaggggaatctaattggtaattcgagatattttagagtacattccaaagtatgaagacagtatactcataaatttaaaatgttgttttatggagttgtgtgctttaacaaaacctaatgatatttaagagcaagctgactttctttttgggtgtatatgtcatggattggaatatgtaaaatatagagagaagatctggcttctagtatatagctgtgtagtcacattacaaataactgtttattattctcaaatatatagtgtataatgaggtttactttgaaagttaactgtctgcctaactcagggagaatgcagtaactaagcatatatgggtagtaatgctcttgctgaagtgtagtttatgactacatgcattcgcgttatgtagtcagcttttaccaagggaagaaagggtacatttggctgataactggtctcaacacacagactggcccaagtttgaccttttatgcagaatgtcttttggatccaaattagatttttatggattaaaaaaaacactagagcatgtatgtattatgaggtaaaattacattgatgtcaattagtggtgaatgaaaaaaaaacagtccttttataagttgacttacgaaacttgttatgtagcatttttattggtttttaaaatcagtttttagttccaaaattatattgattctgccatcagtgatacatatatttatatgatacatgagacagtatgtgttcctgaggtgtcgatattttgggttttgacatgaattatttttaaagatgtggaagatggtaaaagtgtagtacttttcataaagtttacaatatgcttttgggaaatcactcagtttttcattaaattctgaggctgagtaccattaaatcaggtgtaaatatgagtcacattttaaaacttctttgtcctagagaaaaccggtaaatagctactttcaaagaagtattttgtctaattgatgataaccattacaaatttccttgttccttctccactcccagtgcttcattttactagcataaaaaataaaacagtattttgaaagctctccatgtgtttcacagcaggttaacattttataaactaactggttctttgaaaattaaactatgggttttagttttgtaaaaacttttagaattttaatgagttaaacgtatgagatgctaattcttttaaaataatctattttaaaataattataaagcagtttttaatccttttccctcctgctaactcactccttaaaggctttaaaatgttataggtttcttttgtctgcctttatttatttatttatttatttattttgagacagtctctctgtcacccagattggagtgcagtggcacgatggctcactgcaacctccacctcctgggtttaagcgattctcctgccttagccttccaagtagctgggattacaggtgtggctccaccatgtccagctaatttttgtatttttagtagagatggggttttgccatgttggccaggctggtttcgaactcctagcctcaagtgatctgcccgcctcggcctcccagagtgctgggattacaggcatgagccaccacgcccagccagagaattgtctaagattaaaatttgggagttttagaaaaccactcagtagcaatgatggtctatgaatattctaaaattatgtgaagaattttgtgtgtgtgaatgcatacattcatttttctaacctttatcagatttcaaagaggttcctcgtccccagaaggttcaacaccgtactggaatagtcaaagcactggaattttttcttaattttacatctttctatagttttagctaaaacttctgtatctaattctaaatgtatatatttgagctaaaaataaatggtatttaggttttaaagccattctaataaagcagctatatttagtcaccttcaccagtttccccttatttaagggttaaggttgttcttcatgcaataaacactgtaacataaagaaagcttcctgaactatgtgtagtgtaactgaagatggaactatattagttacaactgacctctttttatcacctcttacaaatattttctctaaaatctagtttttactaacttcctgttagagattatagaaagctattttgaggttataagcagtgataacacatttaaaatgtggactgcatgaagcactacattgaacaagatgaagtgaaataatccccattttttccagagttaatctggagtcagcctgtcataatttgtgtcataatttcctgtcataaattatgacaggaaatatttattgaagcattgtgaaaaaaatagctacgtgatattccgcatgtaaatctgggtcccctcccaccaatatcctttgaaatgaaggtttatccttgacatcacagaatattgagtggaatgctacagttttgtagtcactgctactttaaacagcagtttagccgcactaagcaagaatagctgtagagattaaaatgttacattaagtgttctttaaaaatgaacatatatagtatatataaaaatgtaaactgcaaaatataattttcatctatgacatgatttaaagcaggggactctggaaagggatgggagctgaaccagttttatagcactcttcccgagctaaggtacctttttatcttaatgtagaatgttttataaagggaaaatcatccattttaaatattgggttcacattgcttttcaggctggacaaccatttcttgagttcttaaattatttttatttgacagaattataaattgaggtagacataggggttctctcttctggtgagatccttttttcttttaggtccccaagaattcccatccctccatggtttaaataataggtaggttcttgtattataaaggaagctgtgaagaaaaggcactggcagtaacattacttgtaagtaagtttttttttttctcagtaagaatctaatattttattttgtatatggcaagcatttttttcttaaattcaattgtaactggtacacaacaaaatgtaaatatgtactatcaggtataggatgttttgggggtgtgctgttgaaaatttagtttcacgttataaagttgaccacactttcatgtctgttaatcttagtaaattatgatcatctttgtgtgaaaaatttggtctgctttcattactcatcaaacatgcagtataagtgatgatacagtgaagatcttttttcaggtttcttctacccatctcatccatgaggtttttctttcctctgagataccttaattgtactttaatatgatataagactagaattgagaggaaactttattttctcatgttttgggagaagaaaaaaatagaaatatgtcattcatgaggactgattgattcagagtttttatgcaaagtttgacctttgaactctttgttttcatgtctttatattaattcaaaccttatactcaattctcaactccttgtttttaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaaggtgaattattttgataatctagctatcttaaattccccttccaactaaattttcagcttttcttacagtacttcctcttacatttatatttgaaataccctatggttttcagttatgtgcttttgttttatttgtttatattacaaaggaattcattagttaggtacctgatggaccttattttcatgataaaacattttattatagcagatgtcttgtgttatgaagatcattttttgcgtaatcattctagacattctgaaacagactagaatgtagactataggattttttattttaaaagtcattaaacatttttaatatgtatttttacatgtaaatataataattatatttgggaaggttagaaacactacctaaaataatttatagaatgaggaatgtttgatttttaagtactagcagaaattatatcaatgagaaaattcatgtttttaaagaatgtcttaatgtatagacttcatacaataaataatctgattatttataaccctgttttattgtgtagatacttcagagtattgccaatcatgttctcttcacaaaagaagaacatatgcggcctttcaatgattttgtgaaaagcaactttgatgcagcacgcaggtaattttcttgccacttactcagttgctctgtttgaatcaaatattttcggtttcacataaatccatgtacctgttttacatgaagttcctgtgtaagtttttttcttttcctgctctaggtcaagacatagcttgtcttattttattttactataaaagacagtcatgaaataaattaatattttttataatttggtagtgattttcatatttgaaaaccaagagggatttttgacatgtctaattaaataaaggatttgaggatggtacaatatgtggacaaggaagaagtaggattctttttatttaaaactaaaaccaaattggtatcaataatacataacaatgtttaataaggtttttttgatgttagagtatttgtgatacttaaatttggaagtgtatctaaactaaaatgttattctttaaaccaagtcaaacaaacacataagattttgtttatgaggaactgaactttatgattttagaaaacttttctgctagatttctataactagttatttcactttatttctctgagttattggtctatctgtaaagtagggataaactctttgcctgagttgtttttagagaaaaaaatgagataattcataagaaagcgctttgtaaatttatgtctggaattctgcttttcatgcagtgtgaatctaattgatcctcatcatctaagctagccttgtacaactctctcttccagtttatcatcattgtagttgttactgactttttttctgttagagaaattggagttgaaaaggtatattgctgaatgacaagccatgttggaaagagagtgaatgtcagcataggattcatattctggcactctgtgtacccatacaaagttaaaaggatcaaagttttaatcctggctctgacctagcaggctatatatctttggggaggtctttcgtctggaccttcatttccttatctgtaaaatactagcctctttccaaagtttcatccatcttaattttgttgttgtttaacttcagagcctactttgaagctgaagccgggtatcagaaatggaaagccaactttctccttgtcctttttgctttgtctaatgtcaagtcacattgtgtgaacaagccctccatatttgtaatcttagttacttcacaaagttacttcttataaatttaattcaaacataagtctgggtgtatctggtgttgaaaattctaatgactttgcatttttgaaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacaggtaagatttcccagtcatggggatagtgaacactctccgtttaaatttagattaatacaattattggtcatgaatagtgctttttactttgcatcttcttggactaagaattatggtttagaaagagaaagattctttttttcaaaaaaatacaaacaaaaggttaagtcatattaaataatcaacaaacctacctaggttccagtggtcattattattatttttttgtcaggttaagaaatcacagatttgctctttgggtttttatggcttgcagattgttatagatccaaagaagttcagattagcgttggcatttgactctgaagaacagccaattcgtaggaattcagtaattaaaatattgtcagtgttttaattctatgataaactcattcgtgatactcttaagtatatgcaaataaagctttatatagaaaataccggcctggcacagtggattacacctataatctcagcactttgggtggctgaggcaggcagatcacctgaggtcaggagttcgagatcaggctggccaacatggtgaaaccctgtctctacgaaaaatacaaaaattagctgggcatggtggcaggggcctgtaatcccagctactcgggaggctgagccaggaaaatcgcttgaacccaggaggcagaggttgcagtgatccaagatcgcacaattgtactccagcctgggccacaagagctaaactccatctcagaaattaaaaaaaaaaaaaaaatacttaaaaatcaaaattattaatttgggcattgtttcattagctcttattagtctcttgtgtaacataaattacttgctgtcccatctagttatataaacttgtaaagggaccaaattcctatgtatgaagagttccttacaaaggaagaatgagtccaaattatttttaaatgccaataaaaatgattagcacattcacgggaaaagtagtggactgtgaagctaagggtaagcaattgggagatgggagtttaaatgacagggcattttaatcttttatgaattattaatggattgaagtagacatggtcctgaggtctttttggtgctgtttacaaatcagctgacagtaaaaggaaaagcaaccagttacaagttaaagaaatgtgtagtgctaaatgtgaactgctaattttttttctaagtagtttgctgtatctagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggtaaagtacaaccttgaaatagttgattgctttctttttggttgagaaggagagtttgccaccaggccacttgttagatatgatagaagactatgaggaaagatgtatttaataatcacattgccatgtttggggaatccaactatatattatttatatatatagggtgtgttttattttatatattgattgtcataacaatagtaacaaatcatattttatcatcttgctttcataagttttcacatttaatacttaccagggagtgaagacaacattattttcaaattatagttaaggaaaatgcaactcaatgtgaataattgacttgcctaagattccacacctgattcataggtcttttggttttaagtgcaggacttctctactacactataacatttttcagaaccctcataaaggttaatggttttaaattatttcagattaaggttcagaaaatatagtatacttcagtattgctgtaaaatttctgtggacatttgtttgaatcccatttagtgggatttagtttgtgaatgaaaagatcctcattgttagacacttactctgtgatgatacagtgagagtagtttgctgaatcttttaaagtacctttcacaggactttatgcttagtaagtgctccttcgtgtctgtgatttgagtgctatgttcatagtatgttccaaaacagaataaaacagaatctgatgatgagaagttaaagatttgtatataatatgccttgaattgtaagtgcctgttgttagttgtattacttacaggtcatggttttgtacatataactccaaaccattgatactgttaaaagaatatatgaatatatgaaagaatgtataaacataagaatgtatgggtatatagtgtcctttccaaattaatttttatttttagctctactagattttttttagtgtaacaaatgtttattcctatgtaattaagggcatattttccatacagactattcacattacctaattgaaaattatatactacaaaaatataatactatttttaggccagacatggtggctaatacctataaccccaacattttgagaggccaaggtgagagaattgctggaggccaggagttcaagaccagcctgggcaacatagtgagaccttgtctttattagatagatagataggtaggtaggtaggtaggtaggtaggtagatagtagtaggtaggtaggtaggtaggtaggtaggtagatagatagatagatagatagatagataagataagataagatagataagatagatagattgggcacagtggctcatgcctgtaatcccagcattttgggaggccaaggcaggaggattgcttgagcccaggagtgtgagaccaccctgggcaacatagcaggactccatctctacaaataataaaatattaaccaggtgtgatggtacgcacctgtggtcccagctacctgggaggctgaggtgggaggattgcttgaggatgcagtgaactgtgattgcaccagtgcatttccagcctaggtgacagaatgagaccttgtctataaataaagaaataagtaaaaatataaataagtaaaaagaaatataagtaaatataaatataaataaatataaatataaaaatgaatgaatcaaaacagtttttaaatttgacatcactgaggacatcctagccatttttctagaaaaatatttttattattccttttttctaagatcctaccttcccttacaaagcaatcttttgtgcttttgaagattaagtaatccaatatatataatatacttagcatagtatctggtacttgtaaagtaattaataaatgttggatcttatttttgttctaaattcccactgatgctcttggagacccattttctttttttaaaaaaaaatgaaggtagctttataatattctcagttatttaaaaaattattaaattacttgatatagaaatctaaagaaagttaaaaaaattaaaaattgtttatcctccctctcagaatacttcacttaacgtttggtgaatagtctcccagtcatttatctatgcacatgtacatttgtttctcctatcaaatgatatctaggttgtttccattaatatttttaaaattctgacctggtaccagcagcatgatgggctgagctaatgcaatctcttcccaagacataaggctcatagaaatactaggtgtaaaagaaaatatgtgtacttaaaaaaatttaggccgagtgcggtgactcacgcctgtaatcccagcattttgggaggccgaggtgggtagatcacctgaggtcaggagttcgaggcaagcctggccagcatggcgaaaccccatctctactaaataaataaatatatatatatgaattagccaggtgtggtggtgggcacttgtaatcccagctacttgggaggccaaggcaggagaatcatttgaacccgggaggcagaggttgcagtgagccgagatcgtgccactgcactccagcctggtcaacaagagcaaaactccatctcaaaaaaaaaaaaaaattaaatttatagctgaagctagtttctaagcaaattacctagcatacagtcagtatagacagataaatggaaaatatgaaagaggttaggagatgcagaagataaaatgaggaggttcaaaatatgtctagtaggtgttccctagaaactgagctcagtgagaatgggaagaagtaatatttgaaaggctaatggatgtatgttttctagagttgatgaatgacatgaatcttgaggttgaagaagcacactgagtcttgagcaaactatataaaaattaaaccaggctttaatacatatgggaacataatatatgctaaagctggtattcagaatcgagattaggatggactttcaataaatggttttgataaaactgagtaatgatttggaaaaatattttcataccatttatgataaacttccataaatcaaaaaaaatgagcaaagcaaggcctttttcatccattcaaaatccataaactagaaaagattgataaaatgaattatttaaaaaatcataaacttctgtctgggacaaaaatgtcatgagtaaaaccaatcctatggttaatattcttgcccagtagttctcttagaatagtcctaaaagtgcttttgtggttcaaagagtaataccttgaaatttttggtgcatgttgccaaattaccctttagaatgcctgttgcttttaaaatattttttcattttagtattttattgtttatccaattatagacttttttacatactcagtagacaacataaagcctcataattactctgttatttttcttttaggcatcaggtacatgaaaaagaagaattcaaggctttgaaaacgttaagtattttctaccaagctgggacttccaaagctgggaatcctattttttattatgttgcacggaggtaagaaatactatgttttgggtctcttaacagaattttttaaattatagcaaatatagagagatggcaagtttggtttttcccagttgacttaacaggaattgaagacaagtttacttgggagcatatagcagggtaaatagcctgcgtttcctaaaatgatggtcggtatctagtagctgcttttcatactacccatttcatattgcttactctgtcctacatcattttttaaaatactgcctgcaatggattaattaccaagagttaaaaacccacaaagaatcttttgttttcaagtatattctgattaaatagtactcacaacatgataactgggaactttttttaaaggaagaaataaaactataagagcctatttctgagaacttttaaaaatatgctgtgtaagacagcatcaggatgatttaaaaaataattcaaaggagtggtgaaaaatctctatgaagatggtgcaaggggtggcctggaaaacggtgcttgttcatgctgccctcagttgaggctagttcctagaaagcctttctggaaatgttgtgagctcttccttaataataggtatgatgcttgccttgctttccctaccattgtcttttcttttttgcttcattttaccttccttttgaaaactcaatctgtgacgttatttggtcagttttactttttcccatttaccatgacatacattcatggtaattgagccttagagacaacatgatacatagagaaaccactgactttggaatctcaaggaccatgtttagacctagttctgctactcattagttatagacttaatctttaccagtttcctgaatttaacagtatttaacatccatgaccattaagttagtagacttacattgttagtcagcttgctggccacaggtggcagtgtgtaggaaacaaatcaaggttgagaaatagtagagagacggtgaaggaagatcagtggaagatgggaaacttgtctaatagggtcattcagatagccttaagaccaagaagtccaaaggactggagtattagggaatcaagaaagtaagaaaattgcattgaacctcccgccacccccctgccctttaacaactctaagtaacccctgctcaccttcccatgaaaggcctctctccagctctcatctcagttgccatttctaaattgcctaagatcattttaattttcgtttgcgtttgagatgaaccatatttgtattctaaccccaacctttaatacaaccaggatatttttacttttccgttgttgtctaagtaaaaagcaaacattggtaagggaggtagaagatgtgtttccccctcttctttaaaatcttattagtttacaaatagcaaagatttctggaaaacaaagctgcgttttttttttttcggaatcagaaactgttatatttgtattccctctctgtggtgatctagaaaaagctaaaggaaagattggacctgctgcagatcccttagtgagattcaatcagtttggtttccatgaaacctattgagtcttgtggcctgagaatgctaagaattctcagctctgctgcttattagctgcataatctttttttttttttgaaatggagtttcactcttgtcacccaggctggagtgcaatggagcgatcttggctcactgcaacctccacctcctggcttcaagtgattctcctgtcttagcctcccgagtagctgggattgcagacatgtagaaccatgcgtggctgattttgtatttttagtagagatggggtttcaccatattggccaggctggtcttgaactcctgacctcaggtgatctgcctgcctcggcctcccaaagtgctgggaattacaggtgtgagccactgcacctggccttagctgcataatcttagataagtttatttttccaaatctgttgcttcatatgttaaagctggggtatgtgcttataaaaactgtctacctctcctataaagagttttgtgacctataaagttgtgtaaggagtaaatttgagattttctttttttctttcattctttttttgggggatatggcactgtcagtttcagattttcaatccttttagtttcttacttagacctactggagctcctcctgaccttcattttcacctggtgtgaagcctagctccaagacagatgagtacacagtatatcagagcagagcatccatttactccattatgaaggtcttgtctgtctgtatgccgtcagttttgtcaaagagcacttgggtttgacttctcttttgatattcctgtgtttctgtggcttagactactatgtattaagtaatgctttttgaattgtggattttctaatttccttatcgatggtccacagacgtttcagacttgaaatgtccaaaacttaattcagtatatcttcaaatcaacctcctcttcacaccgtatttctgtttctcagtaccatcatcatcccttctagttccccatctagagaccctaatcattttaaattctttcctcttattgtctttctcattgttagtcaccaaatcttggttttacctgtgagatcctgggcaatcagttaagttgttttagttaggcttttattgcaaagcagtcatttgtattttctcaaggatagtttttaggaaaagcatgaattagcgcagagcctacccagatatagagaactagatggctgtggtgctggaactggctatgctctttgactgtctcttggttttgtgttcaactcttcctcatgattttcatctttctgtatcctttcagcttttgccccagatagtaacccgttcattatctcagtactgcacatctgaaattccagaaagaaaatatgattcagctaaaaagcatctctgcttggcagaaactttaatgttaggttctggccagccagttgattactggctgcccctatgtccagtatgtgctcctggcccagcagtcatgtgattcaaaatgtgaccacttggctgggcgcggtggctcatgcctgtaatcccagcactttgggaggctgaggcgggcagatcatgaggtcaggagatcaagaccgtcctggccaacatgatgaaaccccatctctactaaaacacaaaaaattaggcaggcgtggtggcacgtggctgtagtcccagctactcgggaggctgaggcaggggaattgcttgaacccgggaggtggaggttgcagtgaaccaagattgcaccactgcactccagcctggtgacagagcaagactctgtctaaaaaaaaaaaaaaaaaagtgaccacttggtgctgtttcttcatcaggggctgttcttaggtatgtgttttaattttttttgttttgtttttgagacagggtctcactctgttttctaggctggagtgcagtggcactaccatggctcactgcagcctctagctcccaggctcaaacaatcttcctgcctcatactcccaagtagctgggacaacaggtgtgtgccaccacagctggctaatttattattattattttttttgtagagatgaggttttgctatgttgcgcaggctgggcttgaactcctgggctcaagcaatcctcctgccttggcctcctaaagtgctggaattacagatgtgagccaccacacctggcctaatttttttttttagttggagcttaatggtctaatattactattacgtaccttggcaatgtctttcgaaaccattttcccccactgctttgctggaactctgtgtcttacttatactaatgtagcattattctcctcctccttcatcaccagttgactacttctaggtaatcttaacatttcttctggagccagtttccagtagaaagcttgtctgtcccattgactccctgtataaagtccaagttctgtagtcaaacatgcaaggtaattttggcctaatgtacttttctaatcttttccttctattccatccaatatacttatgctcttgccctgtggtaaggtagcataatacaaggacattgttgcaacattgtttatatagtggcaacaaaaaggaaaacaatagagttgtgtttcaaaaggggaattgttgaataaatgatgatacatttacattagggaataaggcaatgtgttaattttgcttgttacaagtgacagaaatgcaattcaaatttatgtgtgccaaaaaggaatttattgactcatgtacctaagaaaatcaagagatgtattagtttcttgcatgactagctgcagagctttaaacagtatcatctgcagaacatctgtcttctctggctcttaactctactttctttgtgtcggttttattcccaagcagctgctccctagctgtggctggtaatggtttgtgttctcccagcttaacaatcccagaggaaaaacacctctttcccagttttgtggtttcagcaaaagtggttggtcttactggcctggtgtgagtcacatgccattcctaaggcagtcactatggcaagggggatggaatttcttggttatctaggcctggatcatgtgccccttcctggaatgcagtggtaaagccagccctatccaaattgcatgaactaaaaggagggcatgggggcagggttttcacaaaggaaaattgaattgctgttactagaatgaggcaaaatggatactgggcaggcagaagtagcagaagtcctctacatccagctttaaaaaggcccagaaagatgactctgacacttaccttacaaggtacacgacagtgtgtgtgtgcacctgcacatgtgtatgtgtagactgagaaatgtatgaaagtatacatattaactgttcacattgcttatctcagaagtgtgattggaggagatagaggaccaatttaatatttctgttatctatctctatgttgtttggcttgccaggagcatatattgtttttgtaagaataattaaaaatataaaaccccaaagtggccgggcaaggtggctcacacctgtaatcccagcactttgggaggccaaggcggggaaatcacttgggctcaggagtttgagatcagcttgggcagcatggtgaaaccctgtcaccacagaagaatacaaaaatcagccgtacattgtggcatacacctgtagccccagctactcaggaggctgaggtgggaggatcacttgatcctgggaggtcaagactgcattgagccgagatcacaccactgtactccagcctgggcaacagagtgaggccttctctgaaagaatacattaaaacaaaacaaaacaaaaaccccaagttacaaagaagagttttcctcttaggaatattgtgatacctggcaattgctttttgggtggtagtagtaaataatgataatagctaacatttcctaagtgctttctctgcatcaggaaactgtgcatattacataatttctcatttaatctacataataaccttctgagatattattaacaattaattgacgtacgtataaactgaaacccaaacatggctatcagaatgatctggaacattaaaacaaacatatccccagcccccatttccaaaccaaaatctcaggggcagggccttatttatatatttaacaggcactccaagtgtttcatttattactaaagtttgggaatctcactgggtcatgtacttaattcatggtagcacaactagtaagaatcagaattcggtttcaaacctaagccaaagctcttaacaaatgcactattaattacatgcttattactattataattgtatgcttgggtaaatctttgtagatgagcatgaaaacctaaccaacagttatgagatatattactctggggaaaataagttctcgattccaggcatctgatttacaaatggttttttgaaacataagacaagagtgtactcaatataagataatcttgtcattggcgcaatatcattatacattacaaaggttagcagaattggcaccttttcttagcgaaatgacatattactattaacacatttcgtgaaatatgttaatacagatgaatgtgttattttgtagagcgctttagtttatcagattagcattttttgtctgtttaataaaaaataaaatatagaccgggcatggtggctcacacctgtaatctcagcactttgggaagccaaggcgggtagatcccctgaagtcaggagtttgagaccagcgtggccaacatggtgaaacccctctactaaaaatacaaaaaattaatcgagcgtggtggtgggcatctgtaatcccagctactctgggggctgaggcaggagaattgcttgaacccaggaggtggaggttgcagtgagctgaggtcatgccattgcactccagcctgggcaacaggagtgaaactctgtctcaaaaaaataaaaataaaatacaaaaacaacttcccccataccactccttatcccacacccccatcctctatcccctatcccctatccttcatctctctgtcactgttgctcactcgctctctcactctcatgtgtgtgctctctctcacatacaccacacacacacacacaccccacctacataatttcttctcttacacctttaatataaatatctgagttttggttcagttttgcaaacatttaaaaggcaaacatggtattttgcttgtttcagcatttaataaggtagtgcatacttctttcatatggaaggaaaacatcatattaagttaatatttaaacgtacacaattataatttgcaaaaaaaaatcaagatgataatttcttaaatagtaaattgaaataaatgatattttcctagcatgcttgtcattcagcaataataagaaactgagataagaatgcaggcagttgaagttcacttcagcctgagtgcaagtatacacaaaacagcaaaaatattacatagaaaataaatgttgtccattggattgagtatggtgctaccatttgtcacagtgttcatattcatagttgtggctatctttggggtcactgctgtattcagacttgtcttggaatttggagtcatctagggatttgaggtcattttgagatttgggcttgtcccaggattggtgctaccatttgtcacagtattcatattcatagttgtggctctttggggtcactgctctattcagacttgtcttggaatttggagtcatcttgggactcgaggtcattttgagatctgggcttatcccaggattggggttcattctgggattggtgctcttcctgggattaggtctggtcccgggattcaggcttgacgcaggattggatactgccatagaatttgaggttgttgatgttgaagtttgtccccggaatgttaacaaacatgaagagcaggccaatcggtgatagcttgaacatcatcctcctctgtttcacaataattatataattttaattgaacacttggatcacaaataggcaagcatatatccttaattgtgtttatcagtacatttgtgttatgtaaatgtttgctttttcactattagtgaacaaattaaaagcttccctttctttgttgtcaacatctgctgacagaagacctattttctattgagggctaccaactgaaggcaaaaacaatcccaagactgaaaaagagcttaattggcatttttctatttaaaaaaggaaaaaaataaaactctagacattcaatgcaataaatatgggggcttgagatcagtatagagtagggtaggggcaaagactgagaggcaatttgggacagtagagcaacaaaagaaataatgaaataaatattggtattttcttgatttctcatgacctttattccaacaatttaaggttttagtttaggtcacaaattaggatattacttctaaatatttacccaaagactaaagaggttaaaccaaagcatttccccagtgctgggatgaggttttcttcattaacaacaacaacaacaacaataacaaactagagaagttcatagttttaagatttagaaatgaacaaaaccaactccttcattttgcaaatgggctcagacaaggggcataacttacctgagggtgcatatctaaaaatgacccaagctagaacttaagtctgtgacttaaagcccaaattttaactgtagaactctaacatatatattaaaagttacatttggctctaatacgtaattgagaacatttcaaattaatgttaccttttgatatttttctttgaagagtaagaattcagtctttctccagcgtctatggggaatctgatttctcactcactgcatgctatttaaatataattagtgaggaagtcatgtgttctaaacttgacctgccatttgctctttggaagtatccaactgagtgtttccagacaactacatataaacagatagactttggcagagattaaagaattcaaataaagttctaaaatctgcttgctaatttaaagaatccagtgaatagcatttgttattcctcttaccatgtatacattaatgaattgcttcactggattgactctaactagatgaatttactattttgcctgctgtgattattatgattttaaaccaagtaagtgtattaaaggtgtctgcgttttccttagaacatctgtacatatgtttatagggcagtttctacccatggttattttgaagtttaaaaaataattcagtaatacaacatttcaggtatttaatttttggtaaataaagtaaccttagaaaagaagttaaacttcattaatatgaaacttaagaaaaggattacatatgaaagtgatactttttcatactgagtttacaaacttttgtgtgtttgtgtatggttttttaatgtattaaaccagtcaccttgaagtgcataaagtaaattttttgaaggaattttgtcttttggtcagccgttttccatgataactagcatatagggaaattgggttgtattctgctaatgttttcatcatattggccagcacactttaaaaattgcaggactgtgaacaatggtgttgacatacaaggaaattgcaacataaatggcagaagtacaagccagtacatgttcctcacttgttttactgtgctgtgaagatcatttttcccctgaatgaataaaccatgaatagaaccatgcttggtaaatcttatttatatggtacatataataacttcacttaactggaggttaatgtggtcagatctaagaagtaaacaaacaaaaaaaaactacttggcaaccagagtagatattatgaatcggagtactgcagtaatttacaggagtttgtcattgtcctctctctgctcacttgctcattctgtggatttctttggggggtatatagttggtaatagtaatagtaatagtaatagtaatgtttcgaacttgagcaaactgtgacttattctatttttctaatcttgaccttttgagtactacacttacacaactctttattgatgcttcaaacacctcagtctcaacttgtttaaaattcagaagttagtgttttctccttcctatttttgtatctagatatattcttctcataatctcttggttaattgtatcatcacctagccaaatgtttctccaacactggatttctcattatcttctctttcttatttatcttaagctctccaggcctcttcatgatgattaagtaaaatttaaattctatttagtactcaaatgttcccaaacaaacaatagtcaatttgccattattcaggtcttcaaatacccaccaactttgtatctttgtgcagcctccccaacttgcccaaagtgtaataatagccccctcttatcctaagtttcactttccatagtttcagttacccatggtccaccatggtctgaaaatactcaatggaaaattccagaaataaacataagttggatgtatcatgaggttaatagtagcctagcactgtgtcacagtgctgcattagtcaacccacttcatcttatcacataggcattgtgtcatatcacatcatcacaagaagggcgagtatagtacaataagatattttgagagagatgccatgtgcatgtgcttttattgtagtatattgctataacttctattttattattgtttttaatctcttactgtgcctaatttataattaaactttatcacaggtatttctgtataggagaaaaacacagcatatattgggttcaatactgtgattctgtggtttcaggtatccctgaggggtcttggaacatatcccccacagttaagggggtactactgtactttcctcattcaaaattgtgttgtttcttcaagctccactcatgtcagcaccttttatacgatccttccctaattcttcacgtcagaatcagtcattttagtactttatactttgatcagagtctcattttcactaaagaaactaaatcttccaccatattctggctttttttgtggtaagataccacctcttattccttctattccctctagcttctaatatagtgagtgtttataaagaataggacacagggccagttataaagaataggacacaggctcatgcctgtaatcccagcactttgggaggccgaggtgggcagatcacgaggtcaggagatggagaccatcctggctaacacggtgaaaccccatctctactaaaaatacaaaaaattagccaggcttggtggtatgcgcctgtagtcccagctacttgggaggctgaggcaggagcatcgcttgaatccaggaggtggaggttgcagtgagctgagatcgcatcactgcactccagcctgggggacagagcaagactccatctcaaaaaaaaaaaaaaaaaaaaaggggcacaataagtattggaattcattgaaatacctcctgtttctccatgtcggagggctggtatcattaatgatgtctaaagtaagagttatttggttatttgcagttttcccttcacattagcataaatttggaaggcacaggcttgagtttaactttcatctctactttcctggctgctgttttgagaagatttcttcatttgtacaatgtggatcataatgcacattcataatcccttgtctgtaatctgaaaccccaaatcctccaaaaaccttaagttttatcaaaaaataaaaaagtttgacaccaaaatttatttggtgcaaatgccttatctgcatagatgggaggtttttagctatctttgtttcacttaatgtggatattaatgttgcgctgcagaaatattgatgagattgattttggggtgctgttccattttctactggagtgttacataatacatgataagaatagtacttagcatattcatgtttctcttcttccttctgggcacagcaccataccactcttagcattctgatagttaggtggtaccatctgactgagttctggccagtaaaatgtcagttccaatgatgtacaatcgacccttgaacaacactggggttaggggcactgaatctccacgcaatggaaaatctacgtataacttttgcctccccaaaaactaaactactaatagactgttgatcggaagccttttgataacataaacagattaacatgttttgtaagttaaatgttgtatatgctatattcttagagtgaaataagctccagaaaagaaattgttacccagaaaatcatgaggaagagaaaatatatttactgttctctgagtggaagtggattatcacgaaggtcttcatcctctttatcttcatgttgagtaggtggaggagaaagaagagggattggtcttactgtccccgggctggcagaggtggaagtaaacctctgtataagtggatcagcatggttcaaagccatgttgtttaagggtcaactgtatatgatttttaagcctgatgtctaacttctcaccaatcttccattcttgctttcttctatcaacgcctactagaaacagacggttcagtggagggggtctccaagacgccagaagatggtaaaaccattagaaagcatgatttaagagaaattaacttttgttgtcttagccagtgatattttgggattatttgtgacagaaattagttcgtgctgactaacataactacatgctggacatcttgcctttgcctcttcaaatccactctgttctttaccctgctgtgtaccctaagaggctgacctgtgtagagggtatcattgggctcccctcctttctggctttcagctggcccatagggaatacaagcggaagattagggagaagaaagagagtaaggttaggaggtatatatttttggctccgtttctgcagggtcccagtgggctggctacatccatccatgcagtatggtttttgttgggtgaccctctccacacaacctactctgtgtctgctttctgctaactgcttcctgcactcactacttcaggtgtagtatcacactgtttcttaagagtttccttaaaacctgccttctcctttatacataatctctaatatctcagtttgaatttgccacctgtttcctgctagaaccttaattgctacaagctgtatgtacactgtatcatcttcctaaaatcaccaggcatggtgggatgtgagctatagtcccagcaactcaggaggctgatgtaggaggattgcttgagcccagaaattcaaggctacagtgagctatggataccctaacctgagcaacagagcaagaccttgtctctaaaaaacaaaaattaagttaaaaaattgtgtctttctttatatacttacattactttccgttgatctgtttttgaaatgtttccagaactgtcttccctcacgtattgattcttccaaaattcttaagaaaatggaaaaaagtaatttctgaaaatgatgagaatgatcataaatttcatatagcactttcttgagaatttcaaattgcagttttaatattttactttagaaacaggtccagttttcccttctgtaatttttttctttggtctttttggattttttgggtttttgttttttttttttcttgaaaagaacacagagatcttttcttgagtgatatttgcacagacattgccttggtaattgaagcttttttttttttttttttttttttttttagaaaatcctattaagttttatgccatgtctatgctcattgcacctgtgcctcatgtctcattcattcattcgtttattttattattattttttttttttgagacagagtttcgctcttgttgcctaggctggagtgcagtggcacgatctcagctcactgcaacctacacctcccagattcaagtgattctcctgcctcagcctcctgagtagctgggattacaggtgcctgccaccacgcctggctaattttcgtatttttagtagagatggggtttcaccacattggccaggctggtctggaactcctgacctcaggtgatctgcccacctcagcctcccaaagtgctggaattacaggcgtgagccgccgcgcctggccttcatgtctcttttaaataggacttctaaaattttgaaatgaggtcagcttcagtggctcatgcctataatcccagtgctttggaaggccaaggcaagaggatcacttgaagccaggggtttgagaccagcctgggcaacatcatgagaccctgtctctacaaagtacatttaaaaaaaaattagccaggtgtggtggcacacacctgtatagtcttagccacttgggaagctgaggcaagtagatcgcctgaccccaggagttcaaggttgcagtgagctatgttcccaccaccgcacttcagccagttaaggggacagagcgagaccctgtctcaaaaaaattttgttttgaaatgaatttatgtatgtttggttatttctgaaagcagttcaggcctacagccataccaccctgaatgcacctgatgttgtctgaaagcaattcaggttttcaggattaaaatttttatgctactaggtttgtaacctatatttaaaagtagaacatttaaaacattttagtagtatatagcactgaaaagtggctttttagcgtagacagttgtttttcaagaaactattttgtaatcctagctacttgggagcctgaggtgggaggatcgcttgagctcagaatccagtctgggcaacaaaggagaattccagcctctttaaaaaaaaaaaaaaaaggaagaaactatttgggagttttgtgaacaatggatatgcaaaaagacaggccattgttatgagaggcctaattgtgagtaccttctagaattgtatataagcatgattctcttcaatagtaaaatctcagcctcttcattttagaaatctaatataggaaaaagaacacatttctccatagttgtaaaacataggttctcagggtgaatgcccatctttgagcaagtttgtcttcctaatggtataatactgtaagtctgttatctaattttggcttgttgtcacttatttttcataatcaaagaaaaatgatttaattttaaaaagatgctctcctttctgttttcttctcttggatgatagtatccctatctgtctgagtttatagaatcttaatttttacctgctcttaccacatacatctgattagtcattaagtcttactgattctgcttcagaaattttgttttatgcttcactctcatgctaccaacttatttggtagcttcagcagttgtctaagctggggttggcaaattttttctgtaaaggaccaaatagtaaacattttaggctttatagcccatataaagtttttttttaattttttttttttttaaaaaagaaagaaatgtaagaacccacacctgtaattgcagcactttgggaagccgaggcagggtggatcacgaggtcaggagttcaagatcagcctggccaacatggtgaaaacccgtctctactaaagataaattagctgggcgtggtggtgtgtgggtatgtgcctgtaatcccagctactcaggaggctggggcaggagaatcgcttgaacccgggaggcagaggttgcagtgaaccgggatcgcgccactgcactccagcctgagcgacagagtgagactctgtctcaaaaaaaaaaaaaaaaaaaaaaaagtaagaatcatacttagcctggaggccatacaaaaataggtcacaagcaggctgtgggaaggatattgtaagtgggccatactttgctgacctctggtctaggctattacaacaatttcctaattggagtatttgtcaccggtattttaccccggtgtaagattgcctccatcttacacattactgccagaatcatctctctgaaatgtgaccatttcacttccaggtaaaatctttatgtgctccttttagctaagttttcttgcttaaggtattcatgtattacttcggggattttttttttttttgccatttcttcataaccatctatattatttattcagtatttttatagacttttttttcttaaaggaaagtttatactgtgaatggaaaatcaatattgattgccataactagaaaaccaacaaaaggcaacagtaaaaggaaatatagaactatgaaatgcctgtttcatgtagcacccaatcatatatgtactacatttcaaaaagtcactggcttataaaaatattttttagcatctcatacaagtctcttcataatctgttatacagctcaccttacttgcacgattgctgagccaaagcagatcgaaagtcattttggtaagaggctagatgctgaccttgtattctgaaaatctgatgattctactgttgttgatgtgattccaagtaagcctgtgtgaacttctgggctattctcagggaagtgtttatgacacattgttgaaggtatcatcagggcagttgatccaagaagactctaggagctggctaagccacaaagtctgcccaaaaagctcagaatgacaaatgaatgttttgtacattatctccactataatgctagaaaaaagtcttaaaagcatttgtctcaattgatcatttatatggaataatactggttaatcatcttaaatcatcatagtgttgggtaatgtctgtagaaggatgctttaaactctacttggtgcttcagctatgctgaccatctcaccattgccccctttgccatgccctgacatcctcacatgtctctctgcttttgcatactcttttccacctggtttgaatgcccttcctttatcatgggacattatcctttccatttaatacccatcttgataacctgactctgaccccctaggcaagtttaaaaaaaaaaaattcattgaaatgaaattcaccctttttgaagtgtacaattgcctgggcacagtggctcacacctataatccctgcactttgggagactgaggttgggagagtcacttgagtccaggagttcgagaccagcctgggcaacatagtgataccctgcctctacaaaaaaaattgcaaaaattagctggatgtggtggttgatgcctgtagtcccaactactcaggaggctgaggtgggagaatcacttgagcccgggaggttgatgctgcagcaagctgagatcaagccactgcactccagcctggacaatggagagagaccctgtctggaaaaaaaaaaaaaaatcttttttttaagtatacaattttgggccgggcgtggtggttcacgcctgtaatcccagcactttgggaggccgaggcaggtgaatcccgaggtcaggagatcaagaccatcctggctaacacggtgaaaccccgtctctactaaaaatacaaaaaatcagctgggcgcggtggcaggcacctgtagtcccagctacttgggaggctgaggcaggagaatggcttgaacctgggaggcggagcttgcagtgagctgagatagcgccacagcactcaagcccgggtgacagagcgagattccatctcaaaaaaaaaaaaaaaaaagtatacaattttgcatattcagagttgtgtactcattaccactgtctaattttaaacattttcatcactccaaaaagaaacctcatagccatcaacagtcactctcccctttcctcctgccccccctcagcccctggcaaccactgatctactttctgtctctatggatttgcacagtttagatgtttcatataagtggaatcatacaatatgtgctcttttgtgactgccttcttttactttaatattttcaagattcatccatgttgtagcatgtatcagaactttatccctttttatagctgaataatattctattgtattcatacaatatataagcgtttgtgtggacgtatgcattcagtttttttagatacatatctaggagtggaattgagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaattttgataaatccctccttttctaaaccatagccaagtctattactgtttaacaatgaccatcttggagtataaattttctgttcacactttgaactttaacttccgggtcttagatgtctttatctggatatacagagaatctaggttttgtatgtaattattcaatgatagtattaaaactaagtccggacgcagtggatcacgcctgtaatcccagcactttgggaggccgaggcgggcggatcacgaggtcaggagatcgagaccatcctggctaacacagtgaaatcccgtctctactaaaaatacaaaaacttagctggtcgtggtggcgggcacctgtagtcccagctactcgggaggctgaggcaggagaatggcgtgaacctgggaggcggagcttgcagtgagctgagatggcgccactgcactccagcctgggcgacagagtgagactccatctcaaaaaaacaaaaaaaaaaaaacactaattaccagtttttttgtttttgtttttttgggacagggtctcactctgtcgcccaggctgaagtgcagtgacgcagtcacagctcactacagcctcagcctccctgggctcaagtgatccttccagctcagcctcctgagtagctggaactacaggtgtgcaccaccatgccagactaatttttgtatttttttgtagaaacaccatgtctagctgatttttgtattttttgtagagacagggtttgtcatgttgcccaggctgatctcaagctcctggactcaaatgatccaccttggcgtcccaaagtgttaggattacaggcatgagccaccttattaggcctaattaccagttttaattatagacctacatgactacggtttgaaggaaaaagactttatttaatcctagtgattggaattggaattctcatttgagccagaagatttcttgagtggttttgttttctgtgataacttggtttatataagtaatccacattacttgggtgttagtggtaaagcaagtctttgccttgtacaacaaagataatttagtgattgatacattctgaataatctggtggttatgacttgacacatacaaaaaatgttagtggttgcagtccatctgttgctctgtaaaaagatttttgttattgtttgtttgttttgagaccaagtctcactcttattgcctaggctggaatgcagtggcatgatctctgctcactgcaaactctgcctcctggattcaagcaattctcctgcctcagcctcctgagtagctgggattacaggcatgcaccatcatacctggctaatttttgttttgttttgttttttctttttttttgagataaagtctcactatgtcacccagcctggagtgcaatggtgagatctcagctcactgcaacctccgccccccaggttcaagagcttctcttgccctcagtctcccgagtagctgagattaaacagtcatgtgctaccatgcccagctaagttttgtatttttagtagagatggggtttcaccattttggccaggctggtcttgagctcctgacctgaagtgatccgcctgcctcggcctcccaaaatgctgggattacaggcatgagccaccgtgcctggcctaatttttgtatattttatagagacggggtttcgctatgttggccaggctggtctcatagaactcctgacctcaggtgatccacccacctcggcatcccaaagtgctaggattacgggcataagccactgtgcccggccaaaagtttttttgaatcacctatggttcatttatttcaagtttaagtgtataatcctcaaaggaaataatccattgggatgtatttatgaagtttaagtctgtaaaacaatgtggaggccgggcgtggtggctcacgcctgtaatcccatcacattaggaggccgaggtgggcagatcacttgaggtcaggagttcgtgaccagcctgccaacatggcaaaaccccatctcttctaaaaatacaaaaattagccgggcatgctttgcgcgcctgtaattccagctactcaggaggctgaggcaggagaatcgcttgagcccgggaggcagaggttgcagtgagccaagataatgccactgcactccagcctgggtgacagcatgagactccatcttaataaataaatagccaagtgtggtggcacatggctatagtcccagctacttgggagggtgagacaggagaattgcttgaacccggcaggcagaggttgcagtaaaccgaaatcgcaccactgcactccaacctgggcaagacagagtgagattctgtttaaaaaaaaaaaaaaaaaaaggaaaaattctgaaacaaccatgtaagaataaatgcatccaaatgaacgttgttcatctcagaagagtcacctttggaggtgatgcacttagttccaactttgctgcctttgagcacaacattttagggaaataattttttggaagtgttgtcaaagtctgaaatacattcttgtagaatgtggaaaatctcatacttgaaattttttgataagcaagacaaaatgtcacgtttagtaatactgttttttgtttaagatgaggtttttctgctggacatgggggctcacacttgtagtcccagcactttgggaggccaaggcaggtagattgcttgagcccaggagctcgagacaaacctaggcaacatgatgaaaccccatcacctgtacaaaaaattagtagagtgtggtgatgagagcctgtagtttcagctgcttgtgaggctgagatcggagaatcactttagcctaggaggtcaaggctgcactccagcctgggtgacagtgagaccctgtcttaaaaaaagttttcttatgtaacttacaaactagctcttagtggtatttgaaaggaacagccccagagttgttttcagtaacgatggtatcattggagtaaaagtatagcgatccaacctgactactttgaagaaataatacagaaaatgaggtgtatcatgtgtgacatttatgtttaaatttaaaatcagtttatagtcaactcatagttaatatacgaatattttttactaacttcaagtgattccttgatcctttaaataattttaatatgcttttttgttgttttttgttttgagatggagtcttgctctgttgcccaggctggagtgcattggggcaatcttggctccctgcaacctccacctactgggttcaagtgattctcctgcctcagcctcccgagtagctgggattacaggtgtgcaccaacacacccggctaatttttgtatttttagtagagacagggttttgctctgttggccaggctggtctccaagtcctgacctcaggtaatctgcctgtcttggctcccaaagtgcttacaggcgtgagccaccacacccagcctattttaatatgttttaaagagactttagcttttacaaggtgtctctaagctcatacttaatgacctgcagctttttttgtagaatttaaagtcaaggcaagagactcataatactttatccaagtatattttgttaaagcaaaaaaaatgtcatgtgatcttgtggaaaagccataccatgaggaaattttagctcctataaataggtgaaactatttttaaacaattgtttgctttcttagattatttgtcattggtataaggaatacagatgagtatttaatgtctaaataatataactcataaatggatgtggttgtatgccagttactcttacactacataatatctcaaatgtgataatggttgctgaggctttggatggcaaattagggctttcccagtggttattgtggtgtatggcatccttgtcttcccttacttatgttttgtttttcttctttctcaatggaaagccattaagtcttagttaattttctgttgaggcaagcatttgacattcattcgaattccctcagccttccagaagcattcagtatgtttcaactgtgactatgagcaacaaaataatacaaagtgaaaaactgcgtttcctggtgtgagtatttcattagatttattgatccttggccttatggtatccatgtgaaatgttcagacatctaattttttactgctaaataatttttttaggggataaataacaaaccttgtaaattatttgaagcataactgaagatgtcagatatatgagaaattatttactattactgtttcagtcattttcacttctaatcttgttaactacccaagaatctcttgtacaaaggatagtaatcattaaaatggttatatagcacccacaaagtgctttaatatacatgttttaatctattccttaaaacaccttctggagtatatgttcttaaccatattttttatcagaggacacatttaatcacttgcccaaggtaaaaacacacaccgtaggtgataaactttatgtcatgctctgctgttaaaccaccaatatagttagaattattttgatcagacaagagcgaagcagttttcctgtttttagtgagtgcgtatgtatgtttaatttctgtgctttgatctcattcataactgtgtgtgtgtgtgtgtgtgtgtgtgtgtgtgtgtgtgacacagggtgtggctttgtcacccaggctagagtgcagtggcatgatctcagctcactgcaacatccgcctcctgggctcaagccatcctcccacctcagcctcccaagtagctgggactacaggcacacgccaccacacttggctaatttttgtatttttttgtagagacagggtttgccgggctcagagctcaagcagtctgcccacctcggcttcccagtgtgctgggattacaggcatgagccactgctcctgggctcattaataacatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctacacattgtgcacatgtaccctaaaacttaaagtataataataataattaaaaaataataaaaataaaacatagttttaaaaatacaaaaaaaataaaaaataaaataactttccagaaatttagattcagaatctcaggtcaggctttctagataaggataagtgggtatgttgagcatgtgtctcacctggctcttaaatatgtttaacaaagttggggctgttgaaccaaactgacatttcttaacagttgatcttcttaaagacctcactttgcaccacagttttctaaatgtgaaacatactaatctgcttaacacattattaacaccttaacatgacatttgtttctacttctcttctaacttcccttgagcaattttctatattgaattgttcatgggtatcagaattaacctttctctagaattgttccaaaggtaactccacattgcccagaactagttttttttgcttttttttttttttggagtgggagacagagtcttgctcttgtcacccaggctggagtgcagtggcatgatctcggcttactgcaacctccgcctcccgggttcaagcgatcctcctgcctcagtctcctgagtagctaggataataggtgcctgcccagctaatttttatatttttagtagcgatagggtttcaccattttggccaggctggtcttgaactcctgacctcaagtgatccacccaccttggcctcccaaattattgaggttacaggtgtgagccatggtgcctggcccagaactagtttcttatatgactagtagtagcctagccaaatcctccctcattcttaacttttctttgatctttcttttctcaggactttgaagctgtaactttgaaataaatgaaagaaacttagactctagaataagactcgcaggtttgacttggtctgtcctaagtaggtcattgttagccaactagtcacatctttgatctatgttaattcattcttttatttataaattcagataaaggtggtcaaaaaaacaaacttctaggggcaagtgaatgtctcagctgaaatcaaaaggatgagtagggtttgagagggcaagaagagggagagaggacatgcagcatctctgaaagcctggtggcacgaagcatggtgactaagggacagaggatattttgtttgtttgaactataaaatgttagagagctggaaaattttaagatgatactctaaagggaagcaaggccctgatcatgcagtaaaccatattaagagtttagattttattatgagatatgagaaattattgaaagggaagggttggtacacagttcatcttgtgtcttcttatttctcttgttttcttactcagtctagatgccctagacaaacatttcagtagttcttttcttagatctcttggctatttcaaggacaaggcaggtaataaaatatgcttggtctacagtgttagttagcattttggcatttttctttttgttactttttaatacatggttctatgtcctataattttttcttatttttctaatatttgcgttttccacatttcacactttaaaaaactcttcataaatatttttattggccagatattctggtcagtgggtcattgtttacttaatttcctaatggtggatatttattgttgtttcagtttttcttgttagaaagaatgctgtgatttacctataggcaaaagtttaaatgccttaactgtagacaaaagttaaaatatcttacttttttaaaaatttcattgccaaattgctttcccaaagaattgtgccaatatgtgaacatggccatttcattctaccttccccatcgttggttttttttttaattgcttgctattttaatagtgaaaaatgatgtcacatttttattgcatttctcaattacgtggttggccatattcccatatattaatcatagtattttgtatcttgtaaacattctttttatgtcctttgcccatttattcattgagaattttaagatttttttctcatccgttttatgagctcctgattaacaacctcctttatagcatcttatttgaatatttttatcaggctggttgtttcagcataatggggattttgtatagaccaatctattgataatttctttgtgattgtttttttttctaattaaatagccttccacctgaagacttacaaatatttttaaattcttctgctggttttatgacttccttgttcatgttttctttcactttgtcagtgtatcacatgaagtgagtgttaaactgaacttttttccaatttcctcatctcatttattgagtcttttcctttcccctttggtttctgatttttctttccacagctaacaatgtttgagaatttactgtgtgctaggcactgttctaaacactttatctgtattatctcattttcttctcacaacaaccctgtaaggaaatagaggcacagaaacctaatttgctgaagtgacacagctagtaagtaaagctttgtcacatattcagttcttctgtgtacctgtgctctcattgtgctgttgtttctatattgtggttatctttctgtttttatgccactatcattctgtaattattatggctgatacatgtttctctctcaagaaaagctaatatcggccgggcacggtggctcacgcctgtaatcccagcactttgggaggccgaggcaagcagatcacctgaggtcaggagttcaagaccagcctggccaacatggtgaaacctgatctctactaaaaatacaaaaattagctgggcatggtggcacatacctgtagtcttaactactcaggaggctgaagcagaagaatcgcttgaacccaggaggtggaggatgcagtgagccaagatcgcaccactgcattctagcctgagtgacagagcaagactctgtatgaaataaataaataaataaataaataaataaataaataagttaatgtaactgtagtatttacttctttttctattcttgcttgtttctaagtgaacttaaggttccaaaacatttctcattggaatatttttcagaattgccttaatctgtaaactatactggaaataattgcaacgtaatagtatcccaccaaagtcctctgtaccttagtgtttgatatgttccaggtgctgactaaatatttgttgagtgaaagaatgaatgaatgaatggagagaccttagtttgtcatctgcatcaagtcttaatttatacttctcattaatatttttcagattttccccatttgatgctgcatatttcatgttaatgttacttcttgacattgtatatttttcccataattttctaattatttgttgccaatatctgttatttctgtttttttgttttggaatttcccaaatattgttaaaaaagattggcaatagtgggcatccttgtttcgattgtgattttaatagaaatatgttattcttcaccagcaagatgttgggtggtagtgtgtaatacattcttttatctagttcttaaaatatattttataaggaaaaattttatgaaagattttaggttaactcttgactgacatttttggtattaaaggaatttgctgttgtttgatagcatcattatggaagatattgaatagcacatatttgtgatcttttaagttagctatagaagccatcttctcattctgctgtggtaagtgaatgtctttctgactttcttctgggtccctatttcactgatatctaaacctgatttctagcagggaagagactaaagcaagcacatcctttcattcccttgctctcagtgtgtagagctgaaatgtttccatatatgggaatttctcatagcattgggtttggacatacagatgtgataataatcctcacaacaacaacattactgcatctaggaatgtgggtgggccaagacactgtgaagggtttatgtgaattatgtcatttaatcttcagaaaaaaaccactgtaagttctgccagcccattttatagatgaggaaactgtgacttagagcagtgaaataacttgtctatggtcatacagctgagaagtggcagaggcaagttgcttgtaaagtagagccaagccttagagatggatgggtgaagatagatatagatgtatgtgtatataggtatgtgtatatctgtacacatatgcatacatatttgatgtgcttgagagatagatgctaaggactaatgcattttgaaatttttctggagccaggaatatagtaatacttagtggcaaataatgagcctttttccattaataataagaatataatttctttggaaggaaatactatctaattatagtttccctcagtatatctgggggattggttagcagacccctgtgtataccaaaatttgcgcatattcaaatcccaaaatcggccctgtggaacgtgcttccttgtggaacctatttatacagtatgtgggtttcacatcccacaaatactgtgctttcaatctatgtataagtgtgcccatgccattcaaacccatgttgttcaagggtcaactttactttaaggctagataattcttctgtctaagaacttagagtctgagtagttgacgtatattgtacttgtaagtttaccaagtttgactctgcattttgcagacatgtctgtaggattgacataatccataggtgctcctaatgcagtagtctataatttgactttcttattacttttccccttaaaaattctaagacagcattgagtttttggtatcctcagaggaaaagacagttacctctaagatacctactttcagggcaggcgtggtggctcatgcctgtaatcctagcactttgggaggccaaagcaggcgaatcacctgaggtcaggagtttgagaccagcctggccaacatgatgaagccccgtctctactgaaaatacaaaaattagtcgagcgtggtggcaggcgcctgtaatcccagctacttgggaggctgaggtgagagaattgcttgaacctgggagggggagattgcagtcagccgagatcacgccattgcactccagcctgggggataagagcgagacttcgtctcaaaaaaaaaaaaaaaaaaaaaaaaaaaaaaaaaaaaaaagaaacctactttctgtgaaagtcggtgtatatgtttttttaaataagacacaagtatgtggtagagtagggattatctaagcaattagtccctatcatggatggtgaaggtactaatcagtgtttgggagggagtggagatagcttccgtatatagagaggtaatgcattttaaaatcatttaggggactttttcaaataatcctgtttcttcatggtgagattccctgacacagtgagccaatcaggtttgctaaggcagaaaatgttcgagagccactgtactagacagcatgaaagatgactgttttgttgaagcttaatggtaatttttccataatcctggtccttaaaaagcaaaaaaaagaacacattagagtgttgttacttttctctctctcaatagaaatgttcctaaaccagcaaaggaggctatctgaatttttaaaagtttttacgaaggaacataaaaattcctttctctatcttttcccacctctagaaatgcttgaaatgagattctgccttacgtctcacaaattaaataccacatttgtgtctcacccatctcagttatgctgtcttgcattttaatcaatcctgtttcaggacttcttttgctgccttgtggctgtttcttatgtttgtcactaattcataagttggctaacttttatatttgtagagaatttctcagtgattttcttctagttggagttccagtgtggtttgatttggagtgtcaagatctctgtcccatgcctagccttagtcctcagtctgttttactgggttcaccacctggttgtagtaccaaatgcccttttccctttccctctctccttcctcacttcctcagtactgcccaagttcgtcagacccaatgattttattcttaagctaatcttatttttaatttaggtaattctgatttctgatttgtaaaagataaattttcttctccttcatgtagtaggattttaattttgtaaatatttaaattctccattaatggtgtgttaaatctgcactaaaactgcttctttacatgtttttaaattttttcattatgtttttaacacttttcttacatgcaaaaaacacaaccgttaaacttttcttattaaaatgcaaagcctagtgtcttctagctttttgaagagcttttgtccattatataatctgtcaagtagccaagagttcctcagaagcaggacatcatttagatttaaaacaattatggcttgtctgtaaaataatgttgtagcataaccattcatgggatggcagctacgattttacttcagtaaaatatccttggatactaccgccattttatttaccttaaagattttaccaaggtaccctagaacaaaaatggtgaggtcattttgattctgctaaagttggtatgactggaaagccaaatgacacagttatgagcatagaccttttattttccagatgtttgacagtgtaaacatacataaaatacatattaaagtttagatgctttatattttgtgcaataaattgaagccttaaaacatttcattttttttataaaagaaactcattagtttacttaattaagacagtaaaatagcagcaagtaccaagacattgtgcatttcttttatttaagacaagttacttcatttacatcagagttagaaatgttaagactggctttcttgaatacttaaatatagctcgaatcactggttagatatggacatattttcccaactgtacatcagggaggagtgctttcattagtttcagaaaatgcagaccctcagacagccagcatgaccacaacattgagcaataagagaaatgaagcatttactttccaagcatttgccacagaaggtaatggagtctttacatttgtggttgtctcttccctccataagttaagggttgtgctttgttgaggcatttcagagaaattatttggcatgccactagtgatacttagggtcatgggtgttggggatgattttgttgagctagtgaggcttgtgtttgtgaccattccatcttggagatgaatagttagagttgcagctgctgcttcatgtgaattgatagtctctgtggatgtatcttctggatagggcacaaaagccttatcagtgctagtaaaggtggtgtctttgcttagagtggcaccaaacgttgtttcctttgttcgatattgtttgggtattttggtcactttgggttgagttaccacactcagagagttaatggtgtccactgtctgcatcccacttacagtgaataagcttgaggtaaatccagaaggtgtgggatacatgttatgttcctttaaagatgatatttgggtagaacatggagtccctatcacatgggcttttgtttccatcatccacttcagtaagtaagtaatgttttgtttgtggtcacatgaccacctgttattgtaaagggttatctcttgcaactgaaagagttggtcaaaagattggtctggaatgaatgtgaacttattgttgtgcaggtaaagatgtgtgagatttgtcaggtttattaatgtacctggaagaatttgtgtcaaagaattattagacaggtccacgatatgtagtttggagggcatgttggttggaactgtccaaagtttgttactactgaggttgagaacctcgagacttcttagtgtatttttaatgaggacaaccttttccagcatgttcttagaaacatccagatatttaagattccactgataagcagtatcagatttgtcaagaagtttaatgttgttgttagcagcagacatgttccacagagaccgaggtaagtgagcaggcaggctttcaagcctgttgtttgaaatgtccagggtcctcagattggtatattgggttaactggttatgcagatcagtaaagtggttataagacaggtttaaatgtataatattctcttgcagtccagatggtaatgtagacaagtttctgcctgaacagtccacatgcctgtgcctctctgtgcatatacattggagaggacaaatgcataaaataccaggtgtgagaaacagaaggatgaacaggcagagagacattttcaatatctgatattccatcaaagcctagaaacaaacagatacacccttcttttaatatgcaaatacagtttaggcatctgcatgggtcagttagcattaggcaaaattttcaataaacctcgttgttgtcgagtccttttataattgttccagtgattaaactaacaaagctccccttcatttatagtccaaatgcttaatccttcaattgggctatgtggtagagagagactctctccctactctctcctgcattttctcctttattttctctctccctccccccttttctaaccatattctttcttatttatctttctagagccttaatatgataaaatagcattctttgcaaataaatagttgcagttgtaggctattactatttttgatgatatgctttcttactcagatgagaaaaaatggctgtcgtgtcttttttttttaatctctgcagtaatgtaattcaatgtgtgtatatagggtagattttatttagatattaaagcagttcttcgaaattttatctgtatgtttttaggataaatatatctttgtaaaaagcacttgaaaaatccagaccaacacagtacctataaacctcacattttataaagtgatttttttctgtatatttcagtgcccattttaaaggaaaacaatatgtatatttacagagtgactgaatgtataaaaaatatccctcaactgacactgcagcaaatttctggtgcatgcacttgctattgaatatatatttaatcctaacgttgactttttcttaaaagaaaaaggaaaaagattccaaagtcagccttttactgatttaaataacatcttaccgtggtgtcgtcttcaacatcagcatctcattttctctgggaaacttaaaggtcgtcttgttctgtagagtcggaactgtttctggctgtgggctgtgcttgcctgctcagctgcattgtgttgctgtgagctgaagctctgcaaccacctgatcagtaccacataggaggactgcagagctgtcgctggtgctgactcaaatttatggcaagaggtgcacacgcaacaaaatggacaattttttaaaaaatttgtggcatcaagcgtacctatatatctgatttgctataggatgggataccttatgcatgagagttggcccttactcctttctatgtatttgtctgagattgggttccatattttaacatttgcctcattaagaatctgtgaatttttaaaatacctctactctttatcctttttacatgttgaaaataaatttgaccttcctcatggatagttttctatgatattagtcccactattttttaactcctgcctttttatattcctttctaaaattgtataattttcatgtcacttttttaatattataaaaaatctgttttatgacttttatgtcttcccccaacatggtgattattatgtttaatcagcttttcaaatttatcaaccacttaagtgttccgtcttcccttttaggatgtatagaagtactgaaatacgattattttttctttatctttctgatacaatgatcatttgaccaaggctacacacaagccaggatacatttggaaattagcatcttatacttcagattatcagttcctatgtaaaataaacatgttttattttatatatttggagttaaagttttttttctttatgcaaccttgggtggtaagtggatatgagtattgttttttccaaagacatttttggtgctgtatgaatgaccatttatttgattttatgttttaagaatagcagtatcaatttaggtgatttcagagtgttgcacatttcatctttctgggaaagtagtttatagttttaaaattacatgaaatgatataaaaggaaaatttttcatcatgagttttataaagtgagatcagatttatgataaattttgctccactcttcagtggactgcttgtgtaaatctgttaaaacacaaatctgatttccagaatggcaagtttaaagaaagcaaataaagttacggtattttcgttaccaagtggcaccatttaaaaacgagtaatatttagcatgttatgtgtaaggaaagtctctttatgccttgttactaaatcgtttgtttttctctaaattatattagcattatttagattataccacaaatagaatttgttgtattaaaatttgaagtttattttcttacaagagaaactatactctaggagccaccttttgtataaaactaatgttcctcgaaaagtatctgcattttaagagtccgcaacatagaagtttattgttgattgggtgctttattgccactttactttgagggttcagttgaactctcaattggattcttactgtggatttaggaaaccagccatcaatcatagtgcttaaaataatgtgttaaaaatactacattcagcaatattgtggaaatagggaatgcattgacatttagagttctatttaagctcatatatacactgctgcacttctaaagatgtgactgagggtcaatttaccgaccacttaaatctcttaattttaggaaacctcattaagtcagtgtagaagtagagttatgcattttcattacacttaacagtacttttgtttgaaagaaaagacatgttacttcattaatggattcaaatgaatttgggtttaggctgtatcaagtttagtttctgttgtatataatagaaaattccagtgcaatagtagtggcaatgtttctcatttcaagtttgggacataccaaattgcttcatattattcaaagattattgtaaaattctcaaaaagaaaaagggagatcatttcaatatatttgaattctaacaatctcttacactgggtgcagcacaccagcatggcacatgtatacatatgtaactaacctgcacgttgtgcacatgtaccctaaaacttaaagtataataaaaataaataaataaataaaagaaattctcatgaaataaaataatactgtattactgttactcaaaaaaaatattttttagaggcataagtatgtgttacaacttattttaaatattattcagactcattacattttctattaggctgtctaggtcagtaatgatagttaggcaacttttacattctagattaagcagtaaattaatttacgtattcttttgtgtcctaggatatattaccccaacattgtgaaaggtatcacaaagcatctgccaaggaatagctatcccacgctaatcagtggtttcagttttccattattataggtaacatttgctatgcttgagagtcagatattgtttatttttggtaatatggttggctatttagactgattttcctgctgaatacaactgagagtactcaataaagtactttaaaagcatgaaagaaataacaacatagaaattaccaagtcaaaatccaaatgaatcagtttctttgcccacctccctactcctttttttctttatgccactggcttgttgccaaaactcagtcaattatttcctaaaatgtctctcatcttggagttttctctttgactctttgggaagatttaatttgttcttctgtcccccatattttctataagtgattcctcatatcattgacataattgctcatttgcatcatctcacaataatttcaaaataataccagtattgattgctacaattagattatagactaccgaataaagtttaaaatttgtttgtagctctgcttgctttattttactaaaagtgtatagtaaattctgtgttctaatgcaatgtgaaataattcttttctgtgtatttttatatcaccaacttgatataaactttgtttcagttttcagcttttcaggatcacaagtcaaaattatatatataacaatgtatattcagataaatcttgcttctctgtcttttccatcctatttccttccttctgctattagtaactgtttttattagtttttcgttgtatcattaacatttctttttgaaaacctaaaaaaaatgtaagcatatgtatggtatgttcttatccccccttctaatataaaaggtgacatatatacatactgttagataacttgttcttcttttcttactgtatcttgagtatcactccatatcagtatataggtatctgtatgattcactgtttgatccatagtactccatttgggaatgtaccatggcttattcaaccagtcccctattggtggacatctgggtttttcagacttttgctgttacgaataatgccacagtgaatacccttgtacctaaataattttatatgtttgccagtaaatctttgaaaaagattcctagaagtaggattgctgggtaaaagggtaaatgcatttggaatttttccagacattactaaattcctctccattgattataccattttgcagtcccaccaacagtgtatcatggtgtcgagttctatacagcctcactgtatactttgttgttgaactttgggatttattgtccatctgataggcaagtatctccatctaattttaaatgcatctctgtaattatgagggggagtatatgtctttacatatgtttaaagaccatttaaatgttttctcctgtaactgtctttttaatgttttgcactattaaaagttgtgttttgggtcttccccttcctgccccatattaggagcattttaaattttagaggtattagcactttgtcttgatttaagttttaatttttttttccagtttgccatttgtcttttggctttattatggtgaggtgtgtgtgtctgtgtgtaatgcgcacttgcatgtgtgtgatatttaaaagtttcatataatttgatttccctttttattgcctctggattttgagtctcagctaggaaggttttttcccgcttccagattataaaggaatttactcatattttcttctattacttgtataatttcatggtttatatttagaactctggtccttggtgttccaatatagtgtgaagtatggatcaaattttttcttttttccagatgtctatccaattgttccaatgcttgtttccactgatttgatatttatttctggactttttcttctgttccattgatctgtttgtttagtcatataccggtaccacagtgttttagttataggttcccaaaggtgctactttactttttgatcagaattaagtaagaacaacagttaaagatcaccctcatctaattcatttgtgtccctcaccactgacaccaaatagaagacttatgtgatatatgtatgtttcagtgcatgatgtaggtgctctttggtcctatattagtgaaaagagtgttgaaccaatagtcagggagcaaactcagcttttaataccacttctaagcacatcacttactttctctggtcctgttttctcagtagttaacaaacaaaaggagttgaaccaaatggtcttcagggttgtgtctgactctggttaatgctattttggttaagagcaccactagtatgtggtgtgaactttaatctaccttttattcccctgtgccttattcttttgcagtattcatgaaataaactttctcttctggatcttagttctttaatcttttctctaaaagatttttctttgttccagcattttcttctgtcctgcatttattagtttgtatctcttcctgctgattaagcaaggattgccactgtttggctgctcagcttccactgacctcactggggaaaattacatgcagttaaatgtgaattattcttcccccagcaaagaatttctttaaaaaaaataaaaggaaaaaagacaacataaaaacccggctgctgccagtagtctgtcctgttatacaaagaacagaaagagaaaacctccctttaaaagtacttaaagatatcagacaacactgtggtcagctaatcagctcccgtttaatctaagaaaattggtatttccctatttttccctgtatttctttcaggaaagaaggtggtaaaaaggggcaaaaatgtggaacgagcccattaagtaactgtcacaaatgtaaaatgagaacagttatgatgatttaaggcatgtcaaagacttggccaagtataaaaacatatcttatttaccataacaaaaattcgtaaaattaaaaagaataataggaaattctcaactccagattgctgctggggaaattagctttaaaagtactaagtttgggccgggcacggtggctcacggctgtaatcccagcactttgagaggccgaggcaggtggatcatgaggtcaggagttcaagaccagcctggccaatatggtgaaaccccatctctactaaaaaaaaaataccaaaattagccaggcgtggtggtgcacgcctgtagtcccagctactcagtaggctgaggcaggagaacccctttaacgtgggaggcggaggttgcagtgagccaagatcatgccactgcactccagcgtgggcgacagagtgagactctgtctcgaacaaaagtactaactttgaagaatacatgaaagaaaatttttaatgaggaagacaaaagatgtaatatgacaataagtatcatgcttattcaggaaaagtaagaagctcaaggaagtgtttctatagattaaaaaattaatggtcagtaaagatggcttgaaagattttaggaaaaacattgtatgtaaaattcctgtgtccaaaaccctactggttcttattaaatatggagctttgttaatgtcatgaatgccagtgctatgaataaatgctatgttctactctgaaaatcccagaactatgagtggttctccaagactgggctaccattttattctaagtgcttgtttccccctggagttagatgggactaatgaggaagaatatgtgcttgttgggcaaaggagcacttctgcagacaaaggctggcatccccaaaagtataggctgatgaccactcttgactttgacaaagattgggcccattcctactctaataactcagacttaccaattgtcagataatggataaagatgaaattctgtgtaagaaaggtgatttaagagtggatagcatcagaaagtataagtttagtaaaaagttgagaatcatctgtgttttgatagtctcttttcctgaaaaaaaaatcacccaaagtcacccgtatttagaatgaagccatagtcttcttttccttttttttgctttataaaacttgattttgtttgggtgtttataaagaagaaacttgtaaagatgccagttttaaaatttgtgcccccccaacatggtaggaaaatatttacattttatgatgcatcctcatatttttttcagggtaaatgttcctaacccaacccttcagttgatgttttaacatgtttgttttactctttgcaatgaaaccaagaagaaaatttctctattctcaaacatgcattttaatctcccattcccacaaacttggaatatttatttaatacttgaggtattaatttaaaacttgaagcatatacttagtctcttattcctctccaccctggtctttgaaatggaaacataaaagtttattcaccataattttatacacagcttttcaggggaaaaaaaactgtactgggtaataagtatatgtagattgtttcagagttcttaaattattgaaacataccatttacatatgtaaaatgtactatactttaaagataggtactataattagtaaatagattactgttaaataactttttttaaaaaaaagtttcatctatgcacataggctctgagcagatttcagatagttcctgaataaaaatcaaaattgactatcagttgccattttatatatgttaacatataaagaaaaaagagtcatttgaggatggaagatcagctaaaaagcaagttgtaatatttataacagttctgcaggtggaggtggcagggattcattaagatcttgatcagagttgggaggaatagagaactcctgacactggatctcaaggttggaatcttcttggtttttcataaaatctactggtggcaggggcaagttaagtgagtcaagcggtggaaatgattgtattatctcagatttatgatctccacagtcttgattgagacagtccagagatggagggagactagtagaatcatttggaagaggagatacaattgtcattgtgggtttgatcagattggttactttcctgtccttccaaatccagaaggggaggtggtggaggcagatctgcatcatctgaagaagaaacagcagttccaactgttgaaccatcagcactatcttctgatgtaccatttacttgatcttttattttctctgttttggggttgttggagtcttcaatgttttcacttgattcaaacaacttaatttctaagtcatctgctaaaagtgtgcttttgcttggtttccagggtgtaagtgaaatgattgatgtacgttttgtggatatttcattttctctgatgttatccatacaaatgtcaggggtttctccatcagcaaatggagatctacctgcccaattttgatcatttaaaactggtttccttaagcatttccaaagtacaatgatgattatagctaccaacatagaagtcagaagtacaccaattagtatggcagctattgaattataattgtttttttgtggggtttgtttgttactggtagtatctaagataaatcctggtgtactcctaggtgaatttttgacagttgatgttggttgtgtggatggattatgaacagttatttgttttctagaagggatctggacagatgatgattgttgagtaaaagtatagacaaatgactttggtggttgtgtggtagaagtacgggcagatggtagttgtctggcagaggtgaacacggcttgctgggaggaggtgttggctattggtgttggttgtttggtgttgtaggcaagtggttgtccagcagaagtatgtgcttctggtttttcagaagaggtatagacagctggtgttggttgtccagcagtgactttggcaggtgatattgattgtccagaaaaagtgtcgctgaattgtgttggttgacccaaaggattccctgttgtgttttgagaattagccaatacctgtgacattgatgatgtgaataaggtaggctgtgactgcttctctgttgtaattgtctctgtctttgaaaaaaatgtattgttcaggtgtccacaaaacaaaattaagatgaaatatttgggatccatttcagaatatttcctcgttatctatagcgggtttataatgaaagagaaagacagttaggcgtcattggtgtctagttaaaaatttgacttttcattatgattcctggcataaagtaggtagacattattcctaattagtagtagttgattagtagttattattcctaatttagacttgatacactgtaggtttggtgtaacaactcttggatatactctaacccatcatacagcatttggacctcataagcagtgatctctcttcttttattaatacaagttctgtacttggctctgctgcccctctagcttcattatatttcagtacttcacttagtcatacttctcaaaacgcataggctctatatgctggatccatgtgttctctaccttttttcaccattttctactagaaatatattgattctcctgccttgaagaacaccagtgatcatctgttacctaatctaattgttctttatttcttctctcccctcccctccttgaccacattagacactactgttccttcactaatattcaagtagctttttgtaatcagtcttcctttcatgttactctcactagctctttttcttctgcctcctaaatatggttaattgatattctgtcctcacccttacctacttttctttgttcctgattctgtaagattttagttctcagctttatgccacaattcctaaacctgtacctccagcctacatcttctttgtcctaattctatttgtgtgacttcttggtggatttttccatattttatatatatagatagatagacatagatatagatataaatatctcccactatcagcaaattcaacatatttaaaatggagttcatctttaccctcacaactgacaactgactcttctcccaacttctctgtatctgttaatggtaccactaagtttcttaggcacagagtctattagtaatctttgaagcatccttagtgtctctgtagcgtggtagccttatgttaatattgcatatttttaaagaatttcattcaactcagagtcttaggcttaaaatcctagagtgatctctgaatctggtggagtaaattcaatccagttggtcaagtagtcctgctgctgctttcattcatctattggtaaatgccacatttgtgtggagctctgttctaggtttaggagattaaaaaaaaaaaaaaaagatagtcactgcctttaagtgtttcagattctagtgatagaagcaaacagtaaaggccaggcgtagtggctcattcctgtaatcccagcactttgggaagccaagatgggaggatcgtttgaggccaggagttcaagaacagcatggaccacatagtaagatcccatctctaaataaaaagaagaaagaaaaaaagctaaaaaataattacaataattttttttttttcaagacagtcttactctgtcacccaggctggagtgtagtggcacaatctgggctcactgcaaattccgcttcccaggttcaactgattctcctctctcagcctccaagtagctgggattacaggtacacatcaccacgcctggcctatttttgtatttttagcacagacggggtttcaccgtgttggccaggctgctcgagaactgacctcaggtgatctgcctgccttggcctcccaaagtgctgggattacaggtgtgagccaccacgcctggcccaattacaataatttgataagctttctcataaaagtatgcaggagatgtacagagaagttaacctagcctggaaaggcttcagtgaagtaaagcttgaactgaattttaaaagtctataaaaactaattaagtttccagccagggagagcaacaatgtgggcacaggaaaataaggcacatatgaaagtttggcagatagggctttttctgggatgtggtagatgctaaaacttggagagttaagtttcagttctacttctcccatctaactacctgtctaaccatgagaactagttgcttaacctttcctgttctcaattgcctttcctctaaagtgaagagttctactgagacaatttgcaacttttggtataatatacttgttttgcacatcatcaaacacaatggcaactatttggttatctcttaacattagggaatagaaaatcttagggtgttagatattggtatacatgattagaaactatagttcttctgactcataagcctatatttagagagatttgatgttctgttggaaggtgcaataaaggttttacaaattaccttttcagcatatctaaacagcatatcattgcttactcctctaccacttggtacacagtgatgataaatggccctgttttagtagaagaaaagatatgtgatttttttccctatacgaataattcaagcctgaattttaaaacagttctcctttgaactctcctgcacactgctgaattaatcttaaaagtgtgcatgatcaggttactactgccttgcttgagggtttaatttctgttaagataaaacttcctttttctttttttttttggagacagagtcgttctgtcacccaggctggagtgcagtggcatgatcttgtctcgctgcaacctctacatcctgggttcaagcgattcttgtgcctcatcctcccgagtagctgggactacagtaggcatacactaccacacctggctaatttttgtatttttagtagagacagggtttcaccatgttgtccagaccggtctcgaactcctgacctcaagtgatctgtccgcctcagcctcccaaaatgctgggattacaggcatgagccaccacgcctggcctgttaagataaaacttctaaattgagttttcttccttctggcttgagttaaccagtccagattcacgtatcatgactgaaacttcttatccagccaaatgcatccctttcccaccttgcatactttctaaacacacgatttttccctgctaaacagacacttctatgctgttttttacccttctcaagggtgttctttttttttatttttcttccagacctagcctcttcccctttctggctgcatatctgaatctgtcctcatctttcagacctcagtttaaattccccttcttaacccaagttctctgtgactgactacagcccaaacagatcagtcatttactgaattccccctagctctcatttattgtttttatggttccttacataattcatgtatgtatctcactcacacttctattctcttaagtaattgtgtttacttttcacattttcctatacctacttccttgaacaagattataaagaaccttgaagaaggcagaaaggagaaagaaaaatacttatctagagcatattatgtgttgtactatcccagttttgcatactttatttcacagaaccttcaaatgactttataaggaaggtaaagggatcccttatttacagataaagagacagtgtcaaatgagttaagcagtttgcctgatgttataccactcgaagtgacagattgggagtttgtacccagggccacctgattccaaagcatacattctttctgctaccctttattgcctcatgtttttatattttgatttctttgtagttaatgccttatatattaggagcacagtaaacatttaacctgtattgggcttcttgattcctttccattttagtttttgctttttactagtacttctaccagaaaataagcagaggcagtgaaatctgagttaataaattctgctttttatccattttgcaaaagatttaaaagggaaaatttgaacacttttggcatagatatagggatttgaataatctctggatggtcatcatccatgcagttcctacccattattcttatagattacaaaaaaaggcggggggacttctttagaaaatgttattctcttcagaacttcattttaaaaatctgttttaatgctatgcaaagcatcagaaaatataagccatgaattgtctttagccaaaaatgtttcctcttttgtgactttgcttaaaataaggaaaccatacggttcctcttttcagttagctgaaaaaggcattagagaaggacagggcccaaacaggaacataattttaaacccaggttagtttgtaagatcaattttgataggctcctatcctctactgtcagtagtaagctggtggaaccctccatgtatgagattttcacttgtcagttaacggttatggcaatattaaaaccaaattccattttttgcctatcctaacactttctaccactcttcagttagctttttatcctcctaggatctgccacatcagagtactagaaactgtattagaattctatgatggcaattcagtgtagtccagagaaggagaagaaagatttaaaagaggaataaatagggaatatggtagtggaaaaaactgacttttttcccagcggtaatgaggccagcgttactaccagtgtggaaggttatttagcatacacattttaaaatatgtaagtggtgtgtacctgaagtaccaacattgtttctgtaggtaaagaacaatattgggcaggggaataaaaaggagatttagaataatataaaaggcaatgcaaagaaatacaaaataacacaaaagagaaaaaacaaaaactctaggaagcagcgaacagaaaagaggaaggtcaattgactagagaagatacagaaaagaagaaaagttaataaacaggtgaaaaaaaaagcagtggttatataattagcaagaaggcagtgtagatgattgaagtaggcaaaatgaagttgggggtggggggagatgattgaagtagatgaaagaagcaacggcaaaatgctgctctgttgtggctggcctgtgtttgtgagtgcagggagacagtaaagaggagcttgctttctaaaatggaggaccagaaggaaccatcctttcaaattcatttacctttcatttcaggctctcctgtctgctgtgagtatccttaccatcctctccctttttttttccctgacactatccagaagcatacctagcaattattccaaagaacccatgtacccgtgtacgttttatatagagttttccagaaatcccttagtctgctgctcaagcaaatttgtcagccctcatatgccggtttttactcattattataggctggcactttgaggtttaaatctgtgattttggttctttttctttgctgaatatttagaatattttaaaaagaaaaacataaatttaaacattttaaagacagttacagtgaagcaggagtccccgtgtataagacatgttctttttttttttttttttccgtttggagacagggtctcactctgtcacccgggttgcagtgcagtggtgcaatctcagctcactgcagcctctgcctcctgggctcaagcgatcctcctcacacctcagcttccctaaagaagttagaaactgcaggtgcactacaccacgcccaactaatttttgtattttttgtagacatggggtttcaccatgtcacccagacttgccttgaactcctggactcaagtgacccacccaccttggcctcccaaagtgctggaattataggcatgagccaccgagcccggccatagacatgttcttataaatataatgcataagtacttaaagggtccagcatttaaaattgatgctgttaagttggatatgttaggaagtatgccattatcttttaaagagaatcaagatttggagagcatatcctagacaaaagacaagtatagatagctgtatcaattactttgatataataaaagttgtgatgcaaatataatagattaaaatttagcagtagtattatctctaactagtgaagttttgaaaccgtaaaagaaaaaaccagccattctgcatcttgaggaaaagtggaaagagaaattgaccttcaactacaataggaagtatttgatgaccatcttgtatcatgatagtgaccatttactgagcacccaccaaaggctaagcagtatcctattttaattagctaggtggtggttttttcatcctacagataaggaaactgagacaccacgatgttgggtaacttggcagtatcacagctctaagtagtggcactaatacaaaaatcatgctaatcttgtgccagaaccgtttctttctatcacatttcactgtatgtgctatactgcctttcatagaaaagttatgaaatagaaatgctttatgaaggaaggagatgtgagttggtgggaattacacgtaaataacacttgtaggtagtcttagataaagggtaggaaagaaatacctgaaaacccattttagtcctgattctacgaaaactattataagaatttggaatggtttctataaagtgtcatatttagtaagtttactgaaaattttgtggtgattttttttttaaagcttggacattgaaaggcatcagatttatgtttctcaattcaaacttaatcagaattaaagtttccttctaagtagaattatgtgggaattagctggaaaacacaggcactactagtaaactttagatttgggactaaccctttaaaaacatgtatgggaccaggcgcagtggttcctgcctgtaatcccagcactttgggaggccgaggtgggccaatcacttgaggtcaggagttgaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgccgctgcacaccagcctgggtgacagagggagactccatctcaaaaaaaaaaaaaaaaagtatgggattctatgacaaaaacacaccataaggattgatgggaaattttttaattttatgaaatatgacagtgaaaaaaatttaatataattttatgactttatgcataatgaaataaactaaatattagaagtagaaaaatatatagacaagcctaatctgaaaaagagataaatatctttattttctgacttccacagtaattacttagaagaaatccttctaagagaaagtcatgaatatttattaagtgttgaaatgggatatcacccactatgaacatattattccctgaaattacaagtctatgtaaaatactctttgcagtttttaatttgcccattttacccacagcaagcatcttttatgcatattaacaattttctattgtttattctataggtttcttctatcttatactatgttctaaagtctcagataatgtgacataaacacgtagatgatattaatatacgcatgcatgtttgattattgactaacatttttggcttagtaagcttttaaaatgagccataatgttttcatgtcatcattattaaatataaaatctatatgtaaaaaataaagcatgtataataataatagtcaaataccacatctgatttctttttctttctaaattaagtgaaagtgaccattcttactatgcaaactaaaggggatacaaaaattttaatttatgcattatattatgtacaggaaaattctataaaaagtacattagaacttttaacaattaatattttggaggttataaattcagtcatagcctgtggaatctagttctatttctaacccttagctttatctgccatggctatagtttctttttaattctaaaactaaggttaacaaatatgattgtggctgggagcggtggctcactcctgtaatcccagcactttgggaggcggaggtaagcggatcacccaaggtcaggagtaggagaccagcctgggcaacatagtgaaaccccatctctactaaaaatacaaaaaaattagccaggcgtggtggtgggcgcctgtaatccgagctacttgagaggctgaagcaggagaattgcttgaacccaggaggtggaggttgcagtgagctgagatcatgccactgcactccagcctgggagacagagcaagactctatctcaaaaaaaaaaaaaaatatgtgtgtgtgtgtgtgtgtgtgtgtgtgagattaaataaacttaaaaggtcttatacaaacctaggtgaaaatatttttctaaggcaagctgaactgagtattttttaattctatgcaacaaaaccacaaaaacctgttatagacatctttagactatcagagtttaagtttaaaacactaatgacagtttttaaaataaattttatataaagcaagatcaaaccaaattgtgtgaaaattttcttacctcagctgttaacttcttttgcagaatgctaaattcttgttctaactggacattttggtgatttggctaagaaaggaaaatgggtggttcaattcagatttaaaatgttcctctagcaaactgaaatagtttctgtagaaaaagaggaagtttatcaatagctggttccggaagtgcaataaaccacaaagtgactaagaaatatattactttaacagaacttattttgaaatacattttggagccctatgatttgagtgcttttaattatgtaaataaatatttgagatactctagtaatatgattatgtaaattaaatatttaggatggagtcccgaagagaaaattacatgttctaagaagaaaagctgccagttgggttatcacttacagtgagatttcttctcataagaagtgagtgatgtgttctgtttacttgtatgaccttaggcaagactctgcacttctgagtcaccgtttcctcctctaaaggaatattttattgggttattgtgaggattaaataagatagcataatataacatgtataaatgcctcaccaactgcaggtaaccaataaatgtaatgttatttcctcataatataaaaagtccagggtaaaagtataattacattattttgcaaatgacaggatctcattcttttttatggctgaataatactccattgtgtatatgtaccatattttctttatccattcatctgtttatagacacttaggttgcttccaaatcttggctgttgtgaatagtgttacaacaaaagtgggagtgcagatgtctctttgtacagttttcctttctgttgggtatatacctagcagtgggattgctggatcatatgatagctctatttttagttttttgaggaaccaccaaactgttctccatagtggttttactgatttacattcccaataacagcgtacgagagttccattttctccacacccttcccagcacttgttattgcctgtcttttgagtataagccattttaactggggtgagatgaggtatcattgtagttttgatttgcatttctctcatcagtggtgctgagtaccctttcgtatgcctgtttgccatttgtatatttgtaattaaattattttgaccaaatattttactagtgacttttgagttcaagttctcaactatttatttgattacccacaaagtagttacttctcagtggaaaataaaataaattggggatcattttttaaataagaagttaactaaagttaacttgttactaaagggtaatgaggggttggggagatggtgttaccagttaataggtacaaaaaacaatagaaagaatgaataagacctatttgatagcacaacagagtgactgtcattaataccataattatacattttaaaataactaaaagtgtaattggaccctttgtaacacaaaggataagtgcttgaagggatggataccccattctccatgatgtgattatttcacgttgcgtgactgtatcaaaacatctcattaccctttaaatatatacacctactatgtacccacaaaaatttaaaatacaaaaaatttttaagttaactaaacaaagtgtattgaaaggagtgagtccatctgaataaaaatttctttgagtaagtcacctttcctctcttgaaaaatggagatcataattcctaatttataagcttattgtggaattaaataaatgtaaagtgccttggatgatgcatattatagtaggtacggaatgtgttaacccatgcactgctttttcctggtcactgcgggaaacacaggttattatgaccttgttcttaacttcagggtacttatagcttggtgcaaaaagaatagtttttttttatgggctcctactataaagcataatataatcaaatgctataaagcttttgattcactggtttttggaagtattgttgtttttacggacagggtattgctgtgttgcgcaggctggtcttgaactcctgacctcaagcaatcctcctgcctcagcctctcgagtagctaggactacaggcacatgctactatgctcgctggctggcttatttatttattgtaaagatgaggctcttactttgttgtgcaggctggcctcaaactcctggcctcaggtgatcctcccaggattataggtgtaagccactgtgcctaacctgattcactatttttaaatccctgaattaagctggtgaactgtaatacccaggggtagggaatgtgtttttgttcaaaactaaatgacttttaaattttgaactcaaagatatcttacctaccattttaaaatacctgtcatttggaaaggaaacacttctgtttgttcagtaactatcattggatagtaccattctgagagtatatgtttaatagccaagatagtgagtggtgaattttaaatattcttttaaatatccttgtggtagaagctctctggtgagaaaatgtttgaccagtatgttgaatatgaaagtaatttcctatttttatgatgatattaatttcttttaattttctctgacaagtgtttatttatgacccttgattcaaggagtgctttgtgttactcctggatgtactggtgcacaatctcaaattttcaatttttgcacagaatgggaagtctgcccagtttcatttctaatctgggttatttttcccctcaaaagataacctgatttcagtcaccatgactggcatgaatattctcatgctttcctttttactttgttaacacttaactttatctggaataatattgttatgatttctcgtttagagaatagatttgttttttacaaattgctaataaattgataataaaaatgatgctttatttttttcctctcattttaataatagctagacgtttgaatttgatgaccaagagcagttatcaccttgagagttacgtaaaaattaccaatgcttagagttcaccccattccagttgcatcagaaggaagacatgggaattaggcattggtgttttttaaaaactcttcaggtgattctgacatgcagccagggtaagaatcactagcttagaagggagagtaagattgtagtcatacttgggaaaaaacatataaaaaatatttttaaaatggttactatattgcccgaaataaatgcccagtaagggatgagatttttgaaatgtggcctgatcttagccctgtgttaatttcagtagatatttggaaagtctctcaaaccaatttttgtaatatatttaattgaagatgggggggttctcaacttaaatgtaagtcattattttacttgaagccagtttctttaaaggttaaattataacctgaagtatgcagttttccagatttgaacacacacacacacacacacacacacacacacacacacccctaataaatcattaggctacttggcatccttgaagtccaaaaattaatcaacctttggtacttgttgttaatgttccagtaagtagtatttatagaaaagatgaatattattaatcataaacagtgaaacatactttgcgtttacacttagcctattggtgtggctataaatcttatttattttagttgtgctctatttcttattgatctttacaatgtgttctctaaagtaataaagtgaatgcaaatatacgtggtcacaggtttattctgagttttaatttattatacaaaagtaaaggttttaatttaatattaatagtagaaaaacactttcttacgtgtgccatatggaaagataaaggatctattctaaaattagctgtgttggttgataagctggtgtggattctgccacatccagcaaagaagataccattaaattacacagtttagctctctctatctatgcattaggaatttgacttccatttgatgttaaagcatatacttggctttaaggacacactaaaactattcaaagtttaattacattcagacaaagatcatctaaccactgttgctacatagggaatatttatttaattatcccttgctatctctattaatcagtttcctcaatttatccttaaaattttcctcaaatgcttagttattttattatttgctttttaaaatattcagtgtcaaaacaaaagtacacagtttaaataattaagcaggcatacttctccctgtctcacctgcttgattctaaattgcaaggtctaccatgtcaaattttagataatcagaacaacactttgggattaaataccaactgacttcatttttactccataagccttctcattgctactttgcatttttcttcactaacctatctgtttgttagtaagtttttcagttccttcttcatcttttctttcccttgtagctgtgagcactccagtagattgcatcactaggttgggtcctgtgagctgttttgttcttttccaagtgtctgattcagcgggccatagaccgcttgccagaaaatcgccattgcttctaggctgacgcttgcctacttgttttgatcgtctgagagaagagactttgtttgccaaaaccacagttgatagaaatagaaaggtacagataagaaaaagcactgcaattataattaagcaaattagcatagccatgttgttgttgttttccgcacagacatcctttttgaaaatttcaccatgacttttgcttgtgttttcaatgctctgtactgttgaaggactgttgctgacgacagaaggtatataaagctcctgttcagatttagaagttaaagctacgatgtgagatgtttcaggcatgtttgtagaattacctttataatctacttcaggagttatagggtttgtgttaatgttttcattttggtttctgcctgtcttgttttgaataactgaatcccaggaagaagtactgttagcccacagacgggtatagtttgcttttgttccaggagacaaagaaaaaactgttgtcatcagaaaggcaagatgtaggtaatgtcctgtgtgttccatgtccgtgggcatacttggcaatctgttgggatagcaatataatttgttagtttgtgaaagaataatggatcctagttttggtaattgtagttaaaagatagtgttgagatgttacaagtaaactacaagcttatgcctaatattcgctaccctgaattccttctcaactaaatttcttttctattcagctatgtatgaagaagcattttaatttctattaacacttttagatgctagaagttagcattacaaataaatattaatcattttaagtggactatcatggctttatatagttttcttcctttgaagcgtgctagacttctgctttgagtcagttagttctgcttttacttttctgattccttctttaaaaaaaaaaaaaaattaaggatcattcttacagaaactacccaccctctaacctgtcaccaatctttacagaagaaatgtggccttgagcttcttgcttcatgtatgaaataaatgcaaatttttttggtggaaagaggggaagtttggtagcaaccaaaagaaactgaacttcaaatagaaattcaaggtgttctttttttttcttgggtgttcatcttgaagcttagaataaagctggtacttagaaatacatttgtaagtgtatttgtgaacgcaattttactgtggtggttgtctcttttcatttatatttccctggactgactgtgtctttctgaaggcaaaggcataccagttttctcaacctaaaaatctgaagaaaaaaaaaaaaaaacagcaaatttcctctgagtagacttaaaagttcaacaaaagttgctgggttttcttttaaagcatcatttatacctagcattttttctgattttgacataattgtaaaaaaaaatgtgtaataaaatagaaatagagcatcaggatcttgatgatttgggatgaagtggcaggttataagcatctcaacagataattgaaaatgttgaatttccactttggccctgagcttgctggaaactagtacaaaaaggagacaagttatattatacattttttaaatctaccaaatgattgatttaaatagaaatggcatatcttagaatttaacagttccatgtactgctaacccagcaggaaagatttataatcattattaaggtatcttataataatataccagtttgtcttgagctacttttgaaaggagtattttattgttagcatttatttgaatgaactaaaagcaaaactatattgttctcctgagatttactaaatgaaattgcctggttaagaaccctacgtatgctatagaaattcttctcaaatgtacttaggagtccttttatttaaaaaaaaaaaaaaaaggcagattcttacctagctagtataggtagggcctgaaagtctttgtttccaaaccaactcctaagcaacatggatgccactgctagtcaggcttttgaacatcaaggttttataagaaatggttgttatatgtcattggctgacatttgtatactattaaaatacagaaattgaaaataagaaatgtgatacgttgagttatgcaaacaaaagtagcatgtaataaacaatgctaactggagactatatttcatattaatagtagggaggaaaaactattaaatattccaggattaagattactttttagattatgacctttagtagacaattaaaggcccaagtcactggcttttgtataatagtgttcagctttaatttttaagtttagtgacataaatctttggatatttcatgattcttccacaaaaagaaatacttgaaattggattagcaagtaatttccatctttttatactagactggacttctgtattagatgctagaatgatttaaagtagattattctgttcacattagttcattaacagtgtagtatacatcatagtattggtacacattttaacagtgcttaccacggaacagataataggcctgctgttgattgtcttcagccagatgtactgcagtgcccaaataaacaaactgtatgacaaaatgagactttctcttgcccttacaaatgcctgagaattgaggactgtttttactccagtttatgccttggaggccaggttgtgttatcagaagttttcttatatctgatcattttcagtagaatttattttcagtagaatttgtaatgtccaagcattagtaatgagaaatttattttttaacttttgaaaaataacaaaacatttccagtttacttgaggaaaccaaacttagatccttcgtaatcctaatttaaaactccatggcgatggcaaattttttcatttctaacttaaaatttatgtaacaggacagaaaaaaaaagtatacattttcagtcacaattctagtttgttagtgagattcttacacactttgatagcatttcctcgaacactaatctgtcagacgttagaagtgaaaaggcataagaaaagccgtatatatatgacctaccttacaaaatgcttggtcaaaatctgattataacgtgattttgataaaccacttcttttcttgtcttctttttaaagcagaatagacttggagaatatgagccttaaagtaaatctgcagtaaaaaaggatatgtgcagctagttttccacttttaaaaccaaaccacagatgacacatttcctttccactgcaactaaagcacatgtcacaggagggaaaaaaaaaaaaacaacgaaaaagctccaacttctctagttggccactggcatgacaggaggctttgtagaaccaatccccgcctccagagcagggagggttttccacttaatgccttttgacagtatgctcattctataggcctgctacatgctttagtgtcattcaaaagaggttttgaaatggtatcttccatttcaaatcttctctaaaagacttatttgaaatctacagactgatttgaaaatgtgagtttggagtccatgggatactgatcagataatgtaacaattgtggaactgcagcaattatttgagaaaatatctagtaaacttagattatatgggacagaaaatgctttcgtgtggtgtagtgtgtgtatacacacacacacacacacacacacacacacacacacaactgtcaaacatcctgtcatcacctcaagtttaacatgactgaaacagactttaagaactaggtatgggctgaacacggtggctcacacctgtaatcccagcacgttgggagggttgacgcaggcagatcacttgaggccaggagttcaagaccagcctggccaacatagagaaaacctgtctctactaaaaatataaaaattaaccaggcagggtagcatgcacctgtagtcccacctacttgggaggctgagacaggagaatagcttgaacccgggacgtggaggctgcagagatcatgagatcttggctgcatgagctaagatcatgccactgcactccagccaggaagacagagtaagactctgtctcaaaaaaaaaaaaaaaaaaaaaaaaaaagaactggatatggcagcacatatctgtaatcccagctactaggtaggttgaggtaggaggatcactggtggagcccaggagttcaaatccagcctgggtaacatagcaagactccatctcttaaaaattaattaaattaatgaaataaaaagaactttattttttctttaaaggaggctgcctgtgacagtcttcttgtttctgttcatgatagcaacattctaatatcagaggcttagtatacaacacatcattttaatttaagtcctctcagtcctgatcagactttgaatcatgttggtccttccttcatattgttggatcagtttctttttccctgtttttactgtcaacagtactattttagatccttatcaggtcatacctagactctacagtgccttttcggtagccctgaatccttcttatatcttgtatacatcactgtctttggtcataccaccctttctttaagggaaaataaaaccggttgaacagttccctaatacatacaacaatgattcagaaatgtttgtgtacataaacatcagatgagaagattgtttaaaaattataaaagcaggacatggtggctcacacctgtaatctcagcactttgggaggctgaggcgggaggattacttgagccacagaaattcgagaccagcctgggcagcatggcaaaatcctgtctctacaaaaaatacaaaaaaacaaaaacaaaaaactagccgggcatggtggcgcttatctgtagtcccagctactcaggaggctgaggtgggaggatcacctgagcctggggaggtcaaggctacagtgagctgtgaccgtgccactgcagtccagcctgagttaagggaaaaaaaaaaaagataaaaatttccaggccccactacatagatccatatttagtaggtccaggttgggaccaggaaactgcatttttatcaagcaccacagttgattctgacgccagtagtccacagaacatatgctgagaaatggtgagcccctagtagaaaacctaagccctttggttgggcagttatggtctctccacaatttgactattctgtattttcccagctttatctctcaaaacttctctacctgaatcctccattctggctagactagctgtctcttcaacacatctagttacctgtttcttttcctttttgcctttctccataaggcctgcccagtcctcttgctgagtctgcattcctccttacctgattcagccactgtatcttctatgtagctttcactgactgcccagtttgtgttaatctctctctctctctcctttgtcttaataacagtattttctctgcatttcctttgataagtgattactttctacctcatatcttctatcttgaaatatttgtgttgttttaaaatcatttgacttgtcatatttttatcttattttctcccaacaagattaaaaattctgaggtgaagttttttattgatacatgataatttgtacatattaatggagtatgtgtgatttttttggttttttttgtttttgtttttgttggaatctcgctctatcgcccaggctggagtgcagtggcacaatctcagctcactgcaaactcccctcccaggttcaagcaattctcctgcctcagcctcccaagtagctggggctacaggcacgtgccaccacgcccagctaatttttgtatttttagtagagacagggtttcaccctgttggccaggctagtcttgacctcctgacctcaggtgatctgcccgtcttggcctcccaaagtgctgggattgcaggcgtgagccaccatgccctgcctgtatgtgtgatattttgatacatgcatataatgtgtaatgattaaatcagggtgattaggatatccattgcctcaaagaaaagaaattgtttcgtctagctgttttgaaatatacaatgttattattaactagtcaccttactatgaatagtagaacttgttccttctatctaattctaacaatacatatattatttattttattattatttttttaagacagtctcactgttgcccaggctgaagtgcagtggtacaatctcagctcgctgcagcctctgcctcccaggtccaagtgattctcgtgcctcagcctcccaagtagctgggattacagacatgtaccaccatgcctggctgatttttgtatttttagtagagacagcgttttgccatgttggccaggctggtctcgaactcctggccttatgtaacccacctgcctcagcctcccagagtgctgggaatacaggcgtgagccactgtgcccagccctgattatatttttatatccattaaccaacctctgaggtaaagatttattttaacttacttagtagtattatcaccagaatcatcacatatggaaaactttgggcctaagttaacatagattgttttgatttgaaactttggtaccattacttcagggctttttcatggtcctcactgtggctgctcccatttattagtattcttttggttttaagcaacatatgacctaatatggcttaatcaaaaaatggtatttattggcttatgtaactgagcagtcctgggataaatttgaccccaggagaggctttatctcatacacaaatgatatggccagggttccagtttgtctatttctcagctccttctcttcagtcttttgggaggctcttcttttatatcccaaaatatgagctagcaactcctagggctacgtattcccttgtttataaacaccaggaaagaaatatctcaaatcccaacaatttaagctaaactacctgaactgggcctctttggccctggttgtcctggtttgaataatgtgttcattgctgaatcagtctgtgatcaaggtgggataaatggattggctaaaaccatctcactccagagctccagatgggtcattcctaccagactattcgcctaaggagtttggtgggccctgcaggcaaccaactaattcccactgttttcttcctttcttgactcatgggcaaattttttattgttgtcgtggctcaaaatttttgaattggagatttgtctcttctcttagccttatttctcagtgtccaaaaaacaactgatttaaaaaatgaatccagactttgaagaattgttttatattattctctctagaaaatgaatcataaaataaaattgattagtggcatctgtatatttattttaaacactgctaataatctttgtcttttttgtcattttccttaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagtaagttccagtctgtgttttgtaaacgattcattgcttttcttgactaactagactatatcctggcctccctaggtgtcctacccctatagtggtgtataaaatgtcacgtaaggctgtcgcggtggctcacgcctgtaatccaagcactttgggatgtcaaggtgggcagatcacgtgaggtcaggagttcaagaccagcctggccaacacggtgaaaccccgtctctactaaaaatacaaacattagccgggtatggtggtgggcacctgtaatctcagctacttggaggctgaggcaggagaatcgcttgaacccgggaggtggaggttgcagtgagccgagattgcgccactgcactccagcctgggcaacagagggacgctctgtctcaaaaaataaaaggttatgtaaatctagatgtaggaagaccaacatttgtgtcatcatggaggtcctgtggaggatatgagacgtatacattttattctagcttaggctggaagtagaagagtgttttggagagggcaatttgttatgtcattcaaattgtaggaatgtgtggagagtagaaattacctaatgagagttctgattattacatgcttttttcagagtgaggacatgaaccttcaggataaaatcagtacttttctataagattgtttgttttgttttgttttgttttttgatatggagtctcactctgttgcctaggctggagtgcagtggcgtgatctcagagtgcagtggcgtatctcagagtgcagtggcatgatcttggctcactgcaacctctgcctcccaggttcaagcgattctgctgcctcagcctccccagtagctgggattataggcgcccaccgccacggcaggctagtttttgtaggtttagtagagacaaggttgttggccaggctgatcacgaactcctgacctcaagtgatctgcccacctcggcctcccaaagtgctgggattacagggatgagccactgcacccggccttctataagattcttgacctttttaaaaaggaaaattaaaaaatttttaaatgttttttgtttcttttgagaacatttatcataataattactgaaccatttgaatatacaatggtgggaactcttccttaaatggcatagtgttttgtttggttggttggtttctggagccttttagaattttatgtaaaagagtttaattcttctccacttcaccccgtcaccaccactttccaggttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtaggttttttaaaattctcttcagtttgatttggggtttgttgcttttaaaatgagaccatttaatgaattttaaaacagcctctaccttaatattgtaaattggaaggtatgcagtgttggttaaccactgtgacctcatcaagttgtggggtattcacatgaactgtggaattccaaacagggtgattcacactaaaccaatatatgtcctttctccatcatgtaaaacaacacgacatagcagatttttttttccaaagtatcctaaattaagtttttcttcctctaagtcctctaatttttttccattttcagaagtatatcactatttagtttaaaagtcaagtcagattattgctttacaaaagaaggcctaatgttcaataacttggtaacattattgcatactttccacctacatcactcttaacaaaattctcaaaataaatcttaagacaaataagtcatctgagcagagtgtaattggttccatttaggcttaataacttgaatatgcatgtggaaagagcatggctgtggagtgagtagatgtggtttgaacagatatgccactttctagctatgtactttgagcaagatactgaagttttcagatatctagtttccttatttgtgaaataaaggtaattgcctttcttatatacccacaaaagcttaaaaaatagtatgtgtagtagtatagtatagcaaactagcaaatagtttatacttagtaagtagtattttcttatcttttccctccctgccagcatctccttgcaccctttctcccttttctcccctctccttaccaagttaggataattctttgtctcaagtaccctgagactttgaagatttttcagatgtaaattcttaacttctgaaaattttccctgaggataacatagcccaggttttatagtgggccttttaggattccaaattctcctttacttaaagggaaaaagaagaaaatcaagatatgtttacttggatgggcttcagaaattgtacataagattttgtgtatgctttgcttcctttatctcataggtgtctgtgacacctgtcctgggttgaggaagtccaattctttataagtgttgaaatacacaggataaaagttttgtcaaaattgtataacttagaattcctgggaattagtaaaagatacaagctgagcacttggcactgtagtcccagctactcgggaggctgaggcgggaggacagcttgagctcaggagttcaaggctgcagtgtgctataatcatgtctgtgaatagccaatgcacaccagcctggggaacatagtgagactctgactaaaagttttttaaaaaagaaaaaagatatgtaaacagaaataataacactaattttcacattttaggaaaatggagctataagcctgcctttaatttctaattcaaagatcttcattgaaaaatacaaccttttaacaattattagcctgggtaaacctgtattcttctctagtgacctaaagcaatctctgacagcttctgctttttgctgaagcatgtcatcccagagaaaaagcctttaggcagacttaaattccagtggctttttttccctatatggttgttgcatcaatatagtagcatgataaacattcagaggtaaggaaaacctgacagttactgaacaaactatttcctttactggacaggggagaaaattaaaatttttaaattgagtctgagtcttttaggctgtctcctaaattgcttaaatatattttcagacatttgtaagtgatgtttggtctcaatgaaacctggatattatagtttttttccatattggtggttatatatgatgtaatgaggtcatagagggaaaaatgggaggacttaattataagttaattttgtttttaaccttcagtttgtagggtaacttttaggacacccagaaagaagttcagcagatcctgattaaagattttcacattctaatttgatgaagggaagggccatctgatatctgtccctatgatccccattataactggatctagtgggaaagagaaccagaatttgagttttggctttgctaaaaatgtatggtgtgccttattctgacttaatttctattgatccacattaggaccataagtcctctcatattttatgtctcagtgagatgtattttaggaaagcctataccccgcccctctgtcataggagcctcacagtgctcttatggttatatcaagtgtgtccctttttataaaatccctaaatgattaaggggtattttggttttactgtagaattataacatcttatttctaactgatcataaaatttaaaaatagttgatcatactttgtaacagaatcacaaattgtatgttatgaaaaaattttggaactataaggaaaaatacgttttaaaacaacttcatttgtgttttctcctaggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtaagtaatgataattttctttaatactaacaattattctaagagaattcaaagaaaaccctttcatttcagaattttccagtgaagactttcacttacatttttactttttttcctcttctgattttatatctgtggtatcctgtaactgaaggaactctgaaggaactttttggtaggccacattgagaaatccaccaaaattctgataataaaagcaaagcggcaagagtttggtactttacacacctctggaccacttacaaagtattttcttcactgttgcagtttaattagcttcagcatttctcttcatagcagaaaagtccacataagtatccatgttgcctccttaattttagagaactagtcattttctcttttctttaggttgactttgaacaatgaatttattgtaaatgtacagttcacggagagcacagtggcacataatacagggcccagagtcagttctgactttgttttaactaagtcttataaatttaatatccactctttatatttgtccatctttatatcctatagttttataaatgttgatcttctcccagcatatttcctgaccttttcttccctttcctttccctgtaatatataaaacttttttttctgcattcaaacacatttcttgacttttatatattagataattaaaagcttcagcaattcactaagactctttgtcaggtaagagatgtaggactataaccctaacaaaaaaatgtgtaggactgacaaaacaagaaaagtataaactttattcataaatattaatatgagagaagatttgagtgaatgtaaaggcatattgtgttcctgcatgaacagttcttcccagattattacaaatttaatgtaatttcatcaaaataaccatgggatttgaggattgagaatggagatagaacttaaatgattctaaattctacataaaagtgcaataatagctaagaaaatattgaaaggaaagagacttgagacttaatagtacagatgtctgaacactttatagcagtacaataattaaaacatacatgtgcaagaatcagccatcagatcagtttaagagaaacagattgataaagaagcatcacaaactgatgagggagagattaaatcatttaataaatgaggctgggaaatgacttaaattaggtcttcgtcttcaccgtacaccataagataccaagtatgttctgcctgtatttaagagttgagtagggctgtgtgtggtggctctcgcctgtaatcccagcactttgggaggttgaggcaagaggattgtggcaggaggattgcttgagccccagaggtcagggctatagtgagctatcatcgtaccactgcactccagcctggatgatagagtgagacccttctctattaaaaaaaaaaaaaaaaaaagttgtatataaaagcttggaaccattttaaaaagaagaggaacaagtgaatatttaattgctttctagatgagtaaggacatatgaagtaaaaaagtgataggatgaaacaaaggaaatagcgaacagatttgactacataaaacttcaaaacatagctactcaaaaataaacacaagtgaagataattaaaaactaggaaatacacttggagcaaatatgagaaatgattaatatccttaatcggccagacgcggtggctcacgcctgtaatcccagcactttgggaggctgaggtgggtggatcacaaggtaaggagttcgagaccagcctggccaatatggtgaaatcccctctctactaaaaatacaaaaattagccgggctcggtggtacatgcctgtagtcccagctactcaggaggctgaggcaggagaattgcttgaacccaggaggcagaggttgcagtgagccgagatcactccactgcactccagcctgggcaacagagggagactctgtctcaaaataaataaatgaatgaataaatgaatgaatgaatgaataaaatccttaatcatgaagggtgctgaccgattaataaaaagtggattaacagtaacatacagatcatgttttttttttttttttttattatactctaagttttaggggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatgttttttaaaaaagaatatttgtacaaaaaaagaaaaaagccaggcaccatggcacatgcctgtaatcccacctgctcaggaggatcgctaagcccaggagtttgagaccagcctggacaacatagtgaggcccccatctcaaaaagaatatttatattttaagaaattcactaataaaagccaattgaaagaatagtgagataatcagttatcagcttggcaaagattttttttttaagatccattcctggtggtctgtggaattgtgagtagaggcaatttttctagaaaggcatttggaagtggataacaagaccttaagactattcataccttttggcctcataattctgctttttagcatttatcctaaagaattaatgttaaaatgtttattatagcattatttttatgtagatttttaaattgaggtatatcttgtcatcagtaaagtgcaagatcttaagtcaacagcttgatgaacttctacatgcaaatacatcatgaaagtatctccagatctagacatagaacatttctagcatccagagggatattctcagtaccctcccttcaccaagagtaaacactattatgacctctattgcacagatttattttgcctactttagaacttcatatgacattatttataatagcaaaaaaatgaacaggccaaaagtcaaagaataaggaactgattaaattattggttctccatctgatggaataatatgaagccattgaaaaatggctttgttacagaatttcagtttggaagatgaaaaggttctagagatggatggtggtgatggctgcacaatgatttgaatgtactcagtgccactgaactgtgcccttcaaaatgggtaaagccacggaactgtacatttaaaaatagttaaaatggtaaattttgtgttgtgtatattttaccacaattttaaaaactctttgagactttaggtaaagtgtatagataaatttttgtacaatttttgtcttataaatgtgaagctttttcaagtaagtttaaaagaagtttgcagaatttgtaatgttgaataaataatctcagtataggccaggggtggtggctccacgcctgtaatcccagcactttgggaggccgaggcgggcagatcacgaggtcaggagattgagaccatcctggctaacacagtgaaaccccgtctctactcaaaatatgaaaaaaaatttgccgggcgtggtggtgggcgcctgtagtcccagctactcgggaggctgaggcaggagaatggtgtgaacctgtgaacccgggaggcggaacttgcagtgagccgagatcgctcctctgcactccagcctgggcgacagaggagactccatctcaaaaaaaaaaaaaatgaataatctcagtataatcactgaaaaaaatattcagagcctactgcatgtatagcataatccccgtttttgcgggggagtgggagtgggttatacctgtgtacacacacataaatgtacattaactctacataaatttgaaagcctgaggagagatgagatgatacaccaatgttaatacagttttcattttgtggtgatgctttccttttaccaaactttctatgattaccacatttccttttataatgagaataaaacaactttttaacaagaaaggactaaaatggaggaaaataagacaaaacttttcaaaaattggcttactggcttttaaaattactttcttcaaggactgttctttcttcgcctctacaaaaatatatttgccaagtgtcttttctccaggcctgattctaggtaatagtctttaccttttaccattttttccccgaattctttatgttaaataattgttgatgtgattttcattgaccatcacatgctaatagtgtatttttttccaggtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcaggtattgagtttgctcaaatatttatctagtatctcctttgtgcacatatttatctggtgccacattgggcaaagcactgcgctagacactagggatagagttgtaaaaaacacagtttcctccttcagaaagcatgtagacactcacccagctcttcatctggttcaaaattgtaaatgtctagtgcatgtctcagagccagagaaaagctagttatttgcacagtctccttcaaggcataattatatatatatatatatatatgtatataattatataggattatatgtaggattatatttataatataatcctacatataatcctatataattatatacatatatatatatatatatatatgtatataattatgccttgaaggagactgtgcaaataactagattttatatatatattatatagaactgtagaaatctggtgacatttctagtgctttattctagttctctacattccaaaggtgtcagtagatgtttcttcttattgatgctatttgggacatctgctttcatttatagttctacataagaatgccaatattaaaataggatataatgtaaattttatttttatctgacaagaattaggcatatcatttcttcaaagtaatcatttaaggaaataatgccctcactcaaacactgctgctcctcctccaaataattagaaataaccttggagccagtgttgcagccctagaaaacatcctggtacttaatgtcatttcctatattttatttttttttgagactgagtctcgctctgtcacccaggctggagtgcagtggtacagtctcggctcattgcaacctctgcctcccaggctcaagtgacccttccacctcagcctcccaagtagctgggcctacaggtgcacaccaacacacctggctaatttttgtatttttttttttttttttttttagagatagggttttgccatgttgcccaggctggtcttgaactcctggcctcaagcaatccgcccgcctcagcctccccaagtgctgggattacaagcgtgagccactgcacccagctctgtattttcaaattactattttatattgatgctacattactgtcttagaaaagcatagagatactttgcaagtgactgaagatagtattgatagagatttaaaatttttgaataccaatctcttaatctctgaaggagtcaaatgaatatactcatcctttcctggatattttataataaattgtatttactgacaggcctgtaaataaaatctagtatttttgaggcctcaggtaaaatagaattttcatattgattaggctgttccaatgaatattttttaattaaaaattaaattggtagagtgattaaaaacatgttattttccttcttcaactagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggtaatcacttttcttttgccttctgtactatagcatatctgttttatcatcaggaggttttttgttttgtaattacttttaaattaaactgaacttttttgtgctaaaactttgagtcccatgtttttttttttaaaaaaaaaaaatcctgcttctttacaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtggtaagttctaggaaaggaatttgtgtttaccagttcctttctccattttacttcacctgatcaatatagattatcttatttatgtttgtgctctaacaccaagttgctaatttaagcctccagtaatgacatgaaatattaccaaaaagaaaataaattacttccattccatatcaagctatagtaaagattttctatgcatacttgtcatgtagagttatcccataagcggaatactcagtgccagttgaccatgttcagttaccagcactaatttgtagataaatgaagcaaggagcattaatacaatgtatctagaggtttgatttagggaacatgattatgtaatttttatatggtattcaaattttctaaattcaaaatgaaacatggaactttagaaattaaaaagtaatattttctgtctttacttgttcctttattctcttacagaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggtatagaagccaaaatgataagaaactaagttaaaatctttttttaaaaatatgttaatactatatagaagaaatattggtttattgtgctattttgtacttaatgcttaaataaaaacacttgcatggactgtgttattggtaacaggtcacttaatgacatcataataaacattatttaaacagttctaaaaacatttatgtacaatatgtattcagagtatccccttttttaggcatgcatgagagatattccaacgtgcaagtggctggaccagtggacagaactagctcaaaggtatgtcctaaattaaatataagttgtaaaaatatgcatattgttgaaaatacagctattactgtatgatcaatgttataatttattatttagtatatataaacacaaaggtttttataagttctgtggatcttttaattgcagatttgcattccaatataatccatccctgcaaccaagagctcttgttgtctttgggtgtattagcaaacgagtgtctcatgggcagataaagcagataatccgtattcttagcaaggtacctgttccgccctcacttctcccaaatatttatggttctcaagttgtaaagcatatctttcatttttctaaaagacgtttaaatttgaggtcaatgaaatatcttatatgttacttattaagcctttaaaatgtattttgattatttattgtaattctttgaagaagtcttctctaaagaagctgtctttatatgtaaactctgattacttcattaaggaagatgtctttaaaataaaatatgttgcctcttttgctaagcaggtacacttagtattttaccagttttcaaagcatttaattatatggtaagactatagccttgcataaaattatttaatttgtaattactataataatgtctgactcttataatgtagaaatgtcaaaaaataagaaaacaaatgtacattaagctagctaccaagatcaccatagcatgagaaatcattctagcatttattaaataagtaaatgttcctgaattcattccgagattcagtttaggagttaatgttttatttcaatgaaagtaaaataaaaaattctgttttcctaaaaggcacttgagagttgcttaaaaggacctgacacttacaacagtcaagttctgatagaagctacagtaatagcactaaccaaattacagccacttcttaataaggtaattactgtatagaaaatgagtgcattcattttgggtatcagtgttgaatgttactttctttcaaagagtttagaaaataagatgaattgagaataagttataaagaaaaaactatagttaaagtagaacctcttaaagtttagttgtttgaagtagtcatattagaagaagagtaagtatggatagtatgttctcaagcgcttgtaagtttttggtctcatcagtgctaaaggaaagataggtatatattcttaattattttatcttataactattaattatctgctattgccaagtactgttttaggcgctagagatagagtactaacaaagcccataaaactcactgccttcatggagcttactttctggggtgggtgtggaggttggggagtgaatggataatgaagtaaacaaaatacgtagtatgttagtgattattactatggagaaattaaagctgggagaagtatacttgatcgtcataagagtttgggtgccaaatgaagattatatttaaaaggagtaaaatgaagtggccactgttttaggatggtctgaccttatcccatttttatatttaagatatctggaaatcatgtttttgtattaataaaatgaaaaagattcgataatggcatggtattaccatccagttctaaagtggtttaattctgtgatttgagtacaaaggtatgccagacttgggagaaataacagagaaataatacctgttatattcctggtttgtctacaagcattctaattttgtattatacaaaatggttctctggtccccatcttctaagtgaaaatgagctcagaagggctaaataacttgcccaaagtcacatacctaataaaagaaccatgattctaatgtgatactatttgactctaaagtccatgtattttccctaatatcacagtgctaagtaaagattgccagtaataaatacttttaattcagagcagcaagagattaccatactggttaagagtgacaagaagttgaaaagacagtttaaaataaagttaaagggaaacataggagttaatgtaggtagagagaaagggagagagctgcacaagaatgccaggacaatggagggaaggtgggtagaacattctagttgtaatggagaagcttttcaaaggaatcgagagagggaaagttgtgaggactggatagacctcatctcacattcagcattgttcaaaagagtttggaaatgtacagtttttaagcagacaagtcatacgatgaaagcaggacttagctcctggtggtagtgtgcacagtggattggagtagggagaaactgaagtaaaaagaatccacctttataataaagaaggttggcatgtggtaatgtcattagcaataagaaagaaatgacaaaagatacaaaagagactactctagaagaatcaacaaaccttggtgactggatttagaaatcaaagaacagggagaagtcaaaggaggtgctaagtaacgttctcagtccagctaacagtgtctttagttatacatatggaaaagtgaagagcttactcatatctttatcttccccaaaagagaaaacatgggtaatttaggaagataagctgctttatttttaactgcagtgtgttttgaaagagactatgtcatgattcatcttactagcctcaaacatatcttctttgccaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaaggtaagcaaactttgccttgaggttcctagattactcaaatttagtactcttccatcttttcttgttgctattcttttaaaatcacaagaagtccataacttaagtaggaatttgtataatgtaacttattgtgagtatatttccttaccagctcataaagaactatgtaaacttgaatgcatattttttacataaaaatagcaaaaaaaaaaaaacaaaaaaaaaacagtactggcctaatactagtagaattacagaataaggataaataatacatgatcatccttacagaatgagcataaacaatacatggtaataatattaatagctaccatgccaggccgtatgctaaacactatacatttatttttaattttcataaccttaaggtaaaggttagcattctctgccccccatttcacacgtgaagaaataatctaaaagtaatcttagttttacttaataatgccacttaatgaaaaatacgtataattcatagtagataaggaagttggagagtctaaaggaaacttttgggtacttaattttactagtttttttattctgtctaatcttactttaaaatataccattagtggccaggagtggtggctcatacctgtagtcccagcactttgggaggccaagacaggtggatcagttgagctcaggagttagagaacagcctgggcaacttgcaaaaccccatctctacaaaaaaggcaaaaattagctaggcatggtggcatgcacctacaatcccagctactcgggaggtgaggtaggaggattgcttgagcctgggaggcagaggttgcagtgagctgagatcacgccactgcactccagcttgggcaacagagcaagaccctgtctccaaaaaaaagtgtgtatacatatattacatacacacatatatatgtaatgtatgtgtatatatatatataaagtgtgtgtgtgtgtgtgtgtgtgtgtgtgtatgtacacacataaaatatgtaaaatccaactccaattaaggttaataaatgttaggaggggtgctaatggggtgtgtgtgtgtgtgtgcacgtgtgcatgtgtgtgtgtatatatatatgaacatgggcaaattacttcttagttcctttctaatttgtaaaatggagatctaattggggttggattttagttcatagagaatagaggagagaataaaatagtatgaaattacgtcccttttgtctttggataaaaatgggaagggtctaggagaaaagaggggaatgtttttaaaagaatgtgtatatacagtgagatttgcttgaagtgaaattaactgaactgtgggtacaaagaacaggattatggttttaagtgtaaaaagatacttggtctaaacattattagttcagtctaccagatgtagtgtgaacctggaacagatatgggtctgaaaaatatagaagcaaaattttagaggtaagaggtcttatggagtttattaatcagacctccattttgcaaattagaaaggaactaagaagttaagtaacttgcccatgcttgtacatctgttttgggactagaacccctctgtcctaattctcattgccgtttttctaaaactgttttgggacagtggtggtcagcgatatctagttgttggctatttatatgttaagaatatttgcaaattggccgggtgcaatggcgcatgtttgtaattccagcactctgggaggccgagttgggaggatcacttgaggttaggagttcgagaccagcctggccaacatggtgacaccctgtctctactaaaaatacaaaaattagccagggtggcacatgtttgtaactccagcgacctgggaggctgaggtgggaagatctcttgaacccaggaggttgcagtgagccaaggtggtgccactgcactccagcctgggcgacagagtaagactccatctcaaaaaaagaatatttgcaaatggagcattgcaaatggggcatctgcctcggtattttcatcttcaaaacagcccagtagcgggagctaatattgattctagtgccctttggatgctaggcatcagagttaataagcatgttaaaagtcaccgggatgtaaattgacagtcatttattttgtattgtaaataaaagtgatttcatcttccaccatcttcttatttatatgcttgactgtcttgcaccagttaatttgtagtagctaaaatgttctgtggttttctgcagtcaactgaaaataatttctctcaaattgaaaggattacttatcttgtcatactattgaacacaaaattaagtgagcctttaaagaaagctactgtgtgaacctcatcaaccatctcatgattatctttaatagagtccagaggaagtatttatggcaatccggaatcctctggagtggcactgcaagcaaatggatcattttgttggactcaatttcaactctaactttaactttgcattggttggacaccttttaaaaggtaaaaaagccttatttagaatatttttatgaagtagtattaagaaaccagaagtaatttgaataagtgattacttgaaataaattgaagtaagttagcccttatgtcttactttaaatgcaaactaggccaggcgtggtggctcacgtctgtaataccaacattttgggaggctgaggcaggaggatcacttgaggctaggagtttgaggccagcctgggcaacatagtgagacttcatctctacagaaaatttaaaaattagccaggcatggtggcacgtgcttgtagtcccagctacttaggaggcatagatggaaggattgcttgagcctgggaagtcgaggctacagtgagccgtgatcacaccactgcactcagccctaggtaacagagtgagactttgtctcaaaaaataaataaataaatgcaaactatatctgtcttaatgagttgtgttttattcaatatgtgttttaagagagcttcatttccaattcaaatatcaaatttgcctgaaaaacaaaagagtttattctggctgggtatggtggctcacacctgtagtcccagcactctgggaggccaaagcagaaggatctcttgagcttaggagttcgagaccagcctgggcaatatggtgaaaccccctttctacaaaaaataaaaacattagccaggtgcggtggcacatgcctatagtgccagctacttgggatgctgaggaaggagaatcacttgagcccaggaggtcaaggctgcagtgggccatgatcgtgccactgcactccagcctgggtgacagagtgagaccctgcctttaaaaaaaaaaaaaaaaaagtgttgattcttacaaaaacctacatactgagtctgataatagctatattaatagtaacaatacctaagtatcttactgattttcaaaatgaaacagactgcaaatcactaagtgttatttgaataatttatattagaaaatgttaagagatttgatcacagattttcttcaacttgtttatagtttattgttgattaatactattattttataccattgtacatcacctttctggcaccctattctcacccctttctatattgcttatagccagtgatctccagctattcctcagagcccgctcattcacttcctaacctggttttactccccattgctgacttcacagcttgttaactttggttcattaacatggggcagtcatggccagagactgcagttaataagaacagcatgtagtggtgggtcagaagcaaagcaggataaagtaagacctgggataaggagctggcatgaaccccagtggtctcagaagtggatttggccacaatagagattcaagctatagcttgagtcaacaattttgtattaatttaaatcataggcttgagggaccatggagattctcccagtttttatgagagagagagagatatgcatacacccactattgtgaatgtatgcatttgatttcactttcttatgaaatttctacaaaaaatattgacagtgttaatctctaaggtcaatggggatttctcaaaaaatactaccttactaaaggataccaagataagtaattgtaactgggctaataaagtgcttaattattctttatatctaaaagaataccaggctgggtgcagcggctcatgcctgtaatcccaacactttgggaggctgaggcaggtggattgcttgaggccaagagttcaagaccagcctggccaacatggtgaaacccctgcttgaaggcaggagttcaagaccagcctggccaacacggtgaaaccccatctctactaaaaatacaaaaattaggcaggtgaggtggtgcaaacctgtagtttcagccactcaggaggctgaggcacaagaatcgcttgaacctgggaggcagaggttgcagtgagccaagatcctaccactgcactccagcctttgtgacagagtgacactctgtcttaaaagacaagaaaagaaaagaagaccagatactttccatgttcaaatcacctatttttaaatgggggaaggattaatgattaaaagctggccaaagatcaaatttatcctctaatcaaccctatttattgggctcttagagcatatacttcctatgtcatcagcttttcttttaattaaaaatgtttttgtattccgcctgcgactcggtcccggcgctgggctgaggggaggggttgtcttaaaagtctctccttccccctgtaggggcggccggcgagtcccagtgagagcggagggtgccagaggtagggggccgagaaacaaagttcccggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaataggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccattagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaagggtggtcacctacacatgtttaaggtgtctctgcacatgtctcaagcccatcacaagaaagcaagtacagtgtggatttcaaatggtgtgtaacttcagctccagctggtttttgacagctgttgctgtggtaatattttttacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctagtcttgagtgactgtgtccacagttcatttttttccggtaggaataactccttttctacatccacactccatagagtctctccttttcagacatcctgggatgaaagaatttggcttttttttttttttttttttttacatctgttttcactcttaggcttttaaacaatagttattgctcttatccctctcagattctaataactgagagcgatggggctatattgaatctctgtatgcactgataactgagctatgaagaggatcttattaaactgctggtctgactctatggattgacactgttcctttcttttattgtgaaaaaaaaaacccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttatttttttttctgttccaaagattcatcctatggggtggccataaagtctagaattagatactaatattttgtcattcattataacatatcgataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagtcttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaggaaaattgcacaatttagagtagttatgccatagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcagttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttaaaaaaaaaaatgtttttgtaaaagaaccctattttcaaatgaaatcttaaggagaattataatacatagatttttttttttaatctctgtgctgctttagggaatagaagatctgaaagactatcatgttttttaattttcctcttcctggagtactgtagagttctagggaatattatattctacacatttttggtacttaatcttatacataattaattattctcattcacatatgcatgttttaccttcccaaatggctattcttggaaagtaggagttatatttcctttccttgcagagttgttagtcagggaagaagacctcagcagatgcttgttcaaaaaattaattcttacttgtttgtttgtttgtttgtttgttttttgtagggtacaggcatccttcacctgctattgttgcaagaacagtcagaattttacatacactactaactctggttaacaaacacagaaattgtgacaaatttgaagtgaatacacagagcgtggcctacttagcaggtaaaaacacaaaataaacaaaattaatcttgctacatctatatataaggatcacccaaaaagtacaaatacctataggttttttggcggttgcgtggcagagcagaaagttcacagtctagtcctttagtggtggttacaattttgagagttttgccagaacatttttctgtaggaaaaaatttaattcccattaaaatctgaaatgtgttcccttggtcatctttggttcaagacactacagtggctctctgttatctgtcataaaatctgaatgcttcagtctagcaccctgggtccttaaatagccctctcagttctgttatctttctctaaatttcatgagcctcattttttattaccactccaaatggatgagctattttaagctaatctacttgccatctcctacaagcaactgcctcttcaatattcattccttatgtcattttatctggagtatctgccctatccccaccattccattaaagcttcctatttgctcttatctgatttttgtttctctactcagcaacacttagcacttatgtacaatacaattcttgaacatagttgtttgatagaaagtgctgattctcagtttcacagacttgtatttgttcaacttttttgtttgaaccgtatcatcttgagcaaatcatttaacatctcagtattttttctcattcagcttaataatacctgccctgcctactttgtgtttgttaaagatcaaatgtatattaaagaacttggaaaataaaagatgcttattaaatctctctgtatatttcacatttatgtagtcttccaaaatatgtgcacatttaacaggtactatgctctttaggagactgtaagaagttcatcctgttttaagtcacacttgtgatttgttaaattttttaacctgccaccgttttccttttagctttacttacagtgtctgaagaagttcgaagtcgctgcagcctaaaacatagaaagtcacttcttcttactgatatttcaatggaaaatgttcctatggatacatatcccattcatcatggtgacccttcctataggtaagtggatttactctcctataattacataatcataatcaagtttcaattttccaactaatggaggcaagcagcagagtaatctagaaggtaacatgggagaaatctagagatggcctaggaagagtaagtgaaactcattttataaatgtgtggtattttatgtgggttagtaggaaagttattcttccagtctgattgtgctaatgttaacattagtttgcctctgaagcacagaccaaatgaacaatgaaaagagatgctcttgaaaatattaggttgcaggggaagggcctggggaaaaaaactaacgcgaaatataaacaacacattacgtgcttggatagagaacgaatctatacagatttgtaaaaatacaggcatgctaacacatttgttgtatttactcatatcacacaagttatttaaaagttttctataatgtagacatagatggtaaaaattatatctgctatacatgggtttgggtagtatatttttcagtataatttagagaaatttcatgaaaatggcatcattgggggatttttctgtattttcaattaaataaaaatatctttaaggtttagggacagtgttgaacacagaaaagttatcttctgttcgcaaaactcgtatcattccatttatcaacatcctgctttttgataaaaagacttcaacaatttccttaagattctaacaatgtacgcaaaaatttttcaaacatggtattcaatagtcttactttcgtcagtcccattattatattactttgagatatgccctttttgttatagaaagggtaaaatagtttgcctgtgttcccctgtcaaagtataaattaatatctgattttcttggtttttaaacaattgcctatttagacttaattttttctgatttaaaaaaaatcagtgcaataagttcaaggtcttttatcaacataactacagttaatgtattttatacttgaaaatagctacgagtagattttaagtattctcaccacaaaagataaatatatgaggtaacacatatgttaatttgcttgatttagccattctacaatgtaaacattttatttatttttatttttctttattaattttttttgagacagagtcttgctctgtcgcccaggctggagtgcagtaacacaatctcggctcactacaacctccgcctcctgggttcaagcgattctcctgcctcatcctcccgagtagctgggattacaggcgcgtgccaccatgcccagctaatttttgtatttttgtagagatggggtttcaccatgttgggcaagctggtcttgaactcctgacctcaggtgatccgcctgcctcggcctcccaaagtgttgggattacaggcgtgagccacagcgcccagccaatgtaaacatattttaaaacatcatgttgtacaccaagcttgctcaacccatggcctgcaggccgcacgcagcccaggatggctttgaatgcagcccaacacaaatttgtaaactttcttaaaacattaagtgattttttggggtttttttttttttttaagctcatcaactgtagttagtgttagtgtattttatatgtggcccagtatattcttctaattccagtgtggcccaggaaagctaagagattggacacccctgttgctatacctttttatttgtcagcttttaaaaattgcagtacagatctttttgttcagcatttggtgagtacctactatgtgcaagatactatggcaagaaagttgataattcctagggatacaccaagagtttgtatcctaaagccctttaaagtgcaattttaaaattaattgattgctgttgttaggaaataggacagccacttggaaggagcaaacgatggttgtatttgtcaccatattaattgatttttctctattgttttcatctttcaggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggttagtttatctaaattatgtagattttttttattatttaaaaaaatagatatttttactcttggaaaattatttgaaatttcaggattatcaaaattttccatgtcagtgtagcaaagtttttgatgccatttaaaagagagtttgatagatcagttaagcattataagttgagatagagaaatgagaatgggaccttgaaacagttttttctgaatcttatactaaatattgtgactctccttattttgttttgcctttgctggccagcagggaatgggactctgagacatattagataaatacctataagaaaggaagagtcttgctgcactcaggggatttaatgatatactgtaatacttcccaaaattatcatctgagagaatatatgaatatggtatgaagctgtaatagtactatttgccgtgctttctttgaaaagacaaaaagacatgcttctcaattaccgaaagaaaataggattcttttttttcttttttcttttcttgatatgaagtcttgttctgttcacccaggctggagtgcagtggcgcaatctcagctcactgcaacctctgcctcccgggctcaagcaattctcctgcctcatcctccctagtagctgggtttacaggcacacgtcaccacatctggctaacttttgtatttttagtagagacagagtttcaccatgttggccaggctagtcttgaactcctgacctcaggtgatacaccctcctcggcctcccaaagtgctgagattacaggcatgagccaccatgcccggccggaagataggattcttgaaattaagattgctcagttacatcaacatttatagaatttttgtctctgagaagtacacctgaaatgctgcgagactcatttccattttagtaactgaaagtaaatgaatgaaaaaacccactaggccaggtgcagtggctcacgcccataatcccagcactttgagggactcaggtgggaggattgctcgagtccaggagttcaagaccagcctgggcaacatgacaaaacccatctctacaaaaaatacaaaacttagctgggcatggtgacgagcacctctagtcccagctacttgggaagatcacttgagcccaggaggtgggggtagcagtaagccaagattgcaccactgcactccagcctgggtgacagagtgggaccccgactccaaacaaacaaacaaacaaaaacactgatcttacatcgctcctcagaggaaatgcagagatgttcttgcattccattgggtaaaattgtaattgttactggaatacattaggatctgtatttcagtagccagcactgaatggttcaacagatttcagttatccatgcaaacatatttaagtatctttaggtattggaaaaatgtttgtgttcataaggaaattagtgaacaaacaacaaattgtaacataaataacgtgccagtaaaccgtgaaagaaatagaaaccatgaatgtgtcaatcacagttactagccacataggtgtgttactgttgtttgagttcccttctgttagtaccttgccataaataatcatttaggagtttcctggttactttgtgttttgtaattctggattttcatgccaatgaagttgtaaatgaaaaactaacctcagaaaaaaatatattgaattcattcaacccatgtactaagtgaaaaagataaggtaactgccctggaagactttgtaatttgtgtccaagacttataatcagccaatcacaacagcaactccaggtgccattaaaatgatatgtcttgatggagaaagctggagatctggggaaattagaagaaaaaaaactgcagagaggagataacatttgggctgtgtcataaagatttaatatatgcttgcaaaatagcaggataagtaggggcatatgtttaagagcagtggggaatagcaagaataaagaaaaggcaggaaagcaactgatgatacatcatggcatcatggggaatggggtaggaaatgagatgagaagaaggactagaactcgattggaaacgactgtatgccatggtaagatatttacccttatcacacattcagctgaggtatttaagtaggagaagaacatgaccaaattttaatttttgccaagtttttctagcagcaatgtggagagacaggaagagatttttagcaagggaaccatttaataaaattgatatagcagtccaagcaaaaaaaatggtgtgggccccgcactaatgcaggagcaatgggagaatggagaagaaccagcaggtttggagctgggcataatggtacacacctctagtcccaggaactcaggaggccaaggcaggaggattgtttgaggctgacctgggcagcatagtcagaccctgtctcaaaaaaaacaaaaatcaggtttggaataggtttctgaagtacaatggacatgacttagtgaccaattgttgcaggtggggaaggggagaagactgtgaaggatgtcagaagcttttagttttaaaaactgtctagatagtgataccattcatagagatcaggactaatacgttcacagtacatgataaatttaggttgattacatttgatatattttcaagacatctatgagtatatatctaagagataaaccacaagatgtacctggaattcgggaagaaagtaaacaagtaaacatttagaattgattagctcacagatagttgaagctatggaagcagaatgagatcttccaggaagaatgcagagaataaaataaaaaggacaagtgagaaaggaaggaaaactaaatgtagaaagtagtgtcccaatctcatgtactttggaaagcactgactggttttagaaaacctgagttttccatctggtcattgtctagatccctagccatgctacctcagactaattacttaactgctcatggcttcatcagtgtacatgtgcatgaaacgaagaagccggactagatccctttggactgttaaattatttggccttggtatttatgactattatgaatagttattcatattcttgaggtaatagactttgtatttctcaagtgttaaattgtcagattttattatattggctttaattctggctttaataaaataatactgttggccgggcatggtggctcatgcctgtaatcccagcactctggggagaccaaggcaggtggattgcttgagcccaggagttcgagaccagcctgggcaacatggagaaaccctgtctctactaaaaatagaaaaatcagctgggtgtggtagtgtgtgcctgtagtcccagctactggggaggctgatgtgggaggatcacctgagcccaggatgtggaggttgcagtgagctgaaatcatatcactgcactccagcctgggccacagagcgagaccctatcaaaagaaaaaaatagtgttaatacatgattacatgattagagaaactaaaagccaaatgggagataatgctacttgctatttttgaagcatctcccagtgtatctggtttttagtattttcaggcatgcatatctttttttcaaagcttaaaaaattaaaatcaaactctgctttcttcctaagcttggaaattactcatgtattaatgagtagttcttggcaccagcagcgtttcttaaactgaaaagactggtcagacatagttgacctttgctactgaataatgcctaccattgcatttattatcagttatcatatttgttgatttacctccagtgtagtttggtttacctccagtgtacagaatacaatctcagtttaatttgcaccagtaaggtgcaacctatcctgaaacagaaagctatgggaacaaaaccctttgagaagatggaaaataaaggaaagaaactgctccagggatgtattagagctttctttgagtcctcagtgaaagcttaaacactttatgtccaaacattttctttttagtgtattcccatttatagacactgtagttaatgaacttgcatattcttaacttttgtttataggaacaaggaaaagttttgatcacttgatatcagacacaaaggctcctaaaaggcaagaaatggaatcagggatcacaacaccccccaaaatgaggagagtagcagaaactgattatgaaatgggtgagaaacaaagtattgatctagatcattgaaaataaggtgggagagtacatgaaagtcatgtttattttccagccatttcttagaatctttagagtgaaatatagaaacgtttgccatttctcaaaagataaactctaccattcaagacagttatcttgaagcttgtgtaaaaattaatcatatatattatatacagcattgtaaataggtagccaaaacttttgtgtaggcgaatagtaattctctatgatgtttatgttagtattttaagtatctactaaagaaagctgttgaattttagaagtaacattgaaatagttaggtgaagtgattatccaggtgtttgatcacgttaattccctatcttgctgcagaaactcagaggatttcctcatcacaacagcacccacatttacgtaaagtttcagtgtctgaatcaaatgttctcttggatgaagaagtacttactgatccgaagatccaggcgctgcttcttactgttctagtaaggatttcccctttttgagtcccccaccctcaaatttttattccagtctacttttaggaggcccttaaatattaaaaacatgaataggatacagtcttctacttctcacccaaacagataacaattcagccacaaagtaaaaatgttgtgtgtttacttttttgcatcttggcaggctacactggtaaaatataccacagatgagtttgatcaacgaattctttatgaatacttagcagaggccagtgttgtgtttcccaaagtctttcctgttgtgtaagtatctccttttgattttaattcaccttcgtgcctgtctttaagttaaatgcttacccagtaatgtgcactggttgcaaagagggcaaaatgagatattgtgatagtgattttagctttgagacagtaggtttaatgagggttaagattagttttgacctattagatctattagaaagtttataaggaaagacttttaaaaaatctggttgatttatttaagtggtttattttgatgatcattgctcattttcctcacttagaagcaaactattagactgctatatctaaatcagcatatctgttttggtttactttttagtagagcttttgtatttatccacagctgagtgaaaacaaaattgaccttctgtttaggaggtgaattgtttactctctcttaaggactaaaaaatattaacctcaaagtgttcaaatttaaatagttcaaataaattcttttcctgatctaggccttctatatcatgtcattattttctttttttaatctcatgttagaattttagagagttagaactcagttatttttattaatggagtgtagccgggttagaaataatttttttcctaagtttcagttggatcatgtatttcactccctctaaactattttgctttccctatttgatctgactcagcattttaaaagcactgattaacattaaatttaatttttttctttttgttttgcacagatcctaaatttagttttaacttcctaagcgcatgtcagtatacaacagatggaaatagtactaaaacatgctaagtagcagacagagccaaccttgtcttaagcaaacatttaccgtatatggttacacatggttatatgacactaccagttgtttgttttcacaatttcttccctggtgactaaaaacaaaagacaaacaaaaacagacacacacacatgttcattgtagaaaatttggaaaatgaagaaatgccccagaaagtaaaaagcactcatctccctttaattttggcacattattctggggaatgtatattatgttttccactacatattttcatttaattttcctctaaaatgttcctctgttgactttttttttcttttaggcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagtaaataaatgtatctggagaaggatggttgatgaacttgctaacatgcgcgctgttgtagaatgcactgactacagaattctttataagggatagacttgttcatacttttatttccatattccatttttttactctctcaactgtatgtccaatgtaactggttgacaactttttatgctgagtatattttaagtaggttttagttgctttgacactcattctaaaaacatgttttcaacatgtacatagggtttatatatcatcagctatatgacttatttaatttctgttacaattaaaagataccttgcttgttataagagtaaaatttgatttgttgcaggttttggttttaatggcttgtggcggtttgcaggaccgttttcaaaggtaagaaaatatatttttctctaacttttggcaaaatgaaggtttctgttcaaattagtatgcctgctttaagaacacacaatgtgctgaaaaccagaaaaataattcacaataaacacatatgttacttttataaaaagtttctcatcacaaggtttttttccaggaggcagcatggtgttggggtgtgtgtattcacttttacaaacaaagtcaacttatgatcaatttttcagaagagtatgataaacctctgtgatacttttctgccacagtcccttgtgtatttgataatcttaatgcacacagttagatatcttatgactagcaaggagcattaccatggttaaaatctatttcatgaaaacatttttatttccagcctattagattagattaatttctctctggatttgtcctcatttgctcttattcagtttttttgtttgtttgtttgttttgtgagacggagtctcactctgtctccaggctggagtgcagtggcgcaatcttggctcactgcaacctctgcctcccaggttcaagcgattctcctgcctcagtctcccgagtagctgagactacaggcatgcagcaccacgcccagctaatttttgtatttttagtagaaacagggtttcaccatgttggccaggatggtcttgatctcttgacctcgtgatctgcccacctcggcctcccaaagtgctgggattacaggcatgagccaccgcacctggcctcagtttgttttttgattggcattagtttatgtagtgctacataagatgtatatgatcattttctctgtatgtgggctctctccaaattgatcaaagttccttgaagacagggtttctgtttcttccttaaacagttcctggtgcagtgttttagatacagggggtgctaaatcaatatgaattgtataaaccttgttccagtttttaagaattgggtattttatttatttcctttcactattacttgaatatctgtcaacatgcaaaggttgtcacttaaaaaatgggcctgaagttacagaaataagtatatcatacagaagtttttgcatttggattgccagtaaccctctgagccctttacagtgtctagtgagtggaatctaaatggcagctggaatgatgatgctctgctcattttctctgttttggaaaattggctagacatcattcctggtgattgtattgtctcagtattacattcagtctgtcttgtgcatggctttcagaaaatgcaggttcatctggaagctttaagctgaatagaactccctgttgtaagtcctatggtagtctataaatattactccactccccttttttaatgataagtaatacaaaggaagaaaaatagtaaattaagtccaaacaaaattaatatttttggcttcagatggggatttacttaaaaaaaaggaactaaaataatttcctattttccattacagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggtcagtaaatgtgatctttatatgactttgagcaacaatataagacaccaacattaggaattcccttgtgatcagtttatagcaaattttgctcctttttcttatgagattcaccttacatttcttctttaccttgtaactgacttgacttttgttattctatgaagctttctactttcaaacaagttgtacataagacagtaaaatgttaaaatgtccacatgatattccaaggttgacaagtttgtagagtttgggcaggaagaggaacttaaaacacattattctgtaagtgaacagaactataatttatttactagatatactaacattgccctaagggcctctttctctgtctctgatacagcatactatatcaaaaaaaaaaaaaaaaaaaaaaaaaagaagaagaagaagaaacacaaaatctattaggtacctcactttcctgctgccagcaataactcaaccatccatagaccatcctgaaaatctggaagtaaataaataatcaaacaaaaaattcatctcaagaaaataacatcttaaagcccataagcatatatataccaattcgtaatgcaacttagatttgaatacactgagaaatactaatagctaatagctccagtgggactgagataaacaaggtgggagaaatggcaaacctacagaactctggacttattcagtgtcatagtgaatggtttcatacaactctggttgaccctggaggtgctattcattatagaacttaaactattgtgtgtgttattatgacagtgagtaatgaaggaaagcttttgttatggttgtgttttctatttagaaagatattcttctaaaatggttaaaaataaaagaaactttagttgtttaacgttccattatctgaaaagttcacttatgaaacacatcattgtataaggaaaagttactatatatagttcttttaagtgttagcataaatttaaaaaaaatccaatgacataactattctgtgatattcaagatcaataaatagaattcccagtttatgatctcagttttgcatgaacatttcaacttatgtaattttgaaggttctgaagaatttggcaatacccaattcatattataaactattatgtaattaactatattctattaaattctgcttaacaacaaagctttggtcagcagaggaaacaaattttatttccacatttgtcagtcgccttacaagtaatccttttttcccccagaagtaagagaagtctaactttttttcccatgtaacaaggtttgtttgccctctgccactaactctctagtacagtgtttctccacgtgtgatcccagaccagcagcatcatttgggagcttgttagaaatgcagatgctgtagtttcacctcagatctgcacaaaaaactcccaagtagagcccagccagcagtcagtgtgttaataaataccccaggcgattcttacacacactagaattggagaagcactgccctggggtctgcttctggtcttgcccattatcagcatttcagctgtgaaggccagggcaaaacttaaaatttactttttttacagatactgcagccactgaattccttcctgcttccccgctgataaaccttttagcattttggagctagggaaccatacaggtaatttagttttaggctcacaatattgtgtacattggggagactgaattttagaagagctgggttaactgctttatacagttcttatctagaaccaaggccaggcccttttgtactacattcattgccttccatggctgttgtctgtttgattatctatctactttcccttctccttctttatttccttgtttttgtttgtttattgctaattcattacttctgtctgccttgccttaagcccaccagttcttttttttctgttggactattttctgggttactgaacagaagttgaaaagtttttaaaagtctgcttcatcttaaccaagcttttgccttttgggctactaaactggtgttaaacatgtcaaaaatggttagtttttttattgactttttttacccagtctaattgtagggaaatttctgcctatctttgcccactaatggagacaataaaataatctggatgagaataaagaaccattacaggtttctctgctatttgattagttgcatatgtccagtgttgattggctatttgccaaatcatttgctttggtgaaacagtcttactctacaaccttttacttaaaattgtttattaaaatcagaataggttttatggctttggttccagtttcaaactaatggtgtcacctccattagctctccaaagttggtgcctttattcaggctggaaatctctgactatacacagaagagatgaggaggtttaaaagtaatagagttaagtggtattgtggtgttcaactcttcctgtcactcaattgtgtgtcattggtttgacagtttattttactacatgttttcagagaaagggtttatcttttcaaaagtaaccttactctcccacaaaacccatttgtatctctaaattacaggctcatgttcacaaaaggatcccaatttatatgcccaatcactgagtttttgtcatttgctcttacagaataactcttaatggtaagagttgatcttttgtttataattaggtatattgcttcatatctttagctccatgtaatcttatatccttatctctctctttttttttttttttttttgagacagagtctcgctctgtcgccgaggctggagtcagtggtgcgatctcgactcactgcaacctctgcctcccaggttcatgccattcttctgcctcagcctcccgagtagctgggactacaggcgcccaccaccacacctggctaattttttgtatttttagtagagatggggttttatggtgttagccaggatgatctcgatctcctgacctcgtgatccacccacttcagcctcccaaagtgctgggattacaggcgtgagccactgcgcccagccttttttttttttttccccctttggagacagtgtctcgctcagtagcccaggctggagtgcagtggcgcagtcttggctcactgcaacctctgcctccttggttcaagctattcccctgcctcagcctccctagtagctggaattacaagtgcacaccaccacgcctggctaattattgtatttttagtagaaacccggtttccccatgttgaccaggctggtctcgaactcctgacctcaggtgatccacccatctcagcctcccaaagtgctgggattacaggcttgagccacggcgctcagccatctcatttctttatggcgttgagtttgcttatatcaaaaaaccaaaagaaagttgtccagattcctaactcagtctggcgtttcaactttgctgtttagctgtatagaaaccaaaacatttccttatctccattcccagcagccaagtctcaagcagtagtattgaaagaagttctctgtcattccccgatatggagcataagtttgatttaccatcaaattacccaacatcaacctatacttagtcaactgagatttaaacagataaaggttccattgccctatttcaaaaagcaaatgttgctgatctgcacgcattcaatcctttgctataaatgtttcatgtcaatgcaaaactcttcattctagatctttgatgtttagcaggatcagctactgagctgtattttcttttgtccaacattttctactagcaaatcaacaaaataagagattcatgaacctctcctcctccccctcctgccccagcattaggtcttacttaaattaaacatttgggcagtatttcgttagttaccagctttgaggagaagtggtagtcacttacataaagcaattgtctctgaaaatgcattcttcttgacaaattagcatagcctaattctccatcctaagggggactgttttacaagtctacatataaaagtacctaaatggttgtcttctgaatccctccctagtagaaattgaatttggcatcagtggagccagtgactgtacctgggattcagtgcatatagaattgcattgactgtgaccctttaggcaaatggatgtaagactttggctcttaggattttcccaaacaccaataagagcatcttgaagagaatccatttactttatgatatataaggatatttcaggtttgatattatgatccttattaggtccagtctagctgagctggacatgaattgaagaaccagaattagaactagaaaatgaaacccaggctgagtgcggtggctcacgcctgtaatcctaacacttttgggaggccgaggcaggtggattgcttgagaccagcctgggcaacatgacgaaatcccatctctacaaaaatagaaaaattagccaggcgtagtggcatgcatttgtagtcccagctacttgggaggctggggtgggagaatcacctgagccggagaggtcaaggctgtggtgagctgtgatcatgccactgcactccagtcagggattgagaacctatctcaaaaaaaaaaaaaaaagaaggaaagaaagaaaatgaattaataggatccatttccaaagcattaaaatttaatatatactttatcagggtcttctgatattcttcagaggagaattgttgtaagttaattcaataaacatttgaatacctgttttgtaggtgtatgttaagtatgtattagaatccttgatcaccagagacttgacggtttttgccttgaaagttatttccttccgatccatgttgtttaacaaattctaagtgtgcactattttttttattttaaatacaagattaatactatagtgcactgtagaaaataccaaaattccagatatttatcctacatatatgtattgtttactatatgcaaggggctcttagaccccaggggagcagaggggctgccagggcatgatacctgccttcaatatatttcagatcagaacgggcagtagaatgtacatagataactattttgacctctattgtgatacctgtcatgttgtaccttgtactatatagtattctgatagttcaaagggacatttgtgtggaaggatcatgtaataattatggcaaaagttttataacacatttttcacctcaaaaatgtttttaaacaaaacaagtaaattcgtgatctatttaatttttttttttttttttttgagatggagtcttgctctgtcacccaggctggagtgcagtggcacgatctcagctcactgcaacctccgcctcccaggttcaagcaattctcctgcttcaccctgctgagtagctggcactacaggcacccactaccatgcctggctaatttttgtatttttagtggagacagggtttcaccatattggccatgctggtctcgaactcctgaccttgtgatcctcccacctccacctcccaaagtgctgggaattacaggcatgagccaccgcacctggcctaaaatttttttttactaggaaaaaggctttaacttttttttgtttgatcagctcattttactgttagtattggtgcgtgaattttttagaacaaagacatacttagttcatcgttactttagactcccttcttccatttttatttctggccttggtccaagcctaccagtcattctctcactttgcttctgtaatgtagaccttcttcctgagaagctggctagatcaggtagtgatcataacattcctaaaccaatagtgctgatagctctgtgtacggagggatatttcatctaaaccattgctctaaacttagacttggctctgagtcagtaatacttctgtttactaggtttgaaatatctccctcttagctgggcacagtggcacatgcttgtggtcccagctactagggaggctgaggtgggaggattgcttgagcccaagagttcaagtctggcctgggcaacatcatgagaccctcgtcttttaaaagaaggaaaagaaatatctcccttttagaagaaacctagaagtctctattttgaggccacttaagatctctgaaatgattttaatgttttagagaattgtttatggtattacctgacctttttttcttgatttgttttctttttctttgttattatcctatgtttaagggagaaaaataattttaaattgagcgatttcttggtataattcttgctaatttttaaatctaatttttagcttaattcttaatttaaactaaaattcttaattttaatataagtggtaaaaaaatacatctacaaagttctaagttctatcatttatttaccaactgtaatatttaggaaattaatggtcagaattcaataattaaaaccagattccttctgaaaaccaaggaacattataattatctagtatctaattgtatttcacccttttttaaatcttatgaacatcacttacttgcttttttttcttccattctttgtaaagcttctctgccttgctctaaatcagcagttttcatgcagctgttccctcatcaaggtactctttattttcatcatctttgcacgaaaatactgcttaccccacactcatcctgggcacatagcatgagactttactcaccggtccctgtaagctcagtctgccttaggcactttaggaacttgtaaagccaccactttataaggtcttggtacttaacaggaattgcacggccagtgtgtggcctgtcttgtttaaggagctgctaatacccacccagaacaatgaagatgcaatcccatacctggactaacaaaggcaggttaataagaaactcaagagagagttaatagagaaagagcagaatacgtggtttgatgaagtttttttagcttagaaaataacttgttttccccaaatagaaagccaaccccagtgtttcctcagaaattaaagctggctgtctattcaatcacctgtggttaaaaaaaggaatatggccaggtgcgatggctcacgcctataatcacagcactttgggaggccaaggtgggcagatcacttgagtccaggagttgaaaaccagcctgggtaacgtggcaaaaccctctttctacaaaaaatacaaaaagctattcacaggactgaggtggggaggttgaggctttggtgagctgagatcgcaccaccgcactccagcctgagtgacagagcaatactctgtctcacaaaaaaattaaaaaaaaaaaatatatggtcattagttagctataaggactaagatgaaaaaatttgacacatttatgtctaatttataaaagatgccttttcttttattcacctgtaattaatatacaaaaagattacacctaaacagaaaaagaagtgctagcagttggtgaacgtcatttttaaaaattcttttttctttttgagacggagtctctctctgttgcccaggctggagtacagtggtgtgatctcagcttactgcaacctccgcctccccagttcaagcgattctcctgcctcagcctcctgagtagctggaattacaggcatgttccaccaagcctggctaattttttttgtattttcagtagagacgaggtttcaccattttggccaggctggtctcgaactcctgacctcaaagatctgcctgccttggcctcccaaaatgttaggattacaggcatgagccacaataccaagccaaaaattcttatagttacaattttttatatttagctcaaaataaaaatatttctaagtatatatttaatacgcctccatgaatgtatttactgtagcttaaaaataggctgtagctacctaagaagatttattctattttgtgcttatttatattagcttcactcattttacaaattctagcataaaattaaagtcctagtatttgttctaaaactcctttgtatcacctggtcttttacttcagatattaggagcatcttaatttgtggagtaattattttatctgtgtgcaaaaattcttcacatagattattttgtctaacaaccctttgaaatagacaagtctgctgttatccttaattgccagattaagaattacaactaaataagaatattgatccaaacaagtctcaaacctaggtcttctgacatgtttaagttctcctgtatgtaataagagttttctaataagtttgccatattgtatatgaaataaactaaatgcagagtaaggtaacctactagtgctcctgcacaggtggcaggagatttcagtttttattagtctgtcatttttgtagtataacttctcacaaattacctaacccatttttccttagcttttcaagagttaaaagcgattctgttgttttattatttcatgatactattataactgattatttcagtttgggaaaccaaaagtgttttttaaaaatgagtgactaaaaaattgtcaggctggagctacatcactagttgtaaaaatacacaaaccttgatacctgccttcaaggaactcatgttctagcagggaagatagacatctaacttaaataacaataatgtaatctaatccttttccccagctactcaaattcactgaattttggccaataacaccttctagttaggattttgtctttatctggaaccaccacaatttattgaaacatagtactgctgatatactgctgtacagaatgtccagctgtttctgctctgcatgtttgtaattggctgcatgtttgaccacagcatatctgtggggtcatttaagctggcaaatcaggaccacagaagttttagctttatttcctttgtgtggtagcctctgggtttctgtcagtcactttgtagttttgtctgtttgttgtccaccaaaggccagaaaggagagccaatgctttaggggcaaaagagataccagaatacaaaactttaaaggggttttgatgaaaagaagtgcagcaccaaggccttctcactaacttaaaatatggcatatagcaatacaggatgtgttctgtctgcattggagtggtctatcagataatctgagagtttttcctatgggatattgaggtgaaatccttcaccagttcctagagagatttctagatttaattttagaggataaaaagaaagaatgctgccaaaattcttagaagtgagaattatgctgagaaacttaaatgccagaactagatactatgatcattctgtttcatactaccttggctttttcaagatatattttggtgtaaacgtaatgcattttaattgtttttttttaatgactttccaagatttttgttagtttctcctttgatccttacagtaaaacatctttgctgtgaagttgaacttaggaatcacagtcacaccacatttacctatgtgtgatttatacagttgggtcactaagtaggaagaaaacatacattccaaaaacaagaatttagatgaaaaatgaatttgagaaaagaagtagaatatcaacttttgacatagtgttgaagcttttggttatgagggatggggctgacaagtcactcgtacttttacatttttaattaatgtgctcattaggaaaaaaattggaaaattcagaaaaataaaaggaaaaagttacccacaatcctatcattctaagatagataaccactgtttattaacattttggtgcatttccttccagtttcttttttttatatacttgaggtcatagtatgtgaacaactttatagcttgttttgtaccctcaacatttaacaggagataaataaggcctttaaaattatttgaggtttgacggttatttgcttcacaaaacagaaagtggaatgttcttagcacttttttgaagataccttcaccctagtgacttcatctacattactacaatttatgtaattgtaattctcaggaataacactgtgcccaaacagaagcattgccacccatgtcatgactgttttcccctcagagtaggccatggtctagtagtagcaagacacacaagaacgagccccagggtagcagattgctggcagagagtcacagggccttcctagtggtcatccatgcttcatgcccctcctgcatgcgggccagctccaagttgtttcaaacctttgtctttttaaggtcctagttttgcctgaatcttattttctattaaagaaacaactcagaattactggacttgaaacttgtaggccaaatgcaaatttgaggaaatggaaggtcaaatacgctgacaaattcataattttaagtggaggatgccaaagggaaaaaaaaaagttctatcttttcaactaaaaatattataccactctctggagatcagggattgcatgctttggggctctgaattacaggtatctagctatcacattttaaaatggaagtgttcagttcattcagtattaattgaaaataatttttcaatgtattgaaaaaataactagattttacaggaaaacaaaaatgaataataatgatctttacccttctcagtgcctttactcagtagaggaagatggatgtacaagttgtagaatcataggcaagttaatttaaaagcaaggaaggagaaagtagttctggcaagagacagaataatgcatcatgaaggaaaaggatatgagaaaaaaaaatatgggttgaattttatcttgtagagatacgcaagacaattaaaagagcctacacaaacatacatcccaaagaagctcaaggcacattccagagatcatgagcagctttctttcagttttgttatttcttttgtaaatagctctggagaggatgcaaataaatatacagaagagaatttaaatagaccagaattctgttacccagagaaaagttccatgaatgtttctagtcatctttctatgcatatgattagattagattagattagaacatgactagccttaaaaaatttaataagggttttaaaaaagatttgaatagaacagattttcagtggtggttcagctatgctcacctcctggagaaatgtcgctgatgtttttccttgcactcatatgcctgatgcagtgcacatgttcataaacagtcactgacaaatgcccatgttcctttgacagcagttcagattttcaagacagcaaatctctgttgagcacgtgtaaaccaggccacgtgcttacagatgcctgatactcttgagtcgaattcagagctgaatccaaatgaaagatgagtggctcctagagggaggtcatcccaagttcatttcctgttcatgagccaacaaataactaactgggtagatctatgtacattttctgtaacataatgaatacttcttgacttgaaatattactttttgtccaaaaatggaaatttttctattctaagatttaaaatttcaatatataaagaagaataaagtacaaattagctgaaatcttgccatacagaggtaaaatatattttttagtcctttggcttctgacagagataaaatattttggcagatgtttacccagccctacgccctctccccacagtgtgtgggtgtttttttcctactccaaaaattgtggtcatctttttgtatcagtaaatatcaatcagtaatgtacattttgatacaaattactaaaacgttctgcagctgtttgctttcccgccaaaatttatgccagcagtaagtataatcagtctaattttgggggtaaattttattgatgtttaacagaaaagttcacaaattgcaagttttcagcttagtgaacttttaaaatgtaaacacacttgaaaatccatcatctacatcaagaaacagaacattaccagcatcccaagaagccatcctcatgcccccttaagtcactacttccgcaagggtgaccacagtcctgttacccaatttgtaatctttcctaatgtgatagataaaaataaaaatcttattttagtttctggttacttttctgaagttactgcttagattatttataatattaattggggtggggtgcagtggctcatgcttgtaatcccagaactttgagaggccaagatggaaggattgcttgagaccaggagttcaagaccagccttggcaacatagtgagactctatctctagacagaattttaaaattagctgggcatggtggcatgcacctgtagtcctagctgtttgggaggctgaggcgagaggatagcttgagcctggaagttcaaggttatagtgagctatgatcacaccactgcactgcagcctgtgcaacagggcaagaccctgtctctaaataaataatcaatcattgttaggcccaggttttggaggtttaatctcctcctcaagagaaataaatggcatctgtttaaggttgcagaatgtgaaatgacttggcatagctgaaaagaagcaaagattctacagtatgacctttgtgatatattattttctcagtaaatagtttctttgggataggcactgtgattaaaaaaataaaagcatcttgagttttctttgaagtgacaaatttgctggaaagatcagtactttctgctgctggagagtatattctgtttataaacatgaatgaggatgtgaataaggctagaagatgacctctgctggaagtttctggtatgatttggaggaaggagcactagtcttccctggtggctgctagcctttcatttagttcaagcctgccagcctctagcttttccttgcaacttgtcttttcatttttcttgtgctattttctgctatgatagcaaactttgcataacaaaatgtgaagttttccatgtgacattaacttagtaaacattttagcaattgactattaaaatgaaatgtgcataaacaatttgccaggttgtatcttatcacaaatatagtcatgtgctgcataacaacattgcagtcaacaacagaacacatatagacagtggtcccgaaagattataatactgtatttttactgtaccttttctgtgttagatatacaaatagttagcattgtgttacaactacataaagtacacaatatggtaacctgctgtacaggtttgttgcctgggagaaacaggctataccatatagccttggtgtgtagtaggctatgctatctaagttcatgtaagtacactccacaatatttgcacagacaaaatcgcctaatgattgtttcctagaatgtgtccccgttgttaagcgacacatgactgcaatgaaattcagtcctggaaggaaaagaagaagtaactggctgttctctttttctccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaagctgccaccatggtcttggctctcccacaacccagtgtttctggggtaagtttcacagtttctaggccctggaatagcaggcagtgtaatgcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgagtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagtcggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaagatatgaggagttatttaatttcttcagatgtatcgagctctgttttcttccccccgagtcctcccaatcttttgaaacattaaggccattttccttaaggatgtttttggctctcctactccccgtgagaaagatctttccatttccagaacttctccacactaaaagtgaaatatttttgtgaaatgcttttttagggcctgccaaactcaggtgagtctgttctctgggataagctggcttctcttaaaatgaagccagtcagaaatgtcagggcatcccaagattgaccagtcagagggcagttctctccaacttttcagctttcccgctatagaatcttctgtgacactacacgtgtatacaatgtaaaccacctcccctggctcagctgccccgtgttactattttacttacttgattatgtgggttgcctcccccaatcagtggagaaagaacacagcccagacccagtggacaggacagagctatcctcagaagggtaacagtgtctgatattgaacaaaggactaaaaaagaccaggtgatagatacctgcaggtctgaggcaagtacttgtctgtttatgggcaggcctggaaagcaggggtacctcacctggagagcttgctaatacactggtccccatcctaatcccccaaggtaaaggcaaactctccaaggatgggctgttgggagaaagagtgtgtgtttaaacttcttaagcgattttacggagcactcagtggtttaaagaccattggagtagagaactgaaaactcaaatactgcaaatagctgccttttccctgtaacctaaagcatcttagtccaaactaggggatgtttttaggatagtgaccctctagatcagagctctcccttcctggacaacaagctccctgaggacgtgggcgacttagtacatcttgtatgggcctctctgcctgttctttgctttgctttctgggacacccttaggctagtctagcaattctgaactgcctggcttgaagagttgattcccatgggatgttgaggaggggccagaggttctggaagaatagtaaaaaacctacaaccaagtggtagcatctcagtattcctcttccacaaagtagcccatccccccccatcaccaagggaagcccctagtggtggcaggcatcttgggaatttaccttcattactaattctcccttgtctaccagtagcacttcttaacctgctcactgcccatcagaacagcctctgacaaagctgcatccaaattctttaaagggcaattcattgccccaagtaatctgccaaacctgtcttcatttggaaatcagtcttcatattcaggtgagttccacttaagacccttttagctgccaatttaaaagaagcccttttgcaatgttgattatgtttctataaatattagaaccagccgggcgcggtggctcacgcgtgtaatcccaacactggaaggccaaggcaggcggatcacttgaagtcgggagtttgggaaacatggtgaaaccccatctctactaaaaatacaaaaattagccggccatggtggcttatgcctatagtcccagctaccaggaggctgaagcaagagaatcacttgaacccgggaggtggaggtttcagtgagctgagattgcacttctgcactacagcctgggaggtagagccagacattgtcttaaaaaaaaaaaaaaaaaaaaaaaaaatagaaccatactacagcagcatagtcactgttggtttgaatctctcacattttgttcttttagaagtgctgcctaatcataagtttcataaagtaatgtggagttataattttaatcagttggtttggcttttttaaaaaattgtcttctaaaaatcggtttatactgtgtgtgtacatacatactacatatgcatatgtggatgcgtatttcaggtttccaaaacagcttgatacattttacctacattgggccaaattattttgtctttttaaattttctcaaaaaggtcatattgcaaaattattctaggtcctttactatgtctttatgctgacagtcaagctaatagtgatcaagagcattatgcttctggggttacaaggttcagaacttgccccattggccacttcctctatataaaataagacagtcacattggaatcttaatagggccctttcctgctcagaagttcagaaagcattgcctaaattaatatttttaagggaagaaaatgttgacagatgcaaccttagctgattgttcaaaaaaagtttttcctttggttataattgtaaatacaaaagaagaaagcttggcctttgtcctctatgacctcatgacttagtggggaaaacagccacacaaacaatgaccacagtgtcccaaggtgtgggtggggtttttagagggtcatggagtgactggcatggttggcaactgaggaggtgggtcttaaagaatgaccaagaagtttgtccaggttgaaatgtgtccagtgagcagttgaaaatagggttttggagtatttaatggacagaaggtaatcaagtccgttaacagactggcccagagacggatcacgaggtcaggagatcgagaccatcctggctaacacggtgaaaccccgtctctactaaaaatacaaaaaattagccaggcattgtggtgggcgcctgtagtcccagctacacgggaggctgaggcaggagaatggcatgaacctgggaggcggagcttgcagtgagtgagatcgtgccactgcactccagcctgggtgacagagcgagactccatctcaaaaaaaaaaaaaaaaaagagagagaggagactggcccagagagggcaagtagcagataagtgtttaggcagaaagcagcacaccacaggagattggcttctcgtgttatttttctccattcttttgtcccacgttggggaatgcagcttaattttctacatttacaaagtatatgggccaggcgcagtggcttacgcctgtaatcccaacactttgggaggccgaggtgggcagattacctgaggtcaggagttggagaccagcctgaccaacatggagaaaccccatctctactgaaaatacaaaattagctggacatggtggcacatgcctgtaatcccagctactcgggaggctgaggcaggagaatcgcttgaaccgggaagcaatggttgcagtgagccgagatcgcgccattgcactccagcctgggcaacaagagcgaaactccgtctcaagaaaaaataaaaacaaaaaatacgtgaagatatgccttagccccagatcacaaaaatagcaacactttttctatcctggcaattataaatgttttgagtctggcccaaagttgaagtagaaagaaattgatggtaaagagatactttctttgcaatttggtaatttgtgaatggaaggcagaaaggaattaggtgatctgtgccttcattaaaaaagactccacaaataccacccttactcatatctaggattctacaggagacaaaaattcattatcaaaataccaagtctttttgagtgtgcagcagtcattcagcaaaacattttctgggtgccttgttgtcactcaatttgagcaccagcacctcttggaaatgctttctgatctcccattggctgagagcccttctcttgcttctgtgacagcttctctatacaacaactttgtaatcatcaactatcttcctatgtccctggttaggattatgagcctcccagtgtagggaacatgctttgttcaaaggtgctcaatagatagttgttgaataacactgaaggctttatgttataaagaactatataaatagaatgggaaaatccccatacacaatagcaaccccaatgcaaaatccctaacaaaatagaggtgacctgtgtaataaagacctattgaaaattctaatccagactttgagatttcacagatcagtaaaatttccaaaatacatttcatcaacttatgcatttagaaacaagaaaaaaatatatctaacatagtttttttgtaaaacgccatttcaactctgagtagtgggggagggaatcacaggataaagtacagttctttaaaagaaattagttttgctttataaaagtcactatgttgtcctcagttttctctcattgctgcttatttttctccacacagcactgctcagcacgcaggcatgtgaggaagctgggcttaaaggagactccagcaaatggagagacagaccacagtcctgggttggaaagctgaatatcgttgaatgccagatcttcccaaataaatgaactggcttaatacaattctgatcaagatgccaacaagaagagagtgtatccagacaaaatgatctttggaaaatattcttcaccttgtggaataaacaggaaagcatggctaacaacgggttgtcgaaaacttccttattaggtagtaaaacaaatttttaaatgcttaaatactaatggtaattagagtaaatataaagtggaacaggctagaaggtccagattatgctttgatttttttatttaaaaagacaagcatgagtaactcccaaagtgtattggcttcaaagccacaaaagcttatttctcacctctgctacatgtccatcacccgttatcaggaggctctgctcaccctgatgtcttgggactccagagtgagtgatcagccatctctgatcactcactcatttgatctacaaatggctagccatcatgccagagggaaggagctcaggctgtaatgtccagccgctgtgatgatggaaatgttctgctggaagctgaaacagaggggtcccattttcatttgtcacattagcaaagacgtacttaactaatattggtgccagtccagaatgtggtgcaatgagttcttcctgcacttggcctcatctttctgtattaccagttccatatctgcactgtccaggacagtggccactagccacatgtggccattgaacacttgaaatgtggttagtgagaatgggaaactaaacttttatattaaataaatgtaaatagttacatgtggctactggctgctagattggacagagcagcatctggaagctcttgcatcagcaattaaaggcttgaggacagatacacagtcacttttcacagtcattgccagaacttgacacacagcttcacaaagtcacaagggtcaaaaatcactatcttcctctgttcaaaagggaaagagctggaaacattggccaagaacattaatgactcctacaatagggaaggactttgtaagcttaaaagcagtgtaagtgcagtggctcacgcctgtaatcctagcacttcaggaggccgaggcgggtggattgcctgagctcaggagttcaagaccagcctgggcaacatgggcctctctaccaaaatacaatacgttctcgggcgtggcggcatgtgcctgtaatcccagctgctcaggaggctgagataggagaattgcttgaacccgggaggcggaggttgcagcgagctgagattgtgccattgcattccagcctgggtgacagagcaggactccgtctcaaaaaaaaaaaaaaaaaagcagtgtaagcttaaaagcagaaatcctaagggtcccgcattgactgcctaacattaaaatgtccccatgtccaaaaaaatcacacacaaaattaaaaggccaaccaatagggaattataaagagttcataaaaactcatctaaagaaaaaacctaagcagaaagaaaaatgggcaaagaacatgaatggccaatccacagaaatattgtaccaactcctgtttatgatggaaaaggtcatcacactcattagtaaacaaaaagaaatacaaactgaaacaatgggatacctgatacatattttcacttgtcacattagcaaagacacttaactaatacttggtgcaggtcaagaatgtggtgcgatgagttcttcctgcaggtggcctcatctctctgtattaccagccttaaaaatgtccatactggctgggcgtggtggcttatgcctgtaagcctagcacttcaggaggctgaggcaggtggatcagctgaggtcgtgagtttgagaccagcctgaccaacatggagaaacccccgtctctactaaaaatacaaaattagccgggcgtggtggtgcatgcctgttaatcccagctactcaggaggctgaggcagaagaatcacttgaacccgggaggcggaggctgtggtgagctgagattgcgccattgcactccagtctgggcaacaagagcgaaactccgtctcaaaaaaaaaaaaaaaaaaaaaagtccataccattcgccctagtaattatctaggaatctattctggagaaacaaatggtaaaagagtgaagactttcatcaaagtattataatatcagaaaacctgaagacaaccaaaatattggttaaattatctacattcatccagcactttctggaagctgaccacttccttatgcagcctttaaaaatggcctaataatatttaaattttgggagggaacttccaataaaatcaagagttttaaaaccacataagagggctaattcccaattatgtaaatacaaatatatgtgtatagtttttgcataggataaagaaaaggaaatgtattgaatgttaacaatatgtatggctcacttactcctttttgtgtctatcttctaagcattttacaatgattattgctttgaaaacaaaa

SEQ ID NO: 545 - DNA, 8677 bp, Homo sapiens
cagcttccaataaaaacaggacagcagaacacacataccaaagtcagtactgagcacaacaaggaatgtctaatcaatatttccaaatacaagttttctttggttataagcggcctcactactattttaaagaatgttaacaatatgagaatatttggagaagctgctgaaaaaaatttatatctctctcagttgattatattggatacactggaaaaatgtcttgctgggcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttacaggaattaactgtttgttcagaagacaatgttgatgttcatgatatagaattgttacagtatatcaatgtggattgtgcaaaattaaaacgactcctgaaggaaacagcatttaaatttaaagccctaaagaaggttgcgcagttagcagttataaatagcctggaaaaggcattttggaactgggtagaaaattatccagatgaatttacaaaactataccagatcccacagactgatatggctgaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaagaacctgctttttaatccaagtaagccattctcaagaggcagtcagcctgcagatgtggatctaatgattgactgccttgtttcttgctttcgtataagccctcacaacaaccaacactttaagatctgcctggctcagaattcaccttctacatttcactatgtgctggtaaattcactccatcgaatcatcaccaattccgcattggattggtggcctaagattgatgctgtgtattgtcactcggttgaacttcgaaatatgtttggtgaaacacttcataaagcagtgcaaggttgtggagcacacccagcaatacgaatggcaccgagtcttatatttaaagaaaaagtaacaagccttaaatttaaagaaaaacctacagacctggagacaagaagctgtaagtatcttctcttgtccatggtgaaactaattcatgcagatccaaagctcttgctttgtaatccaagaaaacaggggcccgaaacccaaggcagtacagcagaattaattacagggctcgtccaactggtccctcagtcacacatgccagagattgctcaggaagcaatggaggctctgctggttcttcatcagttagatagcattgatttgtggaatcctgatgctcctgtagaaacattttgggagattagctcacaaatgcttttttacatctgcaagaaattaactagtcatcaaatgcttagtagcacagaaattctcaagtggttgcgggaaatattgatctgcaggaataaatttcttcttaaaaataagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggaagagcagcacttcagaaaagagtgatggcactgctgaggcgcattgagcatcccactgcaggaaacactgaggcttgggaagatacacatgcaaaatgggaacaagcaacaaagctaatccttaactatccaaaagccaaaatggaagatggccaggctgctgaaagccttcacaagaccattgttaagaggcgaatgtcccatgtgagtggaggaggatccatagatttgtctgacacagactccctacaggaatggatcaacatgactggcttcctttgtgccctgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggttttattgactgataccaatactcaatttgtagaacaaaccatagctataatgaagaacttgctagataatcatactgaaggcagctctgaacatctagggcaagctagcattgaaacaatgatgttaaatctggtcaggtatgttcgtgtgcttgggaatatggtccatgcaattcaaataaaaacgaaactgtgtcaattagttgaagtaatgatggcaaggagagatgacctctcattttgccaagagatgaaatttaggaataagatggtagaatacctgacagactgggttatgggaacatcaaaccaagcagcagatgatgatgtaaaatgtcttacaagagatttggaccaggcaagcatggaagcagtagtttcacttctagctggtctccctctgcagcctgaagaaggagatggtgtggaattgatggaagccaaatcacagttatttcttaaatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtatatggtgctacctatctacaaaaactcctggatcctttattacgaattgtgatcacatcctctgattggcaacatgttagctttgaagtggatcctaccaggttagaaccatcagagagccttgaggaaaaccagcggaacctccttcagatgactgaaaagttcttccatgccatcatcagttcctcctcagaattcccccctcaacttcgaagtgtgtgccactgtttataccaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaagatacttcagagtattgccaatcatgttctcttcacaaaagaagaacatatgcggcctttcaatgattttgtgaaaagcaactttgatgcagcacgcaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggcatcaggtacatgaaaaagaagaattcaaggctttgaaaacgttaagtattttctaccaagctgggacttccaaagctgggaatcctattttttattatgttgcacggaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtgaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggcatgcatgagagatattccaacgtgcaagtggctggaccagtggacagaactagctcaaagatttgcattccaatataatccatccctgcaaccaagagctcttgttgtctttgggtgtattagcaaacgagtgtctcatgggcagataaagcagataatccgtattcttagcaaggcacttgagagttgcttaaaaggacctgacacttacaacagtcaagttctgatagaagctacagtaatagcactaaccaaattacagccacttcttaataaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaagagtccagaggaagtatttatggcaatccggaatcctctggagtggcactgcaagcaaatggatcattttgttggactcaatttcaactctaactttaactttgcattggttggacaccttttaaaagggtacaggcatccttcacctgctattgttgcaagaacagtcagaattttacatacactactaactctggttaacaaacacagaaattgtgacaaatttgaagtgaatacacagagcgtggcctacttagcagctttacttacagtgtctgaagaagttcgaagtcgctgcagcctaaaacatagaaagtcacttcttcttactgatatttcaatggaaaatgttcctatggatacatatcccattcatcatggtgacccttcctataggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggaacaaggaaaagttttgatcacttgatatcagacacaaaggctcctaaaaggcaagaaatggaatcagggatcacaacaccccccaaaatgaggagagtagcagaaactgattatgaaatggaaactcagaggatttcctcatcacaacagcacccacatttacgtaaagtttcagtgtctgaatcaaatgttctcttggatgaagaagtacttactgatccgaagatccaggcgctgcttcttactgttctagctacactggtaaaatataccacagatgagtttgatcaacgaattctttatgaatacttagcagaggccagtgttgtgtttcccaaagtctttcctgttgtgcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagttttggttttaatggcttgtggcggtttgcaggaccgttttcaaagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaactt

SEQ ID NO: 546 - protein, 1988 aa, Homo sapiens
HRLPTGMDQHDWLPLCPGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 547 - DNA, 116858 bp, Mus musculus
  misc_feature (1)...(116858): n = A,T,C or G
tctgtcattttcacagcagttgagcatatgagaaaggataagaaagatggtctggctatgaagaaagtgccaaggataagcaagcagatgtacaattagaacccacccatctctggttaacccattatagatgagcacacatgagctcagcattgggttggtgctctcgcacgtaaatctgagaaatggagttcgcaggtaagcttttctcttttctttctttcccttcctttcatcttaacacatttcatcagtttgcagcaaggtttcgtagctaagattctccatgggagcaggagaagggttgagaagcatgctaggtataaggggcatcaaaacatggaaagatctgggatttgaaatataaccccagttgagatctttaaaatacctctaccttttcagtaatattcatctctgttattctttcctttagcttcaggcaaaaatacttgtctatctgtaactcagtccagaaaagccattcttgagtacattccggctgtatgttccttttgctgaacaagtgacctatatcgccacctatcggtaaagctgtactttctactagacatgtagcttgcttagataactgaatttttcaaggtgaagagtttcgtagttcaggagaatttaatttccttttatattatatatttggaaatagtttcaaactagaagtgaaattataagaatagcataccaggattctccatagaaacaaccaagaagatagatacacacacacacacacacacacacacacacacacacacacatatgtgtgtatatatccctttagaataattgtgtatatatcttaatagatttttatagataatgaaaagctcttttaatacattttgtacatatatgcacaacatgcatacatgtgcacacattaaggagttagccctgtagtcagagcgactgagaagtcccaaggcacattcacagttagcaagctggagacctaggagagctgatagtaatcagctttcctcccatgccagtgtgttccctcatgaccccacagcagcacactttgctagacatgtaaatctacttaggattcaattgggttgttttcatgctttgattgctagtattatataagcatgctttaaaaaaaccctcaagtacatagtattgtgagttaagtggacttctaagagccagtcttgagtacagagtctgaccagaatgtataaactcccagcaaagctacatagtaaaacaatgtttagagcacatttatttatagttaacctatgtgcatgttttggtatagtagaggctagagttcttttttaaaatttatttcttttatttttttgagattataattgtattatttccccttccttttcctccctcctatatagcccttcttaatcttttcatatttatggcttctttttatagtaataattgatatatatttacataatattacatataaattatacaaatacacaaatgcaaactgctcagtctatatactctttaaaataatattttggtgttttaaattacaagtatgggggcggggagttgtatttatgggcatgtgccccatgctggtaatgaattactgtgccaccatgctggtgattggactactgtgcccccatgctggcgatggaccagcgttccaaggttttgcctgagtaccatgtgcttcagctcaggtcctagagggctacagggtagaagaagcacttttgctgtctttatcccctcccttctagtttaatatgctgacttagttttgaaaacctcctttctcaggcttcttaaatgtatgccttaagcatttagaaacaaatatgaagtataaatagatgttttaactcaaacagtcatttagtgagtgagtaaggcttcctggaaggtggtttatttagttgttctgacatgacactctaaacatgtagtagattcacttaacattaccagcgtttcccccttttgcttcttgggtggtgtgtgaatttgctaaccctgtcattatgcttggcttcaagcaatgggagtttgcccagacctcgctctctcacagtttcagggtgtgttcatgtccatgagaactatcaccattgtttgaaattctagctactctcagatttagacttaagtatagcttatactttttacatttcatgccaaggataagcgaccttttagtcttgaactgagaatacattttacatattagaatacgctgataacatggttaatttatagatactaagtatccttagaagatttgaaacacttcaaagtaggaaacttttaaagttattcaactggtgtcatctgcataaatattccaacatttgaggaactctgacatttgaaccatttctagtcctcaagcattagagctgagggaggttcagctggcacttagaagtcagttgtcaacattagaggttagcactctgaaggtatggatggatcatcgttaaagcagccgtttagaactgcataggtatacagcataccgaagatgtagtgttcttattagatatgtaaactcatctcttttttccctaagaaaataatttgcccagtaaaacatacttggttagacctgtaactgaagctccgtattccctgtttttacactgtttttaccattttatttgactcttaagcaaggggggcagtgtgaattattcatagattcaggtagattacatttttttcttttttttatgttatctgctagagactgtgttttctgtgtgaccaagaattctgagttaggtggagtgataatgtatgaggaaggctgaagccaaaaggctagagtgtgaacatgtgtggtggagtgtgaacatgtgtggtggagtgtgaacatgcgtggtggagtgtgaacatgcgtggtttgtagaaaaaacatgtaaaggagggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccccttcatctgtcctttttttctccttctcttcaggctgtccatctcaacattgtaaacttggtcaagttgttagccctctttaaaatggttttggataaccatttgctgtattcttgcctggggaagccagtttctttctctctctctttctctccctctctctccctctctctctctctctctctctccctccctccctccctccccctctgtgtgtgtgtgtctctgtttctgtctctcattccttagttgcctttagcagttgtttgtgtagagccaaggcctcctgtgttcccctctccccggcacctcaggatgtctatgtttgtattggtgagacttggagtgtagcttctgacatttcctaggacacacaatctcacaaacaactccctgatcctctggctctttctgccccctcttccacaagttccttgagctggagttctgttgtagatgtatccaatgggactgggcacaacctctgcattttgattggttgtcgtattctgtaatggtctccatttgttacaaagagaagtttccttgatgcaagatgaggactaaacctctctgtaggtataaggacagattggttatctaatacgaaatggtcagccctgaaaacatacatgcaagttatattaaacagactgaacaggttgcatttatgtatagtatacatatatctatatagtaaaaataatgtagaaagaggccatcagtttggaggagagtaaggagggtgtggaggggtaaggagaggaaagggaggtgtgcatttatattttcacaaaataaataattaaaaaaatagactccctcagaggttgattgggtatactaaggataaattgcatggcctcctggtagaaagtaccccataaatgctagcctcattgttgtacattatattgttgtagccaatgtataaaatgtatgaccagactttgtatgaaaacagttgcttagcctttccttataaaagcagaatattgttcacaaaaaggctagtaataggagttaattatgaacgtctaaaaccttttggcaaagctccaaaaatattagtagtcttaatcatggttaaaataattatttcttctctgaagttttcttccagttggtgtaaacttaaacaggaaatagtttttcatgtgtttttactctctgaagtattttgtggtgcaccaatcccttgaaaatgtttttttgtggtcccccacccctacccctgccccagctgagaacaaaactcaaggcaagagctctaccactgcgctcttgccagtgacccccaaccccgttctctctctctctcttcaaaaatgtttgtttgtagttgtgtgtgcatgtgtgtgtgtagtggggagtggtatgtgtgtgtgagtgcagatgatggaccgtggcagctgtaggtggaggtgtgggcgctgttcatggagggtgctgggcaccagtcctctctgcaagagcagcgtgggctcctaactgctgagccagctccttagctgggctaggtttctaagttgatggctgttttctctgggtactttgaagcccttactttctgattgccggtgatgagaaatcttcagggttttattgttgttagaagtattttgccttttaaatcacttttaaaagaattacttgttggtttaaagtagtacacgaagaatgcagttctttttgtttgtcctgcttaagggtggcccagagtatgagtccctcccatcttctgagttctggaaacttcagcctgggtcttgagcacttgccttgtttcatcatctcttttggatctgctctcagggcgtgtagggtttaccctgatttttacttcttacatggtgtctccatctggacagtgctttgtgtgttgttttcctgtttgtttaccatgaattccctcttgagtagagtttgctatggtgcttctgtagtgaatattaattttgttttaaactctatttctctttatgccttccttcgttgaaagccaccgattttagtccgttctgctctgtagggtctatctgnnnnnnnnnnnnnnnnnnnntgtcttctgacctcacattaagcccaggccaacacagttaagtttatagatcttcctggccaagacacattttcctccccagcatcttgccaccgatgggccaggctctgacctccctagctctgcttcagatgagatgggtggggtggggctggaaggtgagggtgtagaaggtgagggtatagaaggtgagggtgtagaaggtgagggtgtaggccttggttctgtttttattttttagcggtcttgtcttttctcttcagctgggaattaaaattcagactctttctaagtttctcatgaagcacagcatgcttttagattattttgtcaactatgttactagaaatggtcaaatgaccgaatcttaacctgtcgctttgtgggcttgtatgtaatatttaaataccatttccaatgtttttaccgcttgtctggcttgtgtataatcctgccctgtgcatggttgctttgttcaggcatccactcattctttcaacaggtatgtagtaagtagatgattagatgaaatatattatatgtgtatgaatgcaaagaggaaggataatgctttaattttcttttaaaaatgttattctttaacatcaaggagctaaaagaagataaaataaacagtgtgaaaatgccactttgtgggagatgttaggcagggaaccttttgtaacccagatatttagcagaacccattcttttgaaatttctatcataataaattgaacttttgtgatctataaatagcatggataatcatgtagtcctgtacccaaagtggtccaattcatagatactcaacatttcagttggctactgaatagtatacatttattattaaatacatgcagcagagtgaggctgacagttagtggtgttgaagaataaaagccaacagtacaaactgaaagttttctctataaacttcaaactagaataaactgtgtaactgcagctagagtgaagatggagaggcaacagaaactgaaaccttgttgttagattgaagcctagaggcttccctagtcagagcaactgaagcatgacttgatgagtcaagaagtaacagcatagtggtatctgggaaactcagcaatgacctgtgacgctggcagcaagtctctgtgttccctagtggaagcattacagtatagacttcaacacagagaagagtgcatacatagactcaggtgctaaaggaaataaagtttcgttacatcagaggcaaaaatatgcagctatgcactcagatcaatcaacagggaactttttttgtcagcttttatcccttgtttgtttattaaagggaaaaagaaaaatactttgtttggtattggaagaacccatgaaaagatggtcattttggaggctaaatggttgattgggtgcagtttaatggaccaaagcaagagtctaatgctgcatatttcaaggttttctgtctaagggctgatattgcttgtttgaaagaaaccagaagacagccaaataaatgtcttcagaagtagaaaagagagtaagttgaattagcgaacttaactaagaaaatagttattatgatatttgtagtcatgaatgagagtgccactttatattcctaggaaaatgaaataaactacaatatatatttgtttcatttaatttgtcttgagatgcatttttttttcagtttcccacataatggattttaatataactcatgaaatattttgtctgacaaaacagacaaaaacaggcaacaggcttactgtggatttgtggccagtctaagttctaattttttttttttttcctgagacagggtttctctgtgtagccctggctgtcctggaactcactctgtagaccagcctggcctcaaactcagacatctgcctgcctctgcctcccaagtgctgggattaaaggcatgcgccaccacgcccggcatcagtctaagttctatggttagtttaaaacacatacacacacacagattgaaagcaagcaaaaaaaaaaaaaaccttattcaagtgtattgatgcttatttttagtctgtattacctctattcagtaaatagtaataaaatttatatatctaacatgtaggttaaagatataatcttttttacaattaaataaaaatctttttcttaacactagggggctctctagatttatggattcttgttctatgtcacagtgtaggaaatcacttgaaaacattttattacaaaatgagtactattgccagaaaatattagatcaccttaggctctagtaagttctagaccagtctggtttgcagagcaaggtgctgtttcaacactacccccttctacaccaggagtaaagttgaaagcaggtaaaggaaacaagattgaattgtattaatgcataatgcattataaagctgggttttttttttttgtttgtttgttttgtttttttggtttttcgagacagggtttttctgtgtagccctggctgtcctggaactcactttgtagaccaggctggcctcgaactcagaaatccacctgcctccgcctcccgagtgctgggattaaaggcgtgcgccaccacgcccagcttaaagctgggtttaaaaatacttacttgtttaagattgggtctcactgtgtagcccaggctaacctagaactttctgtgtagcttaggctgctcttgggtttgtgatctctgacctttgcctcctagggtccaggtaacaggtgtggctcatcgtacccagcacaagctgttcttttagatagcaagcaagtatcagcctcatcctagcagtggcctgtatggtgagatagtgtgagctagaaggaagtttcgtgctctttattgccatactgattctgtaaatggttcctaaatcctattaattcaaatgtatttattttagaaatttaacatgtgcttgaaagctgctgtcagcagttataattttgaagtttgaaaccccaggaacattctttggtctgtctgaggaatagtcttactctttctgtgttaggattttcatgacactcaccagatatactctgattgccagcagtgtatttaaacagtttttgtctttttttttcctttatttagaagactattacatttaaactttatgttcattaagtagataatgaaaacgtttgcaccctcactgcattgctacaggaacatatttaccatatgtaagtgcatcttagctcagtcttcttcagcacagctctgggaagtagatactcattgttgcacattttatacataaggagacagtaaaaaaagttgacttgttgtgttcatatgcagactataagcagtcttgtttcagagctcttgatttctttgggagttggaggggagtttgtactaggaattgaacctagatccttagatgtacacattctactacagagctgtatccccagcctcccctctccctttaataagttgtctagtctgcccttgagtttgagatcatcttgcctcaagactgctgccttgctgggattgcaggcttgcatcgctaggtccaacagagcccagctttgtagagaaagggtataatagacttggtagagtttatacttactgtgtgtggtaaatagtctagaataccccaacttacagtttcttttatgataaaaataggtatttaaagttggaaatgaacttaaagtctgttttccctgttattttatggaaaagaagaaattatactatgttatttaggaaagacggtaaaatcagtgaacactgtgattttaaggtggaaagaaagaatggtgttaatggaaagaatgcctggctagcgtcttagatgtcttgagtcacgattctctgtcctcacctgcccgatgctgccccagaggctgttctctgtgctggggaatagcagtgacattttttttgtcagagcgtgagtacagtattttcccttagctagtgttttcagtgggataatgggttgagagtattcaacaaaccttagtccctccacacaaatggacatggcttgcattgttcttttgcgacatgtcctgtatttttaagtgttagtggcgtcttggtaggggaataataaaggcaagtctcgtctgcattgttaacctagaggttgcatctaaaactgggaaactgagctgggggatgtattactttgccacgttttaaatgcttgttatttagtttaaactaaaaacactgtgcagtctgattcgttccctcacagtatcacttagtggggaaagtcctaattttatttcacctgtgaagactgatcgtggcgagtgctggcaccattgcaatcctgatccttgggacacagtgacttggctaaaataaagatcacagcacaatcacagcctttccctagtgcgccagtggcatggtggttttcttgagcttagagaaagacatacattttaatttcttctttgttttctccaacaggaatgatgcatttgtggccttggacatgaagtaatcagacctctgttgctgttactgtaggctcaggggctgatgaggaaagcatggacctaatgaacgggcaggcaagcagtgttactatcgcagccactgtttccgaggtgagatgtaagcaccgtgttgtaaagtttcttccctgttttctaaatgtctaaagttacgtttggttacattttacaatcaatgtgagcaaaggactaggccacttctacagcttgtcttcaactactccttagtcatcagacacaataatagattttattgttacgtctttgtaccttggtcatatttgtccccctccctcttcatccacttgctagtttccttctccttacaaatagtattctcaaatagtatccttcagctttaaatacatacatgcacacacacacacacccctaggttctctgtatatgagaaagacatgtagtgggttgtctctccacccattgtatcttctcttatgttctcctccctctaacgccctgtctctcttgttgagacaggttcctctgtgtagaactggctgtcctggaacttggtctgtagaccaggctggtcttgaactcaagatccttctgcctctgcctcctgagtgctgggatgaaaggtgtgcaccaccactgtccagctctcccttctctatagatatcttaccctctcacttactagtccccctttaactttcatgttgtatataaatacatatgtatttatatttaaataagattctttataatccaagaagactatatagcttattattctgaggactattatttgtttgtgtatgnnnnnnnnnnnnnnnnnnnnttctgattgccggtgatgagaaatcttcagggttttattgttgttagaagtattttgccttttaaatcacttttaaaagaattacttgttggtttaaagtagtacacgaagaatgcagttctttttgtttgtcctgcttaagggtggcccagagtatgagtccctcccatcttctgagttctggaaacttcagcctgggtcttgagcacttgccttgtttcatcatctcttttggatctgctctcagggcgtgtagggtttaccctgatttttacttcttacatggtgtctccatctggacagtgctttgtgtgttgttttcctgtttgtttaccatgaattccctcttgagtagagtttgctatggtgcttctgtagtgaatattaattttgttttaaactctatttctctttatgccttccttcgttgaaagccactgattgtagtccgttctgctctgtagggtctatctggtagttttggtgagaggtgagcagtcactgttgctccctgcggtttacagtaggctgtgtgctcacagagttgccggtgctccctgcggtttacagtaggctgtgtgctcagagttgccggtgctccctgcggtttacagtaggctgtgtgctcagagttgccggtgctcctgtgtcgggtctgccagtgaggctttgtttgactggtgtatagtatggagtccatgctcagatttgtttccactgtctgttgaagaactacagctgttgtgaactttatttttaaggcagtgtcttaccatgtagtcttgctggcctagagctctctatgtagaccagggtgacctcaaagtcacagatatgcctggccatgtgaacatattttaatgtggatttcttatgttgagggtcttgggccatgatggtaatgtatatgcctggaatagattctgtcttctgacctcacattaagcccaggccaacacagttaagtttatagatcttcctggccaagacacattttcctccccagcatcttgccaccgatgggccaggctctgacctccctagctctgcttcagatgagatgggtggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgttgacgtttcataagcagttggcgtttcccacttctgttacagcttgcctgagtcagattttacacatgggatttttcctttttcctgtgtttccctttcttccacatagaaaagaaatttcatctttaagatatattttaaatactgtatttttaacaaatccttttcctataaacagatgggagttatttttgaaactataacttaaaaaacaactcatattttcttgtataaatttgttcatagtttttcttccctgagacagactgtttgtgtgtttacgtgttacattaaaaccatatttcttaaatgtctcatgtgtctgtggttagtgtatttttaactgtgtatccagagacaactgctgcaattcacaaatatttatcagatgaaacagatccttttatttgcataaaaatagtttcttctaaaagtaagtgacttacgttaggcttcaggttaatatactttattaattaactaattaattaattaattgattgattatatgtgtacaccatagctgtcttcggacactccagaagtgggcatcagatttttgttacagatggttgtgagccaccttgtggttgctgggatttgaactcaggacctttagaagagcagttggtgctcttaaccactgagcgacctcaccagcccactaatatactttctatatgacaagtgaggacaacaaggtctatgtttaaatagttctgctgtggtgagacagtgcagttaaaaacatgtgttctctacttcagcttaagctttagatttcttaacacatcaatccagatttccttaaacgtgctaggtttttggataaaatacgtaacctgaaccaacctgagcccaccaacttcttccttagtactctctgtggcttttaggccacggatttgtcaaacaagtccattatctttaagttgagcttcattcaagtagtcaggacacagacagaaggcagtcatattcattgccaaaatatcctacacaccccagtccagtttccaaggagtgcttgttcctttccgaagattcatggtttgagcctccgctctcttgtttctcagtgttcttctctgactggcgtcctctagagtagtccacttgtgacagtagctctggtgacagtgctcaatagcttttccaggcacaaggtccaaactctttacatttcctcctataaaatagttacaaagtcctaaaaaccctgtagtcaggcttatcacagcatcagacccactttggtacggttttctatcttcacttcctgttgttatgataaaacacctgtacaaaagctactttaggagaaagggcttatttggttcaattccagactacagtctgtcaccatggggaagtcaaggctgtagaaacttgcagtaccagtcccattacatccctagtcaagagcagagaataatgaattactacacccagctggcgctcagctcgcatcctccattcttacacagtccaggatgttctgccctgttggcatttccagccctcacttgagaggctctagccatctccatggtgccaagccttagttctctcccagactctttggtcttggggcttctgctgctgctaaggctgcacctttactaatggctactcctggattctctgcctgaacaccagccctacgatgtgatgcaaagcttcagccactctccatgacctgtttattccttcaaccccagtaccctgtggggcactcttacacattgttcagcgtccagcttgagattcagccttaccctgctgtgtgatggccttaaggaaatacttcccagaagacttggcctcagtgatgctggacttccagttgtcccagattattcttcagcacaggtttatgccatagatccttaatccagaatattccatgaacagccctgacagctatgctttgttcagactcccaccattgtctgcaatttctttcagcattctcacgtctaagctcccatagagcagcccttcccctaaggtctgagcattcagtggcttttctagcccagagacccagaatccttccccacatccacacggccaggtctgtcacagtagcagccctaccttcttgataccaggtttgttgcagctgctttctgttggggtgatagataaataatgtgaccaaaagcagcttgtggggaaagggtttatttcagtttacaggctgagtgaaggtcggcaggaacggaagtagattccttggaggaaagctgcttactggcttttccccaggttcattaccagctttcttagagcccagatccacctgcctaacggtggtgccttcctcagtggctgggccctcccatatcaattagcagtcaagaaaatgctccacagacatgcccacaggccagcctgatggaggcaattcttcacttaagttccctgtaccaagagataaccagtaccaaccattaacatatatgaacaaatacaatagcttgtaccattatataataaatggcatcctctgaattttcttctgatatatgctacaagagtattttctatttctcctcgttttaaaagttatagactcatgccatgcatgatggcattttgctcaatagcaacttcatgtataacgatggtgccatgatcatgtagtcgtgaggaaactgtgatactagtaattgacaagattgtttaacgacactttgacagtgtctgaattgctaagtgatgcatagctgtggatgtgcagttttctttacctatgttagaactatgtaaaatcagaatgtttgtttgaagagacatacgaaagggagggtcttacataggaacccaaaaaagtataaattcaacattggctttcatatttctggctttatattagcatttctccacctaagcagcctgctctactcagcttttctacatcttttattacatagtgttcttagttcctcagtttgtgtgtgtgtgtgtgtgtgtgcgcgcgaggaagcatgctcatgtggtgtgcccatgtgcgtgtggacaccagtggttgatacaggtgtgtctttcttcattttccagcttatttttgagagatcctaccactgaatctggaattgattgaaatgtagctactctgattggccagcaaactatgaatcctcttatctctgtgcactgcccagccctggggttgtaggagtgcacactctacctagattttacatggatgttgagactcctagttagatctgtatgtttctatagcagacatttgaccagccaactatcctgtcaaccccagagttcctctgtctttaaaggcttatctactttgtgtggcccgggctgtgaaacgatgtttaaaggctgtgttttcttccatcttgtcagaagagtagcagctctgagtcactaagcgagaagggctctgaattgaagaaaagctttgatgctgtggtgtttgatgttcttaaggttacgccagaagaatacgcggtgagctttctgtctcttgctttccagttttgcatttaatttatatacagcatctttattgaattagaatttgtggcctcacagatctcctcagaagaggagatgggtttttaaggctggatctaggaattgttagagaataacacaagaatggagcatgaggggtgaggggtgagggggcgagggcagctttcttctgaagggcagctgcctgttacccggtcaatgtggagcagagagataataacttgatcactgctgtgctgactcaccaaacaaatatgaacatgctcactattttttttttaatgatttgaaatttaaaaattgagaactctgatttaccaaccattggaatatgagtgatataaaattatctagagaatctttttaactgacataagtgttcattgattacattgcttttttggtcttacaccatcttacattctaagagtaaaatattcttgcttggagtacgtggtacctttccctgatttctcctcttaacattcttttctcttaacttttttttttaaagaatgtatttatttttaaaatatatgtgcatacaccattgctgtcttcagacataccagaaaagagcatcagaccccattacagatggttgtgagccaccatgtggttgctgggaattgaactcagaacctctggaagagcagtcagtgctcttaattgctgagccatctccggcccttagcagttttttattacatttattagtttatttgtgtgagaaagggagtcatataccatagtgcacatgtacaggccagagggcagctttacagttggttcttttcctctaccatgtggagaccagcgattgaactcaggttgtcagtcttttgctgagaccccctgagccatctaatggatgacagtgccaaagtatttcccctttcctgccttacctaggaaggaggtaactaggagttgtatttaatggtgcaaagactaaattttctactttttttaagtcctaaaaggctacacattcagtaatttagtatggagtacaaattttattttgaataaattttgtttgtttgtattttgtttgtttacttgtatattgccatctaaaccaaaccaaatccctttgtcttacagggtcagataacactaatggatgttccagtgtttaaagctattcagccagatgtaagtagttttaagaatattctttgaatatagaagatagtaaaccatagtgtcttaagatgttgaagaaattcaaatcatattttgtattaatcattaaatgtctaaagcttgtaatgtcacttaacctattcagtcttacagactcagatgccagtcatcatagtgcattctttagtcaaaaatgggatgtttgaatcacttggttatggaaggaaggaatagacttaaggaagtttttacccatggtgcggagactgtttaatgggaaggtgaaaattagacataacttactagtctttccttctaccttaatttttttataatatgacttattttagcttatttaccttttaaaaattatcgggtgtgctcatgtgttgtgagtggtgtggatgcatgtgtagaggtcagggaacaactttcatgaggttgcttctctctctaccctcatgtgccacttgaactcagggctaggataggtggtcccaatgttgacactttagaggaggaccacaaaacacatttttctcacgataaaaatagagactaatatgacatatctacctcctcactgtaagtgcatgtgtgtgtgtgctcaggtacatttatagtttatcatttaaaggcctatgtataataatcttgcttcattgatgagctaatagtgacacctatgctttatacacagctgtcttagttgactttgcattgctataacaaaatgtctgatgctgggtaatttatatagaggaggtttctttagatactagttctcagaggctgaaagttcagaaccaggaggtattatttgttggaccttgagtctgccccacagtgtggcaggaaagtagaaagggaaatggcatgtgcagcagagccaagcatgggtgtctttatgacagccactcctagagagccacctcactcttgtgtgcgcctgtgctataagactttccataagactcggaaagcttccctcatctccctacattagagactcagacagcacatgtaccttcagagatgcattcaggtcacagctaaactattataagagctcagtattgacagtagccttagattcgggaaagacaggttttgctcctagtaagcatgcaaacttgatctttgtctcccaaacaaagccatttggtaattcacggttgggtctttgggaatagtgtgcattatctgttgtgttctatgcggtctgtagtgaccctgactgctgtaaaaatagctgaagtccagcacatctgagtgtgaacaggtcatgcttgtgatttttcttccccatgtaggccataccatgtgttagtatctcaagtttgctgcctatcaagtgacaggagagctggccgcgtgacctccgagccctgtcatttccaaaagttgtccttctctaacaatgcagagagtttaaaaaataattatgggttaataggagacaaagaactgtgtactctatagataatggtagacagagaatgttgtatttaagtgatcaaagcaaaacaccttggagcattcattcctgtttttcctgagaagcccgtctgccgccttgatttcaacagtcttctaagaatcattttcctttagaataaaatatatttgctattgctctttcgtctgactcacataagccatggacaactggtctcatttatttaactgtatattatgtagtagccacattagacagtatcaaggagtaggtcaaatcaatgggtgacttatttaacctccaggagccaaaatatttcagcttgtaatcaggataaaatttttattgagatattttatactttcccccacgctaagttttgtgaattccaggtttaccattagatgatggtattcttttacctggagtagccctctttcaggtgctgtgaaatggatgacttggaggttggacatggtacactagattgttacttgaagacatagacttccattttaagaggattttttttttttaatttcccttgggacactgaacaatgctttgaaccttcaaagttgattcccagtcccccacatttttgagataaggtcttaggtagcccacactagcctagaactcagtatatgtagccaaagacataagcccgagagcttctgatagttcttcctccacctcctaagtgctagaattttaggtgtgcactactgcacccagttcttgataaatacccaattctctatcgtcagcacctcaatccaaagaagccatcttctctccgccaatcacggcagcacttcctcagttgatctgtgtgtacactgtgccctaatacccaacagaaccaacttcctggaggaaagatctgggcttgtggtctgagagagtccatcctggtggggaaagcatggtgcagccgagcatttattaccttgtaggccatagagcagagaaaagagggaagctggcactcagctggtctcccctcattcagagtgggtcttccttttagttgtcattggagaaccctcacagacacctggacacgtgcatccactcccttggacagtgctggttactgttacaggagcttctgctgtgacccctgcggtctgtcttctcaggtagccatggtaaacagagttgaaatgtgctcacgtggtctctgctcaccacctcagtggtctcacttgctttgaagatctgaagcaggatctgagtcgcttcattgttttgccgccttcttgcttctaagcacattttctactgtttttggtctagcaaaatgacctcgtttcagtccttcaccccccagccggtgcctgtcatgcctaactccctcttcctccttgagttatctggtggtgtgtgttagacttccttgcttttctacagattcccgacattttacatatgttacctgacagaactgtttacgttgtgatgctgtcagcataccttcaattgtctgttatgtgttaggcactgctttagttgctagagacccaacagtaaaacgtacactgaagtttgttccccagattgcttgtttgagtgaagtgagttagacagtgttacatgaacaatacagaggagagcatagggcacaaggtgtagtgttgacgcgataatcaagtcttcactgagcagcactgtaaagaggtgagactgcatactgctagtgtgtttggggaaatgtgttctggtgaggaactggtgagcaaaggctagtggatggcaaccctataagctggatgaaagggctgtgcacgagaggactggagtgagggctgggtgggtgtgttaccgtggagactgttactctgatgaaggtggtaagcctttggggacattgtttgcttttaattatgtgtgtgtttattaagtgccctctcctgactaacaaacaagcccactctccatccacagtggcttttttatctctcttcttccttcactttccacggccaattgctatgtgctttgatgctgccgtgaaatctgctgcttcagtacacggttctaaatacattctttcatttgtttatctttatttttaaagtagtgctggttagcaaactcatgccttgctcacactgtggtacttcaccctagatgctaaaatacattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttctaatatttccagcaccgagctcttgtagaagtctcttgcatacacatggtgctggtcgctctgacgtctctctggatcatgaagaaagttgttacacatccatagggcctcgtctgcgtgcagtatctcacgctggagctctgactgattctaaaagttctccattgcactcattactcttctgttgctctgatgaaattccatgaccaaggcagtatacagagggagtttgtctagacttatggttccagaggagtctgtcacagagaggggagcatggcagcgggcgaggtgtggctggtggagtgggaagctgagggctccttgtcttgaactgcaggcacaaagcagagagagagcaggctaacaagcctgtgaggcttttactctcagcactctatactttcctccagcaaaaccatactacctccccaccccccagaacactaccaccaattgggaaccaactattcaagtgcctgcggctgtggggggacatttattactgaaactaccatatccatcctactgtgttcataggagtggggtagttttgtcttttgtgaattctctgatgttctgcaaagcttgtattcttctgaagtcattgctgcatttattgtgctagtggagtttctcttcagggtgaattttgtatttttcagtatagggtaagatatgccagaaaattggcttaaaatccagaaatactgcctagtatttccatagaccttaattaagggttgaattatttttgaaatctgcttcttacaaagtttctgttgctgtgataaaacattatcaagaccacttaggaaagaagggtttccttggggcttacagttgcagagagaaccattacggtataaagcctgtggcaggccagcatggtattgttgttcagcagctgagaactcacagcctggcccacaaatgaaacagaacactcactaggaaaagctggaggcctttgaagccttaaacccttccatggtgacacacctccaacaaggccgcacctcccaattcctatcgaacagccaactaaggaccaagtattcaaatgccttatggggacatctcgttcaaaccaccatgcaaggttctcatatgttcttttttttttttttttttttttttccttttgagacagggtttctctgtgtagccctggctgtcctggaactcactttgtagaacaggctggcctcaaactcagaaatctgcctgcctctgcctcccaagtgctgggattaaaggcgtgcgccacccccacccagcttttcatgtatttttaaaggacaaggtccaccaaaaatttttctaacaaacattacactgcgtgaagaaaattctacattttaattctaagcaatcacagagcaaaactatttagagtaagcagttctctatgtatagacttctctccctgccgtgcccagtagagtccattaaccccaggctcagtagtctgaatctggagatcctaatgagcttgggacattgtggattttttctgttcttagattaggtacctttgaaatttggaaaatttcaaatgtaaaacacttcttgcctaagcctttcatataagacatataattgacctatataaaataaggcacaatccattggtaacacttcattgtcactgtgaatgtaaacttacttaagccttttatagtaaatttaatatttatcatccagagtacttcattatggggtaatgctgaataagcctgcaggtgcattgtgttaggtattacaagtgacctggaggtgctttaaggtgtggtggagtaggcctggagggatggatggctcaagggctaagagcactggctgctgttttgcaggtcttgagttcaattctcaacaaccacatggtgggtcacaaccttctataatgtgacctgatgccctctatgtctgatgccttcttttgccatgcagacatacgtgcaaatagagtacataaaataagtctttatagtggaggactgcataggtcatttacaaattaattatttttatgattttttaattggcaggagatcctagaactagtcttctgttagaactgtctcagttttattatttactaggaatgaacatggctcatctgtgtgattgagaaactctagagattgtgggaaaatgctagctaaattgggaaaatcttattaattaattatgaatcttattaaacattttggaaaaatttatcctatgagacatttcttgtaccatgtataaaagactttctctgcaaatatttttatgtctgccaaaaggctataatgttagcagcatataaaatttttaacaaatatttttctgttttagtaaaaacaatgcattaaaatgtaagcaggtcatggacttagtgagagagtggaagctgtcaaaagtatgttagaataacataggcactctgttagaagcacgatgcagctgcctgtcagtgtgtgtctgttgttctcatcttgagtatcttaggacgtcgtaaggtcaggtttccatcgggaccagggaaggcaaagaggaaagttgttttggcatttgcttctatggaagcagaaaatagcttctgtctttatccctaatctcattagaggtggtcatcagggaggagggaaggaaggcttgaatacattagagaagagggccttaccctgttaggttgcatagtttcaggggtttgtttttgtttttaataaaaatgcagacatgatggaatcccatccatggtggcgacttctgtatagccttatagtttggtacaatggatgccctatctctttctagctttcactttgaacacagagctacctcaccaacagtccgccttctcacagacaccctctgtcctatcgcttccctccctcaatctttaggatcccactgttttctgtcctcccttggtctctgtctacatgctggtctatattggccttttctctgcttctgtctataggtatccctacatcatcacccttagaacagtccttttaagagtgttggaacctacaagacgtaagagaagctgtgactcctgtgaattgagtcattctctcatagggtaggtggtcatcagctgtggggtttgccctccttgtgcttctgaaataaatgcaactggaaattgatcttgataggtaatgattcacagtgagtccatgactgttctgaaattcattttagcaaagattacgattgttttatatatttgaagattgtctttcctggatgtgcttaaaatggcaagtgagcatattagagcaaatattaatggttcagggctgaggtgagtacttacacagcacacccagccggccctgtctgttcttacgctagaccctcacaaagggttgtttgagtggctgactcacttgagtttggggtgtttgtgtgagattcattagtgcaggattctgtgtgaccaaggcgtcagtataaataagacagagcaaaagcatgatactatagtgttatctgtagaaagatcctagagtctgaaatgaaaagagaaaagaccattcggaagttttaaattctctgttttgctctgaggagctcagataattttcgtttgtaaaatgaatctgacagtatgtagattaaacaaagaacaatctagtgagttgttacctgcagagcaacaacccttgcttttctgacccggcttccctcagacaccaggtagcctttgggacatttcaggttgcttattcagagtaactactggcatgggagccacaagaacggttctggaacgtgttcttttggaaggaaggaaggaagggatagaagagaaagaatggaagaaaagaaaagaaagaaaacatttgcagtttattgtggtgcctgtttataatcctagcacttggacagctgaggcagagggattgtagtgagttcaaggccagtctgggctatatatagcaaagtatcatctcactttgtttttcaagttgatctgcattaatgaagtaagttaggagatgctgtcggagtccctatctgggactccagtactgcctaagtgtgtgtgtgtggatgggccagtgcacatggatggaggccacaggtcagtggtagatagatgcccttctctttgctctgcactttgttttttgaagacttttttttttttttttttaatgtgtatgggtgttttgtctgtgcacatgaatatgcaatgcctataaaggccagaagagggtgtccctggaactgtagttccagaagcatgtgagtgctggaaactgaacccaggtgctctgcaagatcagcaagtcctattttctgctgagccatcgctagccacttcattttattattatttttaaataggtgcatcctgcagcgcctgcctgggacctgggcattgaacttgggtcctcaggatagcagggcaagtagtttaccaaccgaaccaccttccagccatgtgtccattcctcaagacaagggaacttatttcctcacagagaaattcagggactcttgggaggtaaggtggagccaggacaaaattacctttcagtctaggcaactataaatgcaggtcagcatttaagagaaagtggtgagtcctggtacaattctagtcttgtaacctattaagtggatttttttccacctcttaaatattgtgggtgtttttttgttttgttttgttttttgtttttttgtaactatagaacatagaatgttgcagaaaatagtacaaatattaaagatttatagaaaattgcaaaacctgaacagagaaatcttccataccttttacctgttctttgttttttcacttgcatcttgactgtgtagtactatatcaaaatagaaaagtgatgtttgtgccatgcatgcctgtttagttctgtgatgttttattatacaagcagatctgtgttgcctcatatactggaaacaactcttccttggcgcccccccccccttcgaccccttttaagttacaactatctccctacctgcccccaacccccaacttgccttccttgattattttcttctgccttttggaatttctgactacttcttttgactctacctaagatcccaggattactctttactttaatcagtgggtttccaattatttttttttccctgtggcagtttgttcagtttgaagatcttacatcttatttttttgtttattggtgttgagaaatgaacccagggcctcactcatgttaggcataagctctaccaccaagctacatccccagctgttctgttctcttcctgtgcgagcgcgtgcgtgtgcgtgtgcgtgtgtgtgtgtgtgtgtgtgttgcactgtacattcatgcacatgtaggtatgtgaatgctacgagcacttgtggaggtcagagaacaacttgccgtctcttggaccctgtgagaataaactcgagtcagggagcagacagattgacccactgagccacccttcctccttccctgatttgcccgtctgttttgagcttgtgtctactgctctctgggaatgagcacacacatggcagcatctctgaggatctttcctgtctcgagaggatctccagcctttcttatttcaccgggtgtagaattctagaactttgaagttgttgctttcagttccctaatagcattctctcaagatgatttgtactttagaaaaaaatgaacataagatttattttattgttttaaatcttgttttctacaggcccctgcttttgtaaatttttaaaaatcgttttgatgctatgctttggcttcccttccacatacttcatgtgtgtactaagctataggagggtcaattgttatcttttaagttcttggcaattttctttaattgctactttcttgcatctcttaaggtttttgttgtttaaatgttaacacataaattcttacttaacatccaattagggtcttggtggatttttacgaacaggtgttgtgttattcagggttctctagaggaacaaaactgatagagtgaatctatcagtctgtctgtctatccatccatcaatccatctatatctagaaagggcatttgtcagactgacttacaggcagtggtccagctagcccaacaatggctgtctaccaacagaaattccaagaatccagtagttgttccatctgtgaagctggatgtctcagctggtcttcagtccacactggaatcctaaataagtaggctctactgccagtgaaggaggggacttgccatcccacgtgagagcaaacaggcaaagagcagaagcttccttcttccatgtcctttgtatagaattaggtggtagtgtactttaagggacattgttttagtatctcaaaaattaaatagaataaccactgatattctcctagttgatatttatactacatgataaagaaatcaaggaaaatacacaattatatgcgcaaatacattttgaacaaaatatggtagttataataaattttctcatctatcaaagactaatgatggcatatttttctttctctgatttcttttgttgcctacccaaagggtttttctttttttgtcatgagcccttttctctgatggtttttgctatgtagaacctctaagctagacctaaaatttataggcagaaattctcctttaaaatcagatgaattcagttctactagcatacatgcatcagaacattttgaatggtggtgtaaactagacatatgtatgtgtttcatttacattcagtatgatatggaaataataatcataattttgaagcagcaaggcaaaagtgacatttttgagctctctgtaccagttgtgtttacttcttttatattaaaaagagtacgtatattctgcagcctacatttataattaaaaacgattcagttatttttattttatgtggatgggtgtattgcctgaaaccacgtctgtgtaacacttgagtgtgtggcgcccacagaggccagaagagggcatatgatcccctggaattggatttacagacagctgtgagccaccatgtagctgttagttagttaaaccctgatcttccataagatccagcaagtgttcttaactgctaagccatctctccagcccacagtggttcatttcaagtaaaggggattagtatatatatattttttttaagtttctttttcttttaatacaagatcttgaggcacttgaattctattcttagaccactggagtgatcaagaacttctttactaaacaggtgtctgcaaatatccgaagtcaacaactgtcagatcaaagaatgagatgttttcaaacaattaattgtggacctgagagttggctcagtgggaccggactttgaatcactatagcacttacatgaaagaccaaaccagacagactgtctgcaaacctgagcacttgatgggacatgactaaagggacagatggagcctgggtggctggggatggctatggccaagccagtctagctaaaatgggagttccaggttcagtgagagaccatctcaaacattgaggttgagagtgactgagaaagcacctgatgttggcccctgccctatgcatccacatatccatagcaagccacagcacatgcacacatgtacatcacaccgtatacatgtacaaaggaagaaagaacaagctacttgggttgtcactgactgactgaataggttggcagtcagcaatgtttattaagtgtgatagggtattcaaccagaggacactctgtcatactctgactatcaaatacaagtttgtctatattcgtttagataatttgcatataatctaataaatttgttctagcttttacagaataattagtattgttatgtattcctattggttgttccagaaaagaacatacgcagtctttactgtttaaattccccaatgtaagaaaactgagttgtttcttacatgtaatttatacttaatttctgttttaatcttctaggaactttcaagttgtggatggaataaaaaagaaaaatatagttctgcaccaaatgcagttgctttcacaagaagatttaatcacgtgagtcatacttgattggtgagggagggtgtggctgtccttagttgtgtatgcacatgtggaaggaagccagagagtattgtctagtgtctccttgtcatcaccaccagcccatcttgagacgctcagtgaactctgagcatatggactgactgtacttgctgaccaataagcgcccagaatcctgctgtctctgcagacccttccaccccaatcccaacgctgtcttcccagctttttacataatgcttgagatgcaaacttcttgggatcaatctagggttgccaacctcgaagcttggtggcttttttacctgctgagccatcttgtcggcctctgataaatgttttttaagtctgttttgctttgtttgcttaaattagggcttcattgaattcaaagacatcacaaaactttttacagtttatgtgtttgtgtatacaggtgtgttttgtctacatgtgcatctgcacaccagaagagggcataagcttccattacagatgattctgagccaccatgtggatgctgggaattgaactcaggtcctctggaagagcagccagtacttttaacctataaaccatctctccaacaccatcacaaaacttttaaaatgaaatttttattttttaatttcatgatattttcttctagttgtaagaaaaccatagtcaaaaataactatagcaaatctatcaagaagaatttaatgttaattttagtcttggaatttcttaccctttggttaatttttattttcaggtaagcttttgggttgtaagagagattctccatgctcaaacactgaaaataagagcagaagttttgagccactatattaagactgctaaggtaagtatgacttgatctttagttaacccattcagaattgttttaagtgactgtttattggtcctagaaaataaggcctgttgagtacattgaacgcctcttttctctgcctttctctttattcttggtcatccccctgccccatttatctagtcaagggttagattatggtaaattacagtatttgtcaaatattagactatattgatggagaaagtcatgtagtattcacttgaagaatacataatgctttttcttacttgggttttggtttgttttgtttttttgtttttgtttttgttttctatttatttattaaattgtgaaatgaaccacccagnnnnnnnnnnnnnnnnnnnnaaaataagactttgcaggctggagagatggcttagtggtgagcaactgctgctcttgcagaggacccaggtttacttcccagcacacagttggtgacatgatggctccttctgccttgcacgagcaccaggcactcaagtggtccatgggcacacatatatggaaaacacttatatacataaaataaaagcgcatgaatcttaacaaaagactttaagaccttgaacttgtgttttccaacctctaactcccaggactaagattatgggtgtgaaccacaggcctctcctcgagtctagtttaaaagattagcacatacgacgctagcaggaacactgagtagttgttgacaggcatagataataaacagagttggagaaagcagcatggtttttaaggataatctgagtttcagagggaggaacagaagattgcacagggagacagtaagatcaacttgtaatgactcaaaattcatgagtgttgatggatccagaattcatcattgtttgttatgtgtggaatagtcaggtcttccctgacctgtgagttgagaggtgggagagtaaagcagagatgctctgcttatgatttaagttggactccttcctatattttccctgagcacaggaaacaatcttattctaacattctgtggcactaggtggcaggactagccttcctcatgtataagattttacagacatgttagaggaatttttaaaagcattctttgtaagatgttaggtaagtattagtttttaactaaagaaagtaatggctttccccatagattctgagttgttttttcccccatttatttgtatgtttttgtccatacagactacagtttttcttaccaaatgatttctctccagactctctgacctatatttgacagcctttgcttttattgcaagcctcaatgccctgttttccttattactattaaatcatattctgacactctgtgtcttttgtgttcagtttgtaataaaggctcacgtaggtcgtaccctttaatatctgttatagtcagtattctctagtgagagaaccaacagcactctgtacaaatagtgtatagtgagtcacatacaaaatgcaaaacaagatttaggaaatcagatccaagtattgatgggactggcaagtctggaaacattatggcatgacaacaagccgcaaactcaggcaggagcagaggcaaaagatgccatttcttcttttccttctaggtcctctgcatgtttaggcatccatcaagtctaacatggcacttagtctccagtaaatgtttaatatacattcctttagtgactagttcctccgctggattatagaatcctgtgtgaaggtttatctcctgttgcatgtgtattgttttgtttcaatttgctctttttggtttttcaattaagtgctcactatggggcttacctggttgcttgagaaaactgtaaaatgactaatttttagataccacttttagggtagaaactattatgtggtatgacaaaaattttgagaaactaacagcaaatgtaaagtgggtttcttgggaaatagtagaacttactgtttgtgtttgtatactataagaacaacatcccataatgtcaaggttcttgaacacgaggaagcaggaaatggaggcagcactaaagacagcaggtttgaactctagccctgggataataggagcaccgggcaagaaaccaaaccaagtagaccctttcttatgacttggaccacaaaatagatgaccagtcataaatcattgcaaggatactcaccagaaccaagtgcatggccgttacagtcatgccagttaaccttgggagcaagccataacttcagctttgtgaatatattacccatttagagttgggtttattcccacagcttgggtgaaagtgccagggtagaacatgaacattatattataggccaaaaataatttactgggtatcctagaagacagtttccaacagtgacagtaacaataataaatagttattctatccactgcctaaattgtgctaatctgtatttccctgcagtcattttcttaaaaaaacaatcctcttccccctttttcttaaatcttcagaaactatatgaacttaacaaccttcacgcacttatggctgtggtttctggcttacagagtgcgccgattttcaggttgactaagacgtgggcggtgagtaactctgcctagtttaatgaagcatagacttttgtgtgaagtagaaatattatttgtttcttttgtaagtcttagacaaatataatagataagaattcttaaattgtcttgcactttgttctttgaaaccaacatttaaaacttttaaaacattgcactgagcttttgagggaatgttgagggcaatgcttattttgctcttcagagaatcattttcataccttgttgctaatatcacatgtaatacttacctgataattagaatttaattgtgtacagattatacttcttgtaaatttgaaaatctaaatcatgacctttaaagttcttttattaattttgactccattattttttagccataaatcttgagtatagaaaaatctcatgataaacatgctactttctgttacaacagccaccatattaggttctgttactttgacaaaagcaaagtatgatttttggcatgatcagtatttgtatctctgagtagaatgatatcatactcaatctttctaggttatctcttccccttttctttcttttctttcttattttgaaactacggcctcgtttaaggtatcttgctaagtcacccaaagttgctttcaagttggggacttcctttcttggccagtcaagtagctggagttataagcctgatatactagcctctatgaaggggtgtgtgcgcgtacacacacacacagtctttttttatagcccaagctagctttaaagtcatggttctgcctcagcctcacaagtactaggattacaggtggaccatataccgtgctgaaaatattactatatattttttaaaagattaatgtctttttgtttttcaagacagggtttctctgtgtagccctggattttctggaattcactctgtagaccaggctggcctggaactcagagatccacctgtctctgccttttgctaggattaaaggcgtgcaccgacttgctaggcagattagtacgtcttaatggtcttgtgctaaaggcattatttactctataaactcagttattcatttttgtcttttaagacagtgtctttctatgtagcccagactggccttggatgtgtgtgatcctcttgccttggccctttgtgcactaggattctaggtgaattattactatacccagaaaaagcttttttttttaaactatcattgtgtgtgtgcacatacttttttttgcacgtttatgtgttaatgtgtgtgcattagaaacaaaggatatcctctgagtgttattattgagaagctatctaccttccttttctgagataagaatgctcattaacctggaactcaatcaattagtctatgtaggctagcccttgagctccaggggattcttttgtctccactttcaccttcccacctccctacctctcaccttccacctccccacctctcatctccccacatcctcacctcttaccttccacctccccacttcccacctcttaccttccacccctcacctccccacctctcaggactgggattactcaatttagggccttgtgcattcagtgcaagttctttacttggtgtctaaagataggttttacataaaaggtagtttttatattgaaaagtattagtgtggaagagcttacaatcattatttttctattataaacacccgaagaaaggatttttctaccttaaaaattctttttaattatgacggtctcatactttaaaatctgaattccacggatggggtggaaatgactgctagtacacagtcaagagttctgtcttgctctgccatcttccttctgagcccattagagactgctaagggctccagagtgctctccaagcaggatcttgggatcccctcgggatcactggtaagtggaatgcaacatcagctccaaagaattgcggagggtcttgtgccagcagaaacagggacaaaggaaccccgcctgaccagaggctgggatccattcaggtcggggccagccccgccatcttctgcatgaaccccctagcacacccaggacctcctgatcacctgagagcacgttggcattggcgatagaagcaacagagcttcttggtcagggtcccgacgggccttcatcctcagccaggaggcggagctgagacccagacccctgggcacattccttgtcagaggagagtcggtctacagggaggattctgaccctagaactcaggaggtggctccaaactgctggacacctgccctgaaggagaagagcttgcctatagagagtgctctgaccactggaactcaggagagagttggactcccaggagtgctgacagaggctaacagaatcacaggtggaacaagctccaaccagagacagcttgcacattaacaccagagatttccagatggcgaaaagcaaacgtaagaatcttacaaacagaaaccaagaacactgggcatcatcagaacccagtatgcccatcacaacgagtcctggataccccaacacacccgaaaagcaagacacggatttaaaaccatatctcatgatggtggtagatgattttaagaagggcattaataactcacttaaagaaatacaggagaacactgctaaacaggtagaagcccttaaagaggaagcacaaaaatgactcaaaaaattacaggagaatactgctaataaacaagtggaagcccttaaaaaggaaacacaaaaatccctcaaggaattacaggagaacactgctaaataggtagaagtccttaaagaactagaggcaaacgctgctaaacaggtagaagaaacacaaaaatcccttaaagaattacaggaaaacacaaccaaacaggcaatggaattgaacaaaaccatccaagatctaaaaatagaagtagaaacaatgaagaaaacccaaaggaagacaactctggagatagaaaccctaggaaagaaatcaggaaccatagatgtgagcatcagcaacagaatacaagagatggaagagagaatctcaggtgcagaagattccatagggagcatggatatatcaatcaatgaaaatgtgaaatgcaaaaagatcctaactcaaaacatccaggaaatccaggacacaatgagaagaccaaacctacggataataggagtagatgagaatgaagatttaacttaaagggccagcaaatatcttcaacaaaattatagaagaaaatttcccatacctaaagaaagagatgcccatgaacatataagaagcctacagtactccaaatagactggaccagaaaagaaattcctcccgacacataatattcagaacaataaatgcactaaataaagatagaatattataagcagtaagggaaaaaggtcaagtaacatataaaggcaggcctattagaattactccagacttctctccagagactatgaaagccagaagatcctggacagatgttatacagacactaagagaacacaaattccagcccaggctactatacccagccaaactctcaattaccatagatggagaaatcaaagtattccatgacaaaaccaaattcacgcaatatctttccacgaatccagcccttcaaaggataataaagggaaaacactaacacaaagatggaaattacaccctagaaaaagcaagaaagttatcctttaacaaaactaaaagaagacagccataagaacagattcccaactttaacaacaaaaatgacaggaaacaccaattacttttctttgatttctcttaacatcaatggactcaattccccaagaaaaagacatagactaacaaactgggtacacaaacaggacccaacattttgctgcttacaggaaacccacctcagggataaagacagacactacctcagagtaaaaggctggaaaacaattttccaagcaaatggtatgaagaaacaagctggagtagccattctaatatcaaataaaattgacttccaacccaaagttatcaaaaaagacaaggacacttcataatcatcaaaggtaaaaatctaccaagatgaactctcaattctgaatatctatgctccaaatgcaaatgcagccacattcattaaagaaactttagtaaagctcaaagcacacattgcacttcacacaataatagtgggagacttcagcaccccactttcaccaatggacagatcctggaaacagaaactaaacagggacacagtgaaactaacagaagttatgaaacaaatggatctaacagatatctacaaaacattttatcctaaaacaaaaggatataccttcttctcagcacctcatggtacctcctccaaaattgaccatataattgatcacaaaacaggcctcaacagatacaaaaatattaaaattattccatgcatcctatcagatcaccacggactaaggctgatcttcaataacagcataaataatagaaagccaacattcacttggaaactgaacaacactctactcaatgataccttgatcaaggaagaaataaagaaagaaagaaattaaagattttttagagtttaatgaaaatgaagccacaacataccgaaacttatgggacacaatgaaagcagtcctaagaggaaaactcatagccctgagtgcctctaaaaagaaactagagagagcatacactagcagtctgacagcatacctagaagctctaggacgaaaggaagcaaattcacccaagaggaggagatggcaggaaataatcaaactcagggctgaaatcaaccaagtggaaacaaaaagaactattcaaagaatcaaccaaaccaggagctggttctttgagaaaaatcaacgatagataaacccttagccagactaactagagggcacaggcacactatttaacaaactcagaaatgaaaaaggagacataacagatcctgaggaaatccaaaacatcatcagatcctactacaaaaggctatactcaacaaaactggaaaacgtggatgaaatggacaacttcctagacagataccaggtaccaaagttaaatcaggatcagattaatgatcttaacagtcccagctcccctaaagaaatagaagcagtcattaataatctcccaaccaacaaagcccaggaccagatgggtttagtgcagagttctatcagaccttcaaagaagacctaattccaactctcctcaaactattccacaaaatagaagcagaaagtactctagccaattcattttatgaagccacaattactctgatacctaaaccacacaaagatccaacaaagatagagaacttcagaccaattccctttatgaatattgatgcaaaaatgctcaataaaatcctcccaaaccgaatcgaagaacacattaaagcaatcatccatcctgaccaagtaggcttcatcccagggttgtagggatggtttaatatatggaaatccatcaacgtaatccactatataaacaaacacaaagacaaaattcacatgattatcttgttagatgctgagaaagcatttgacaaaatccaataccccttcatgataaaagtcatggaaagatcaggaattcaagggccatacctaaacataataaaaacattatacagcaaaccagtagccaacatcaaaataaatggagagaagctggaagcaatcccagtaaaatcagggactagacaaggctgcccactttactccctacctattcaatatagtactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaattaactcaaacaactcaacaacctttctctacacaaaggataaacgggctgagtaaagtaaattagggaaacaacacccttcacaatagtcacaaataatataaaataccttggtgtgattctaactaaggaagtaaaagatgtgtatgacaaaaacttcaagtctctgaagaaagaaattaaagaagatctcagaagatggaaagatctcccatgctcatggattggcaggattaatatagtaaaaatggctatcttgccaaaagcaatctacagattcaatgcaatcctaatcaaaattccaactcaattcttcactgagttagaaagggcaacctgcaaattcatctggaataacaaaaaacctaggatagcaaaaactattctcaacaataaaagaacatctgggggaatcaccatgcatgacctcaagctgtacaacagagcaattatgataaaaactgcatggtactggtacagtgacagacaggtagatcaatggaatagaattgaagacccagaaatgaacccacatacctatggtcacttgatcttttgacaagggagctaaagccatccagtggaaaaaagacagcattttcaacaaatggtgctggcacaactggcagttatcatgtagaagaatgagaattgatccattcttttctccttgtacaaagctcaaatctaagtggatcaagaaactccacataaaaccagagacactgaaatttatagaggggaaagtggggaaaaccctcaaagtcatgggcacaggggaaaaattcctaaacagaatagcagtggcttgtgctgtaagatcaagaatcgacaaatgggacctcataaaattgcaaagcttctgtaaggcaaaagataatgtctataagacaaaaaggccaccaacagattgggaaagaatttttaccaatcctaaatctgataggggactaatatccaatatatacaaagagttcaagaagctgaactccagaaattcaaataacaccattaaaaaatagcgttcagagctaaacaaagaattctcaactgaggaataccaaagggctgagaagcacttgaaaaaatgttcaacgtcttaatcattggggaaatgcaaatcaaaacaaccctgagattccaccccacaacagtcagaatggctaggatcaaaaattcaggtgacaacagatgctggcaaggatgtggagaaagaggaacactcctccattgctggtgggattgcaagctggtacaaccactctggaaatcagtctggcggttcctgagaaaactggacatagtactactactagatccagcaatacctctcctgggcatatacccagatgttccaactggtaataaggaaacatgctccactatgttcatagcagccctatttataatagccagaagctgaaaagaacccagatgtccctcaacaggaggaatggatacagaaaatgtggtacatttacacaatggagtactactcagctattaaaaacaatgaatttatgaaatttttgagcaaaggatgtatctggaggatatcatcctgagtgaggtaacccaatcacaaaagaagtcacttgatatgtacttactgataagtggatattagcccagaaacctagaatacccaagatacaacttccaaaacacaagaaaatcaagaaggaagaccaatgcgtagatgcttcattcctccctagaatatggaataaaatattcatggaaggagttgcagagacaaagtttggagctaagacgaaaggaatgaccatctagagactgccccatccgggggtccatcccataatcagccaccaaatgcagacactattgcatatgccagcaagattttgctgcagggatcctgttacagctgtctcctgtgaggctttgccagtgcctggcaaatacagaagtggatgctcgcagtcatctataggatggaacacacagcccccaatataggagctagagaaagtactcaagagctgagggggtctgcaaccctataggtggaacaacaatatgaactaatcagtacccccagagctcgtatctctatctgaatatgtagcagaagatggcctagtcagccatcattgggaagagaggccccttggtctagcaaactttatatgccccagtacaagggaatgccagggtcaagaagtgggagtgggtgggtaggggagcagggcgggggggagggtataggggacttttgggatagcttttgaaatgtaaatgaagaaaatatctaataaaaaattgtgggggaaaaaagaaaataaaaaaacaggcccaactcttgagacttttgatatgctcatggtttcttagacatgacactgtggtcttctattactttgtgacaaaccattcatttcttcaagtttgtcctcctatacctttgccatttgtttatgatactgaatatattaaaatttatccacttacaaaataaaaaagaagccgggcgtggtgccgaatgcctttaatcctagcacttgggaggcagaggcaggtggatttctgagttcgaggccagcctggtctacagagtgagttccaggacatccagagctacatagagaaaccctgtctcgaaaaaccaaaaaaataaaaataaataaataaataaataaataaataaataaataaataaataaataaatgagttctgtctttaaagtccaaggaattatactttgattatgttgtgatttacaagtgggatatattctcttcaagttgttattttccttgaaaatatttttgttagccctcaggtagttctgtaaaaacagctttttttatttggtaacagccctactaacccatagtgaacttaataaactttaaaagaatttcattccagtgaatatatttcccattcttacacagctgatagtctgctggagagagatgaactgcaatggaattgtctagtaacaaattatcagaataaaataggatgagaagggaaatagtgcagcattgtctttagtactgtgggaagaagttattgcttagctgggtgctgtcagcttcccattactagacccctgaggtagtcgggggaggaagtcatggacaggagaagcatgtgctataggaaagccttttaataggctgagggcagggagaacgttcagcgtggcattggatctgacagttggcaggagtgatattggtgtggtagtgggcgacagactgagtggatttgagagtgaggaagaggactaggtcagtaagtgtagaccctgcctttgagtgagtctgctgtagacctggcagtagctggagagaaataagaagctaaaggtttgtggcacaatggttttgattttggagatgggatccatgaccttcttaaaattctgtgctggtcgaaatgatgaagtggagttggggagaaggtgaaaataaagaacgattcacttcgtcagcactgtagtgtttgaggagtttgttaccaggctgataggcaggaagagggtgtatttgtacagatgcaggcgaactggtagattggatggtggaagtctatacaagttcctctggctgctctgattctttgaaccaaagtattaagttgagaatattgaaagaaagcttttggaagtttgaagaaggaaggaccattcatccacctgggcatgagagcactgtgtctcgggaggcctgaaagattgcatgtgggctttataaagatgattactggtcatgaatttgaagtgagaactgtcatgtgctttctaggttcaggctcagtgtgagtgagaattgtatttaactaaacttggggcttttaagttgtgtttgcacaacttaaaacacaggactatctagggtagcacaggaggtgaaagagaatatcagagttgctttattgaaagcttaggaaactgagccaaacagaaaaagcggggaacgatgaacagtgggaaggacatgaagagtgcagggaccacagaagtcccaaaaatgctcatgctgtgtcttagatgacagggtggcgtgtaaaaatggctggagatgggagaacgggaagagaagagagttctcacacatgaataacgtgaccagaaagacttaatgataagagaagatggttcctggcccccctttccctcagcttctaaatttctaaagatctaaggggaagttccttgcaggtcttaaataacagtaacataaagggtcatttctcagtgttctcctgtttaacgtagtagccatgggtggctgttaattttacatcattaaaactcattcctctacctcagcaatactaatcgcattacaagtgttcaggaactctggatatcagccattgtatggaaacagccccccagcccccatcacataaggtccactggacagtgaatcagcgctgaaacatcataggtgccgagggcttagggagaaaacagtatgatatgcttggagagatgtgagaccagagttagatccaagcccctctcaggctcagattgcaaggtttataagcaaggaaaggatgagtgctgaggtagatagggaaggctaagggtgggggctttgtgaaggcctctgagttgcagtagccattgatagaaggtttgggtagagtaggtattgcatctgaagttagaggcataatgtacaatgggaatgcttcctacctatttggatcacacattttaatgaataaaatcttaaaggttttagtctgtttggagttttttaattaattaaaggaacatgtcaaaaagctaattaatatcctattactaagtaaaatatttagagcattgtctccaaattaatattaagttaatattaaagaaaaggatgcctgttttcactgttcttgtttaacatggggcacttagctgccataagaaaataagaaaaaggggctggtgagatggctcagtgggttagagcacccgactgctcttccgaaggtgcagagttcaaatcccagcaaccacatggtggctcacaaccatccgtaacaagatctgaccccctcttctggagtgtctgaagacagctacagtgtacttacatataataaataaataaataaataaatctttaaaaaaaaagaaatattaaattaaaaaaaaaaaaaagaaaaagaaaataagaaaaagataaatttttcctacaaggaatggaggaggataattatttaggttaatttgtttgtctatataggaagctttattttttaaaaaagaagttattgaaaacaatgaaaactcccctaaaaattaaataaaattaccttgtaatccagtagttctgcttatagacatatgctcaaaagaattaagagcaaagatatagacatattttttttcataaatgtttgcagcagccaaaaagtagaaacaacctagtcatctgtaagtagatgaatggtgggagaaggtgatccgcagagtgcagtctccttcatcctagaagggacacagcacctgtgatagcatgggtgagccttacaggcgcactctgtgaaatgaacaggtgtaaaaggaggattccagtcatctaagctgcctggaggggccagattcttagagattttagaacagtggtggccagaacccggagaggtgagaacggggcgttactgaatagtaggatagagttgtcacttataatagttactttttcctctgacaacacgtgattttgaaataacttgagaaaggtaagtttggctcacagttacagctggggagtacttatggtacagaattgttacttgactgcagaagtacatagctgagactcatgtttcaaggctgtcctatgccatggaagtcaagtcaatcccagaagcaagcataaacttcaagccttccttcttcccagcaactcacttctggccaggacctatgctccaaaggttccacagcctccccacacagtcctgctagctggagaccaggcattcaaacagattagaccaggaaggggaaatttcaggcttagcctaaaacattaaatgtctcctgaaggatcatgtcgtcttcaagggccacatggtatggtcttttaggaagtagtagtaccttctaatagaagaaggttacgtcattgaagatggtctctcatgtacacacacatccctagattaccacgaggtgagcagcttgtctctgctacatgttctctgtcatgttttacctcatcacagacccaatgcagtggctcatggttaaatatttccttccttctgagaaggtttacctcaagtgttggtcacaggtatagaaaactacctaagtgaggtcccaagagtcaggactgtcactgtaactgtctgtacctgctgatgtggtacagagtctgtggaatcagtttgtgaggggtttggaaagagagaaacaaccaagaaaaagtttagaatcctgagggtggagattaatgaggcagttatggttggagcttagaagaccagggtggagatgagctgatgaggtgagaggctgctcactttacactaaagagctgactgtgttttgtccaagccttgagactttgcaggaggctgagtttgcagctaatgcattaatgtagcagaggacatttcaaggtacaccatttcttggcactgttataggcataggcactcaggaacagaaggcagaagagaaaggtttttaagacttacagttttgttaaagttgaaatcaaagagagtgtgatattgctaaaatagattaacattttaaaagactctcatagttaagaattcaccttgaggccctgagagatggctcagtggttgggagccctgtctgctcttccagaggacccgggctcaattcctagtatccatatgccagctcacacctgtgtagacttgtgactccacttccagagaatccagcactctgacacaggtacacaatcaggcaaaacaccagtgcacatgaaataaaaataaaaagaaaaaagaattcaccttgagtttcagagatatttatcctcattgtctagactttttttcttcattattatagagtagacaccaacctttgggcaaaatgttttggtgcagatcctaaatgtcttccaaagtctatgtgttaagtatttccagaaggtgatggtggagcttttagagactatacctcagggtagagcaaatccaagccacattgaggaatcacctcacctgctaggctgcttgctaccaaaaagataagaagtcccaaatgttggtgagtgagttgaccagaaaaggaattctgcataccaatatggttgcagccatattagaaagtagaagtaaactgtggttgaacttgcagcaacagagtggacagttttcagggtaataggaagatgtttgttgttctgtgagtagattcaaagtttagttttatagaatatatttgagatttaagatacaagcctagtaactataggtaataattttacattatatactagaagaaaatctgaacagaactcagaaatagatctctgacacaggacaaggaaagtattataaattggtgttagggtgtttactgttgtgataaaacaccatgaccagaatcatggggaggaaagattttacgtcattgtacagttttcaggtcacattccattactgagggaacccaaggtggaaatctagagatggccaccgaagcagaggccgtggagaaatgctgcttgccagcttgctgggcttagtttcttgacaactaaggacttcctgccacattccactccacccacatcaatcatcaatcaagaaaatggaccacagatttgcatacagtccggaaaatactaatggattaggtgtcagaatggtccattatcagaaccaatctttgaaactctaagagacaaacagcattcttttacttgctagccatgtgcttgactttcagttttcaccacctctaagtaaatacacaaacttctgttaaccttacaggagaattagatgagatttttttttttttggtttttcgagacagggtttctctgtgtagccctggctgtcctggaactcactttgtagaccaggctggcctcaaactcagaaatccacctgcctccgcctcacgagtgctgggattaaaggcgtgtgccaacaagccccgcttagatgaggattttcttagtgaagtgtttgcatagtacacaaagagccagtattttaagatgtaataaaaagtcaagtgttactgtgttgtgacaaaatagtatctccagaggtttaaagaaagaaaaatgcagtctttggaatgataacaaaatagaacaaaacaaacatccggaagctttcagttaggttgtgggcactaagattgcttgtctcttatcttctttgatcatttgcagtaatctcaaaggacttgttctacatattgtctcttcaggccacgtgaaacaatcttgtgataatgctacctatgataatgttctggtcaagaagaaaatttgttgccagaagttaaaacaaaacaaaacaaaacagcaaaagcaaaaggccatgggaggatggcaggtcctgttaagaccagctacaacttgacttgtcaagaaaagttgtcacttaacaccacaaacttgagggtttcttggtgcttatgaaagaatgacttttgaggaggcagtcaatgaaaatatttgggtatttgagctaactgtatacatataattattttaaattagataaaaacaacaaattgcttaattacataaaatagtaaagataaataatgtgttatagttcaccacttattaagttcatttacgtttgtataaaggtgaatttataaatacttggagtgataaatatgtctgaatctgttttatttatgttctatcagtaaaattaaggaaagtataattttgaaattaaagtctagatttatagtaaatacaattttcattcagatctttgttacagtgagatggaacttgtaataacttaggcttttctgtttgctttttagttattaagtcgaaaagacaaaactacctttgaaaaactagaatatgtaatgagtaaagaagataactacaaaagactcagagactatataagcagtttaaagatgactccttgcattccctatttaggtgagtgatgtcgtgttcgttattcgtagttgttgctcttcctgaacaagtcattgttatgaaatgcaaagtaatttttaaagtgcatgtgtcagatttctaagctgaaaataatcaggtaaggaagtatttcccttattgcctgaaatggttttcataacaacttagccttttgtcttcaggttttctgtagagtgtaacaataacttagaagtgttccatgtggtaaatggtatgttttagctattttagtaatgcgtttaaggactgaaacaaacaatgactagtcgtgaagcttaatatattacttgaagacattgatccaagctgtttggtagtagacagtgaattctgaggagtgatttcgattaattcaataattagtattgttgtttgccgaaatgaattgtttaagtgtggaaatttagcttagtacatggcagttttgtatttattatttgatcaagaatttgtcttaagccgggcggtggtggtgcacgcctttaatcccagcacttgggaggcagagggaggcggatttctgagttcgaggccagcctggtctacagagtgagttccaggacagctagggctataaaacaacaacaacaacaacaaaacaaaaagaatttgtcttatatagcttacaataagttccaaaaactacttaaatgtcataatttttcaacaaaatatgaataatgctttgttgaatcttgagttaaaagaggcccccaaataagctgtacttttaaatttgcatgtaaattaaagatgggggatgctgtggataatacacacctaagatacatcagaacaagctggcttgactgttcagagattcatcagatgatgagcgtttgtttctgatacgcctgcctgtctcctctctaccttttatgtagttacctacagtagacttcaagagagcagtttctgagaataattacaagtgtgttatttgtttgggatacttcagtgtctcctttgaagtctttgttagtgactaaaaggtggactcaaagggtggtatataaacatccatctgtcagagggagcaccaatcttaggtcacagagaaaacctgactaattgcattgtgggatgtcctaggatctctggtgtgggtctgcatttcgccttgtcgccaggttgtcatggagcctctcagggaggcaaaatacagaggtgctaggctgtgtttcttcaggctcacggggcacacagatatgctgcacaggggacatgaaacatagcctaagttagggccccagcctgtgtttctctgggtgagaaatggcacaggctgggactgaggctgggggttctcaaattcctgggcacccagatgcctaagatgagcctggggtgaagggtattggggtgatccagcttagctctgggtaagtaccaggagtgagaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtcatgttaaaggggtgtcgtggttacatgctccaggacaggagacaggtctggaacagattcaaatgcccaccattctcaattatgagaattgctggggttccttaatcagctcaaccttatcagtcttttctgtctggtgacatggttccatgagccccacactcgggtgggatagagatgtatttcacaccctattgaaggcgtaagtaacccaaagcaccgtgtagttaatgattactgcattgggttttttggtttttggtttttttcaatcatagcttagctccacccatatttaggaatgtgggaaagaaagaacaaaggagcttttaaaaccttgtcttggtgatctgtaggagcattaataaccctttgttacatgggatcattagactgagaattggtgattgttggttctaagaaggctcttctatgcttaatcttttatgtttagatttcagtctcatttcttttggtgatgcctttagtccacctacttcaaaattgagagctaagggccctagagtggaaactgacttacagtcctaagaactcatttatgatatccacagtctaatggtattctctagcatgctcccagttatacttgctaaactcactaactcagaaactttctgattctgtgattgccttctcactgaattgcttttctatattagatgccataattagttatcttgtagggaaattgtatttaggagtgagaagaatgacaaattaatccttgtgctgtgctttccaggtcagggatctttgctctgtatggtttcttagtggaaacatggtgcagaagttgaagctgtgtatgtgtgcatatatgtttgtgtgtgcataaagttgtgtacattcatgaacctctgtgtatacaaaggaaagaagggaagttgctgagcagaatgtggaaaggttttctgttggagacggccccttgtctccctgtcttggggcctgaaacactgcctttcttttgggttaaagcagacaaggcaaaactctgacatgaaggtgttgatttgtagaaaataccagaaccattttcttttctgtatgttctcaaatgacccccgggtttcttttcttcttatatgtgcttgtgtcttgaagtgttacttttctgtcacatgcttttgactttacctgaggagaaggccctgttgttgctctcttgctcagcatgccgctatccctcctcaaccacatgacagcatcctgtaggttttcttctgtatacttctcagacttcatcttattttgcagttaagacgctagttatttttgctcttggaaattcctaagcctctgggctttgtttcattgacctcccccaccccaaatatgtagtcatataaagatacctgtctaattattttgcactatactcttgagtacagtagagtgatcttaggatttgccatatatcatttaataacttcgctctaggttgggcctgtatgtctatctacttaattttagaaactaaattgtcaacctgagatacttacgttggctcctagttgaacatgtgcttacgtgaatgcttccccttcctgcagagcgatcccagtctcatcttctattttagttcccacgaatgtcatctgtacaccatttctaagctgctacccattcctttgttctgtgaagaacacccattcaagagtgagaagatacagaccagttgacataaacacttgaaacttgtcacatgacaagttatgacttaagtttactttccagcttgagaaatgttcttctgtttttttttttttttttttaatatttatttatttattatatgtaagtacactgtagttgtcttcagatacaccagaagagggcatcagatctcattacgggtggttgtgagccaccatgtggttgctgggatttgaacttcggaccttcagaagagcagtcgggtgctcttacccactgagccatctcaccagcccatgttcttctcttatagggcaactttgttcagtttaatttgtcaaggcatacatacttttgttttgttttgtttttaagtttagttgtgtgtgcgtgtgcgtgtgtggacgctctcctagatgcacgttgtgcatgacaggttgtcagatcccttggagctcactttccagatgcccagcttgtcacagatgctggcatccaaattcctaccctcaggatttcacagccagcgttcttaacccctgagccacctctccagcccttagacttggttcttttaagaaaatattgacgtaaacctcatatgacttattttacattgtagacaaatggttcgttttcctcatttgaggtctgtagtaatgacgtgtgttgaagaaagaagatttgctgctgatttatattctatgctggtgtttcatatttaatttcattttaaattaattaggtcttgatttaacattccttggttttagaatcctactcatgggaaaatatacttagaacagcttccaaaatgactcttaagattctgtacatttgatggggcagaatcgactgaagatgtctggaagcaaatactcacttcactgttcttttcatactcagttttcaatgcttccgttctcccttttgtctgtagaagttcttagagaaaagatgtcatcaaccaaaaggatctttagtgcatagagacagggtaatcggtgaacagctgcttcctaacagaggtgttctaatcctctagtgtttcagggtggtgttgaggctgtcggtggtcagcaagcttagtcctgccacacagtcctgaacccatatcaaggtggaaagagaaccgtgccctcacttctacaggaacacatgacacaccaggcacacacgtgctaataatgcatttttaagactaaaaaacattaaaagttagtaatcaaaactgatcattcattgtaaagatttttctaaaggagtgttagggatttatatagtaatgagattcttccatattgccaaaagtaaatcaacgtgcactacatttcaggaagtagaaattacttttctggcaccctactcctcctcccttaaaaatggcctcttctgttggtttgcattcaaggcaaaaaaagtggaaaagtggtcagttggacaatatagtcaagaaatctcaaaacaagggtgcagtttgtgtagagaggaatagtttggcaagtgtcaaggaaaaattggttttatatgaaagttgttgctttaaatctgaaaaccattagcagcattcatttgtccttgtcactggagagcaatcttaaggggcttgttgagggatttggcatggaaattccacttcactgtggagagagaactagaacattgctcaaaaataatttaattttgtgaaacatggtaaatactttttcatgtgtattttctaaacctcgtttctacttaattcatgccacagaaaaatgcagtagtgtaaccaaattagaatatgttctgaggaaggcatatttctagcactgaaagtgagtgagttgtcacacgcttagggaagcagagcacagaagctttggtagctctccagctgtgtggtagacagcaagtcagttgttttgatgtatggagatacagttctctcagccttaaagagacagctctttccatgtctccctttcaatttcagcggaactatcacattttcactgaggactctgttggaaggattgcccttttgtggtctttgccctgcagggttgctgtccatccactcccttctctgtaataccttgttctgtccaacccacgctgcaaggccttcattgtctttggcttgttttgttgttgttgggctggttgtttggtttgcatgggaggttttagcatgtaaataaaaggaaatatttaatagatacttgccaattcaaaggatccctttctggcctgttcatttgttctattgtcatacagaactgtgttcatgtggcatgtttgcagttctttaggtgcccgtgggttgggggggagaagtaggagaagtagagggggagggcgcatgcctcagctggcagctgtacttgctcagcactgtatttagggctgctgctggacacatagctgggaatgcagcagccctattcagggtacatgctactgaacatggccttaggaacaaggaatctggcagtaactacacctcctgagtggctgtttcttatgctagaggagatcggtattgtttctcacagtgggtttttaatccatcatcaaagttaacaaaaattttaaggcatacctaaatttaaaagaaccctcagactatctggttttgttttgtgtttttcagttgttgatcccagaatatagtttttcagtgtagtgttggtgttagaaaagtctgctatcctatatgcagttcttaaggctataattctcagtaatttctgttcaggtatttcaacaaggtcctgcttcttgcagttacttttgttgttttgggcttctgggtgtgtttgtgtgctagcaggccttgagttcaggatcttcccatctgttcatgctttctgtgtcctatcttcctgtcccctgtccccaagctgagattacaggttacacaacataactgattttctcccctccttgtgttggagatggaacccaggtcttcaaacatgctagacagtctaccaccaagcagcccacactgccagtcccgtcctatagttctttctgtaaggaactaaagaaatacttgcccttttcctttgataaaatgttatatacaaaagtcaccgacagtgatgtcaaaatctctaatggtgagaaacatgtaggtatctatattttaagaattttactgcactttatcatttctttggtttagtaagtaatatatgctctggattaattttacttatttaaatgtttatatttactcattgatattgagagtgtatacagaagtcagtggataacttgctggataagttctctccttgtgctgtgtggagaataaactcagggcatcaggcttggcacctgctgtccttagccgctgagtcatcttgctggcctttgattatatatcatgttctaagccagcagtagagcacattccatcattttcttgtggattctgagattgaactcttagccagtggcacctggctgtaggtttctccttaggcagaactgcagtctccacccctccaccccccaatcccattgaccctcactcctgtcaagtacgttccaagtcccactgatgtcctttctgttgtgagggtggctactttcaaagacttgtgacagatgtcagttggggatggagttaattaatattcttgtgcttatggttttttaaaagaggttattaagccagtctctacttccctactctctccctctctgcctttctacaataaatgtctaaaaacaaaaaaacaaaaacaaacagaaacagatatttagaagtgactgctagccacaagcagaattgcagttgttgaccctttagtaatgtgttttaataacagctaggcattcaaccatatatgcctgatataattattgttgtcagttcttctttagctttggtttggttttttttctgagagacaaggtttctctgggtagccctggctgtcctagaactcgctgtcataatcaccgacaaggaaagctcatgggtcactgtaagctcatgcaaacttggatagtgttcatccggggcggtggagggggtgcggtcgttaatagtacagatggtacttcagccatgtttctgcgagctcaagagcgaacctgcaccagctgtgcagtagagtagaatccatccacaaggtagggcaatttgaaagctcatttgttttctatcttgtgtgtttacttttaccttgttctggttttagttctgggatggttctgtaagatttgcctctgatgtcaggtgtgaaatgctggttggtggcaaagacaaatgccactgccactcagtcatgggttttaccaggggttttcactgcctctgtgatgcatgggaacttggattgcctatggctgtccgtgttaaactgcccccgtgtggacagggtgtctgtgtggctgtccgtgttaaactgcccccgtgtggacagggtgtctgtgtggctgtccgtgttaaactgcccccgtgtggacagggtgtctgtgtggctgtccgtgttaaactgcccccgtgtggacagggtgtctgtgtggctgtccgtgttaaactgcccccgtgtggacagggtgtctgtgtggctgtccgtgttaaactgcccccgtgtggacagggtgctcctttagttctgctgcattttcactttaccttaccatttgtctcacatctttacgattttagcttgatggatgattagctgtaacaagtgaataattactgggaggaagtggttctaggaggccctgataatggagatgattggaaagatgagttagacaaagtaggacaaaggtcagtcacacacactgtaaaatgagttagcagtttgaacctgccagggcctatggagtttgctttaaggctgttgtatcctcactgttaggaaaatgtctttaactgattgttgaaattctgttagatgtaagtataaagctgtccaatctttttcacaagtcacagacagattttttttttcctttgccattgctataaatcaaacccaggccttcacacatgccaggcatgcacagtaccactgagctacactgctagctcgtagttaggtgtatgtttttgaggtaaagttcaatgaatgggatagggggataatgaatacatttagaatcataattcaaatatattaaaaagttggtatactggcgattttgttttgtgatatcagtaccctgttgcttttgtcattacataacgtgtatcaggagattttgatattagcatatcatgactgtcaagaaattaacttgtttatgtaatgagggtgttagttgtgcatttttaaagtgatacattttgtactttgtgccctaaattattagaggaaaatcattacaagcataaattcaatttaaaattttattttaaagttgtacttactggaaaaacatttcctagtggcaaaactagagtttttttcctctagtttcctgtctgtattttcataaataaaatgcactaattggctgaaatctcgaaataatttttttcagtgaaagttagagcagacttatattttttaaataaatcatgaagtatcttgaacatgtatttggatttgattcaaaataaagctaagatttgttttacattgtggccaatatttacatttaccaatattcagtcaatataatttttaaaataacaaggatttgcataatcttccttgaaaggagaatggaactgttttcacagatacatttttatagtagtaaaatgtattttaaaaactgtacctgtaaaaataagttgtgcagagtaacgtgtaatgtttagatttggggaactggaagtgaagttctgtgtcatttacttggaggtgtcagtcaataggcttgatcatcatctgtactgccctcaaggagtaggacccgcctctgtattcagcccagaaaatgccatcttggtgcttgcttctgtagtgaccacctctgtaccatactccgttgaggttagagtgtgcacaggcgttgtaccaccagcctcctttatggaagtgggcgcagtttcctgcaggagaaatagagacagtgaagtaagagtccttctgtgccatgacacttgcagactgccacacgtatgtgcttctcttggagccgtttgagtgactgactccaggaggagtcacttctcattactcactttactagaattaccgtattcatttcactctgtgctgacttaacatttaaataatttcattttcttcaaagtagagtaaatacatgcagtatttgtgtttaagaaatatattgagggagacaaaagtgaaatgggcaggattgactaagggagatggcagagcttgaaggaaaattgaagtctggaagtagctcagctagtaattaaatgagtgtaaacagaaaggcgggcttccagtcctggctctctccttcctcttttgctgtaggaagtaagttaaaatagtatccaacatgctgcttggtaaggcaatagctgaatacagagttaagtcagtattcatggtggggtatgtcttttatcagtacagaaacatgtttttaaaaagacagaagtatagtagattaaatttcatgaaactatttctttctcctccacctcaagtggttttaccagcattgtgctgcatttcagtctctgctgttcccatctaagacatactcttagaccatatagctaaatggtttacctcccataagcctttgttgagatgatgtcatctcataagaaccttttctggacaacagcacccacccaagagcctgatgcccccagccatattctgttccctgatggattgttagtgtttgccaacttgacataatctgggaagggagtctcactgggagctgtgtaggttaagttggcctacaggcatgttcttggggggattttcttgattaagttaattgaggtaggaagatctgcctgctgtaggtggtatcactccttaggcggaagtttctcaactgaataagaatgcagaaagcaagctgagccaccagcattatacctttgtcgctctgtgctcctgattgtgggtgtgatgtcaccaaatccctcaagctcttgctgccatgacttccttgctctgaggaactatagcctggagctgtgagctgaagcaaacccctttagcctctccttaccccttaagttgcttttctcatagttttatcatagcagcagaaaaaggaactaaaaactgttacttggtttcatttttctaagaatatttatctccacctaataaaacattttgtctcctcttgaaaggaacccccaaaggacaaaaatttagttccccactgagtctccagcatctacagtttctgacatggttggtgtccagctatataccaatgttagtcagagtttcattttctttttatttatttatttattattatgcgtaagtacactgtagctgtcttctgacacaccaccagaaggcatcagatctcattacaggtggttgtgagccaccatgtggttgctgggatttgaactcaggaccttcggaagagcagtcactgctcttacccgctgagccatctcaccaacccagagtttcattttcaagtgggtataggttggttttgttttggctctccccagaacttgtttttcccaaagaacattgaggttgccttagaaatcctaaaaaccagattatatatattccctttgactgtgtccaaaataccctttgtgagattgagggcctggttctgtttaatgtgtagcacgtattgaatgacagccatgcttgtttgctttacctgtgtacgtatctttatctctgtccagcgtggtgaactgtttaccattatgccacatcatagagtccccagcattcccctggtacgtccccaggcgcagtctgtagtagtcactttcgggctccagacgaaagctgctgtattccgcatagaccttcttctcgctccagtcttctagttcaatcatcagcttataattgtcttgattactaagcttgtagatattgtccagtccaagccagtactctccatcaatgtttccaaaccctttctgttaataacacagacacatgaacatattggtaagtttagatggtaaatgttgccacaactacaaatgaaatttaaatactgagcagagtgaggatattgtctactcaaggtgatgtgccatggtagacagccttatttctgttagtgcgctttggttccacattgacactttcttttcctttgctttattttaatgtcactattagtttttgtagcttcaaatgctataaagaagagtaaagccaaagacaataaaattcattgatagttactaaaagtatcgaactacctcaatccttcagaaaggttcctggtcatcctcatccacagatgtgtgttctgagagcatatgatactgtgcccatagtaggcagacagagtgcatctaaaaccatgaccattgttcaaacaaaatgatagcgtgtatgtctttaattttattataagtaaaattagcatgatagtaatctttacagttcaccctgtgaaagttgtaagttactgtctgaaagaagtggactaaattattttaataagcatttgacattggacatttgcagcagaatatatttagtaaagttcatcttatcactgaaagtttgacttcaaagagatttcaaggaagttgccccactcccaatttgtggcagttgaggtttagaaatttctggacatattactgttttattcttaactgccagaaattttcacctgagcctgagtaagcacgtggttgcttcacagtttgaacatggaagtcgtcctctagaaatgcaggcaaaacagactcatacaagtcaacatatagatttaaaaacttgaaaatggaattgagttatctttgtaaaatatgcatgcatgtatgtataagttatccagactcaaaagatacatttaaaggataattttagttttcttttcacattttaattctggctgttcaactagaaaagagaataataaaccttttgctagatgatgaatatcaaatggatagttatgtttttagcatgcctgggagggtcactattggaaggcctactcaggtctaccttccccaggtctgaacttgctcatttaccttataattttcccagtttctgaagaaattgacagagccatctgttcttttctgaataacagtccaacccccaggatccaaactgttctcacaccataactgcatcagaccgttgctgttttcaggtttaatcatgtaaattccactggctgagtgtccagcttcctttgcttgctgacagtctttgaatggtcctgtaatttaaatattgatttttgagaaatgtaaaagataagtactaaataattcttaaatcaatattcttaccttcatttgtttctttacagataaccacattttatctgctgtgtgcataatgctctatacaagttgaagaaactaattaaaatacatacaaagctaaaggaaagggtgacatcaggccaactcctcaaagcattagcttgttttatctcccactctcctctgctttgtatactgtagatacgcactcctaaaacgcaatgcattatattgattctttttaacaaatgttgcctgaagctatggtctctatttattctagcagcaggttagccctggtgcttcagttgtcttgttaaggtttcttcttctgatctgtgctatagcacacactgtgctgaattccttcattcttacaagctttactttcttcatacatttttgcaaaatgctgtgggattgacctgctggcatttacatacgtgttttcctggtgccagacttatagtgtctgaacttttatttcgagggaacatacaaagttggtatgttcattggaagtggagcagcagcctggtaagttctgacagtattaaacattgtgttcccttttggtaactcggtcgtattcattcactcactcattaattgctaagaagctctagaaataaagaaagtagagggctggagagatggctcagagtttaagagcaccgactgcccttccaaaggttctgagttcaaattcccagcaaccacatgtggctcacagccatctgtaatgggatttggtgtcctcttctggtgtgcaggcatacatgcatacagaacattgtatacataacaaataaacccttaaaaaagaaaagaaagtagaaccccccaaatttaaataatttgaactttccctagtattcgtaaagaatgcgtgtcaggccaggtgttccaccacacacttttaatcccagaactcagaagctaaggacagatgattactacaagtacaaggtcagcttggggtacgtagtgagttccaggccagcctggcttcagtggagaccctgtcttaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccatccatccatccatccatccatccatccatccatccatccatccatcaggtaggtgctgggattgatctcgggctgtcaagtttggtatcaagatcttacccctgggcattatatttttagccagctaagatttttcaacttcttaaaaatgaaacaaaacaaacaaaaaacaaaaaaaaacaaaaaaaaaaccatgaagttaaatcatttgtagtgtctgattggtacattgtgggatctacagaaaataactgtctagttctactgaacgtccttgaatttcataactataccagtgcttcaaaatttttattttaaacagcatacaaaaattatggctcagaaaaaaagaattatgctaaatatagatatatttgaacaagggagttttaaaggcattcatcaaaaatttttactgaatattttaaaattctgatgtgtaatttttaagtatctgaaactagtttagtcagaattcttaagatttttttctgctctataattttaataagattgctgaagttttgagataacaatacatagtattgtccccattggttcttactaagataaattaatttcattatgtaaacaccattcattgtgtctgtcattggaggcaacttggggaatgtgagctcttccttctggattgcctcttgaggatggagatgccgtgctctgctgacttcacgtctctctccatgtttcaactgggcatcagccaaggttgttaagtcaatgaatcagtcctttagttttaagtccaaggaaatggaaagcaatatgtacaaactgagtgggtcagagtctcgaccccatagtcttatatttcatatatagctttttcaaaattttaaaattatcagtgtccatctgtactatagattattagtaaaaatataacctggaaaatggcatcttttaaaaataacattaggagagctggagagatagctcagcaatgaatgctcttccagaggtcttgagttcaattcccagcaaccacatggtgtctcacaaccatctgtaatgggatctgatgccctcttctggtgagtctgaagatagctacagtgtacccacatacattaaataaataaataaataaataaacaaacaaacaaacaaacaaacaaacaattttttaaaggtaatattaggtattgtgggttttttactctcagtttcattggctcatttttttctcttctgggatttccttggttttgtgtctattatgaaggcctccagaatagttgctaaaaaaaaaattatatatatatatatatatataattcttgttttttgcattccctagtttgctaaagttgttttcattttgagatgggatctcatgttgtagcccaggttagcctgggactggtggtgtagtacaagcttgtctgtaaacacagtcaccctgtttcagtctcccaaatgctggaagtacagccctctttgctgtaactggttcagcgttttcttttcaagtcatgagtggattccagagttctcaaagtattcagagattcttttcctctttcctttctccttgttttgagacagactttggtctccagatgcttgtgcctcagcatccaagcgctgggactgtgtgtgaacactgtgcttaacagagccagtgtcaccagggactgtcagtccctcttgcctctcttgtccctaaccgtcatgtgcaaaagtactgtactaaatatctttacttaatacatatatgctcattgagctgtttagtccggctagttgaaggttatgatatagtcatttctgtcacagaaataagacattactgaatgatcatgttgtgaaaattcatagattaaaaataacagctgatttagccagtaacatactttacattctgctgtgttccatgcaccacaaaatactatagggaaacacctcagatattgatgtcaccccttctctttcccttaatcacataagaataatttcacattgtagaccatgtgttgtcaggcagagaagaatcattccatttcgggtagggtgaacgctgtaatgttgcctgtggaggagcagtggagaggaaaatgaagtggcccccgctcccaccctccggcttccctgcatgtcatgtgatacatgtcaagtaagcagaatgcacaggcaggaccttttctttgttggccgtgcacagttggagctcattgggggaccctcagatactaacatttctattggtggtcattttcagaatgtctttgggtttctattgtcatttaagagccttttctggagggtggagcgaaggctcagactgtaactttccttctgtacagtgtgaggactgagtctggatcccagcattcgcacgagccagacacttgagcatacacagtgtctgaaatgtcagcactgggttaggggtcagagacaggaaatcccagccaatttacccaaatcaaggaacttcaaatttagtgaaagaccctcctatctcaaaaaggaggacacccagggtcaacctttggctaaatacaaatgaacaattttttttttaatttaaaagaattatcttttctgaatctagtgcagggtagactcaggtccagagacagatgaagaaccctgaagttaggtgggaggtgagagaagtggtaagaaaaggttcccacacagcgtggcgaagcactctaatgaggtttgaagcagaacccgtggttagagtgtgaattgagagctgagattgagcagggccttgctgtcttcctgtctgagctcagcatactgaatccaagttaggccgttgggagtcgcgggacctcatctaagccacatgtgggctacatgctgaagtatgtttagtcttccacagctgttgtacatttcctatgtctgaaatataaacgacaggatgatgtttatagcctctcaggtgggccagagactgcctcactcatgtgctcgatggttttacttaaaaacagtcatggtggaatctctaaagttagctacattgtgctcccgagtcgctacttttagggaagttagggtgtctaaggagcatattttactttattgtaaattcttattttaagacctgatgctactaatggcacacgaggggctttgtgagcattgcacccaagggctgctcctgtcgagtagctcccatgtctgagatttggaactaagctttgcttgttgagatcttactgcctgctctcaaagtttagattggaggccacgtaaagattctgttttagcctggttttgttaaataccagagaactgtttttattttccgctatttaacatgtgtttaggtgtttagataaattgaagaattttatcttatctgagttcagttttcatttgataaaacttctaatacaggcaaatttaagtttatcttcagctttactaatttatccagttttggacagtggaccttgtatttacatttcaggatctttgaggcttacaaaacctcaggaaattttagttcaaattattttgtggaaaacagagataaacttgacagtgctttctctcctctttagaaaagacagtaactatcagagctcagttactgggttttataattataccatcagctcattgatcttggcagaaacattttcttattgttactttcattccttttaaattttttgctctagaattagatgatagtttggttttgttttgttttgttttgtttttttaaatagaaactaacttctttctctggatcatatttaacaaaaatttttaaaactactattagaaacttatcaactttatttttgaaaatccaaatttacctctggttcagaaatttggtgcttcaaagaatgtacacaggctcctctatatatgtactcctctataatcagatttatcttgaatgcagaccctcttcttggatgcagtaatcttgaaataggattcattcatctcccatgatacacattttaattcttctcaaagcagaaaactagattccatgggtgaatttgactctccctgtatctcacctaagtggagtcatagtttttgtgccggcttttgactccagcttactaatttttaggtagaatggattgtgtgtcttctgtcatgcatatagagactctagcatggctacctatgtgtaccacactgcagtgagtcacttagtgctagagcatggatgagcgcagtaaccacctacgtcagagcatgtgtaagtacagtagccacctatgtcacacgacatgtaagcacagtacccatttatgttgttctttctttgaaagtctccagtgtgagacacttcccctagagttgcaaaaattgttttaagctaccatgtaaagagataaaacagtaggcgtattaattgttgtgtgcaatgatgcatgtttgttaggagtcagcgtgttagcactgggaagcaggttacaggcatcggtctgttcgagtttctgtcatgagggagggctgcttgttatgatacaactgattatgtcacttggcttatagagtaaaacggaagggaatgcttacttaaaataatattggaaagttatctctgtggctgaattttttacattaaagattgatttcttaggactactctgtacactgtttcttgtaaaagtgagataaactttggccttgcgtatgccgtatccctgcatgcataattgtatggatgtatttaattgtatgcattttcttgtactgatgctcagtgtgtgaaaaaactagagctgatgttttcattctgtaaagtatttccttggtttgttataaataaatatatgtttcttcatttctgctaaaattgatgatgccactgacttaaatttcagatctacttaaaaactcaacagcagctgtttctacacttctacaattatacctactgtagcttaataaagtacataggagttatctttatctataaatattataggaactgctatcctgataaatcatatcatgtcttaaaaacttaataaaatgtaagtttgaaatgaatgggaaagattttttcctttctaagtccagtggacagttttgtacgtgtctttgaaaattaaagggcttgagttgctgattgacctaattttatgatattcttgctgctcttaagacttgttttcatgaaggtctttaggttgaccacgctaagaggctctgtgttatcaagtcatgtaatgtttcagcacctgcagttgaaatgcaggaaggagcttatgtgttagaatgcctctcacttagatgggttgtggttacttgtaaaggtgagataatttaataaatgtatgtattacagacagtagaggtgtttgtgattataaacaactacttcaggcctgtgaggtcaattagggcttacggagggccttctgtttacatcatgtactcattcgttcggtctcctccttatcatttgaatggacaggagttttagaaggaaaaagtggatttgctttgttgaaacaatttttttgaaggaagcacgtgaaatgaaaatgagactttcttgtagtgagaattccagaattttgtttttttaaaaaacacagaaatattatgagaatgttatcattttaatcccagttgtggggattatgggtctgctctagcagaatcatggtttggccagctgtagatagtttctgtgattgtgacattagaatttagggggaggttatataaatgctaggaccccaagagatggggttcctgattggttgttgttggtcgcagtttgttaagtacttgtgcacaaagaagaaacaacaacaagaagaaattagatatcctgagggctaagatcaaacttgccctaagtaaattgacacctctaaccagcaggaaatggtctaatggtaacatcaccccctttcccatccctggttttattccgggatctctttcctttcctctttatccccctttctctcttatctagtgttagggggttgaaagggtggaagaaagaagaaaccacgaagtagcaaaggacagctacacttgggtttttcttgcacaaaattgatgagcagcagcacggtgtgtgcatgctttacaaaggaggctggtaccagtgcagagtgtgttgcaagggaatggctgtggggagcagtcagcaagcacttagacatctgggtaggatgtgtcaggcactgctgcagcacttctgtactaagctctgagccaggacccagcactgttactcccacgcccgctccctcccctccagcttctggatctaaatgaccagtttgttttgcctctgaatgtttacaggggacttgagtagaattcaggtgactgtgcttatgggacaggtgaggatcaaatagataagtctgtcagttttactcagagaaatgtgtcttaagaatataatcttcagaaaacaaagtggtttttaaaggttaaacaaatattgatagccatgtttataagaagataaaagaaatgaataaaatgttaactgtttatttctgcttcttaggctgttgagcattttttaaaagatagttggtattttctagattttgtcaagtaaatatgtatttgtttggagacaatttctcttggtagcccaaatgaccttggagttaggaactctgcaccgcctctcagcccaagctgtagttagaggaatgcaccacccaagcctgcgttattcttgtcattataattgcttctgtaggaaagtgttggtgagaagatgattgttttaggacttgcttacttattcttcacatacgatgagcacagtatgccaaacctggtcccacaggaaggcaaacaaatggatctcagtaactccagtgtagtgtggtacagaagacagaaagcagagaaaagagggaaagaaagagcctaggatgtggaaaaagagaagttcagtattgtctgtttgattcttggaagtcttagcattagtcttgaaagccttgaggtgagccttgatcacttgtttcagtagaggaacccttgccacagtcaggcggctcctacaccagcaggcaggtaacccttgccatcctgagatgtgggggagctctaaaatacagtctggaagacagcttgttcatgtgactgtgtggaagccaggcgcaaggacacatgtgtcagtggatgccactgctgcagacagcctcgtgcgtaaggtggcttcctagtgcagcttttatgtcctgcctttccttatgtaaatgagttttcgtcttccttgtgggcatctgagtccctcctcccccatagtagggaagcagtaatgtaacaggttcaggagagtggcttgtgggacagcggatgcacatgtgacagttctaagtgaaacatgggactctgttgtgcactgggtggtcaccccagagtcagggccagagcagagcagtgagaggaaggcagggtgctcagtatcatttagccttggaaaacagactccccttttctcttgaggtagcaaaggtaggttttatataggtgttttgaagtttgaaagaacaagaacccaggacccgatgagacttagagcagtgtaggaagcacaccctgagtggagataaggacagacgactgcaggcctgaggacaaggagagcacaaggttaaatactccttttgaagacagcaagaaggccagaggaagcagtgggaatctgaagggtggggctgcggtggagctggctgcaaagtggggtgtagagtgagttccttcagctatatgtcagtggtcattctctttgacagcagcctccattgtaagaatttgggtggcagagtgctttttttctcccacagaggggaaaaattataaacacctagaagcttatagcacggagaaaagagatgttttatatcaaatccaaacatcactttaaaaagtgaaatttttgattggacatgtataatggcatcagcacataagaagtaggacttactaagataagagtattgttgcgtgaatcatacagcatcagcataccagcttcgttcttccattggccagtaagcagtaactcaccttcattgatgaaagtcactgctggaatcttgaaagggcttttcgtgggagctgttggcagatcaggtggtggcattacgtctctggggtaacctgggtccctctgtatctcattgcctcccagcagaccaggggtgtactggtggctgttaggactgtgtcgcggtaccacctggacaagagggggagacgcgtgggggtcttgtcgggaaaacatcctcaggcactgctcttccaatacagtgatcgtcacagactggttattgacaagatccgtcaaggacgcatacttcacctctagctccctgtaccttgttgccatcttcagcatttctgtggtgacattgaggattttgttttccagctgggaaagttcgagtgaattgtctcttttacggatgatctcatgtagtagctgcatgtagagctgcgtgactctggagttcatgttccggctttcctttctcagcagcttcacctcgtttacaatgttcccatccacatctaccaccagctgcaggacatctatctcccgcttctgcctagacagcacatccttgaggttctccaggtccatcctggtgatcatgtccttaatagtgcctgcatcctgacctttggtgttgacacagattggccctgttattttttgttcaggtaccaagaatgtatatgaacatttctttgcttcctctttcccatcagtagcacggggatatctcctttgggttattttttttattttgagttgtcctcctttgcaatgaccactgcccagtaggaagagtagtacacttagggtccaaacaaaagccttcattttgaaatgaaattctaccacagcgtcttttaggaagcagtgagtgaagaagaaacaaaaataattaatatcagtttacatacaaactaaaattacattgagatcctatcttgtccctgttagaatagctattattaaaatatataacaaatgctggcaaggatgagcatggagacatcttttctacacaggcagtgagtgggctctaagctagaacagccgctatgggagtccatataggggtcctcaaacaagaactacaaccgtcatatgggtgagatgtttccttgtatctgtctaaaggctctaagtcaacacacttcagagacacttgctcacatgtgtttattgcaacattatccactacagccacgttatggcgtaggtgtccatcaagagaagaatgaaaaaaatttatatattacatacatgtatatataataattaaagtatatgtatttatatattatatatgtatacagtgcctcaaccataaacaacaaagttaagtctttttttgttgtttgttttttattttttgagacagggtttttctgtgtagccctggctgtcctggaactcactctgtagaccaggctggcctcgaactcagaaatccgcctgcttctgcctcccgagtgctgggattaagagttaagtcttactgcaaaaaaatagaattgaagtcatcttactaaggaattagaccagacccaaaaaggcaaatatcttgtattttctcttatttatagaacctaggtttttttgtagacatgcatgatacatgacatgaaaacagggaattatgaaaatagattattttaggaaaggactagaggagaaaaatggggcatgaatatgatcaaaatacaccatatacttgaacaagaatactatgcaacccagtgaatataaggctaataatttttagagtagttactgttctgctcctgtggtaacacacagccagagccacctactagagaaagagtatgtcttggcttacatttccagagggatgagaatctatcctagtggggaagctggcgacagagacaggagttgagaagtcagaccagcaaagacatggaactggacctgggtgggatcgggctgtgaaatctcaagcccagcacagtgactctttccatccaggccacccacagtgccatcagccccggaggtggaggtgggggtgggggtgggggcatttgtgtaaatacacaagcctacagaggacatttctcattgagactactaagggaatactgagaggtttgtattagtaaattagatttcacttgaagtctcgagttcactattaggtttgtaggtttgtattttgacatttgtgtaaagatgagacccttctcttgatgagcttgcagctgccacctgccatcttacttagaggagaatttgatgcgtgcccgtgctatggaaggcacactgccaggcctggggaccctttaagagcccttagaaagctcactgccttgggactgagaacagtacgtgatcttactactcagggttttagattagaatgctataagatcagttaagttggtcttctgcaataaatactgcgacattttttcaacctaccaagtcagacattttagaccaatagaaagtgagcatttttatatcatcctttggagaccagagacagttttaagaatgacgagatgctccccgtcgtcgtgggtaattgtgtttcctgaactgcagttatggttctgctttaagcttaagggtgactcggtgggtgtgttctgttaagaaagtctggtgggttgtattttagttttaaaaaatcctaattgtcaacaagcattatcaaattggatataaaaggtctttttgtacctatgtgtgtaccaaagcaacactgatattagaaacaggtctaaaactttggttccctggcccctggtcagaatctgtcacagccacagctacgccaggatgtgtacttggactgtgccctgttggctgtggcagatgagaattacctgttatttccagtctgacactggaactctttccaagaacctagatttcttccttcctctttagttcactcccaagtgagtagtgcagtagactggggaagaagtgggcaaagtgtgtttgtgctcaggttcatggccaagctaccccacagcagcttcatgccatctgctgtttgtaaggctagcagagggcacccgaggagcagagggcacctcaggaccttttcttgccatctttgctactaccccagcccttgtttcttgatctaagaggtcgaccccggttgtttatgtgtagtccagacagcacagcactaacactactgaatacctagtgagtgctctcaggaggcatggctgtcttcagttccttatatatgaacatcacagcctggtgaggcagatgattctgatactcatttgtacaggaagtggtgccctaaaggcatatcagtagccacacagctgttaaaagatagagccagaatttgaacccaggttgtcttctatctgggtatatgtttttaagttaaccgtttcatcatatggctccgctttctaaactacattctgtcagagttgcactctctgtagcagaatgaagaaaagaaatggtatcactttcaaaagagaagtccccgaggaccaaaaccactcatatgggattcagatactagacctgggacctgtgttttacagtgtctgtagtaacagaaggcatcttggcatgtgctgcctgcagctttccctggcctgttcgtgtgttgtgcaaaagcatgtgcatgccgttgtctgcagtctggcctggtctacaccccatgttgctgtcgttcctctctgcccatgtgtgctccatcagttgctgcttatgtaatctgacttgcaaccccatacgtacatgcacgtccaaacacacttttcttagtgaaatgtgggctttcggcggctgtgcagatagatggctgccacctcactggaaagcaaggtcctcagatgctgtttccagaagagaaataataaacacagcaaagactgggaagagctggggagttgctcggtgaaatgataccatttactcggagctttctgtggctggctggtggcaaaggcacacaagtgagaaagttggctcctgttctgtgttgtgccttctgacaccaggaaatacaaacctgaggaatcattgtttcttacatctcttactctccaagagttacctgtactaaaactgatggtatatttggagttatatttacaggaaattcttggaatttaactgtagatttatcaaaacaaagaaacagaacagtaaaatgaggtaaaaagccattagcctctgggcaaatatatatcatttctcctaactctccttgtcttattttaataataggacagaaaggaagtatcagggtcactaggattaatagtatgaactcaggaaatgtcagtactgaagacttgactcataaaattatttaaatactttctagaatgaaataagctaccaaaacaagggaacttttaaattaaaagcttgaggaatatttggggttttggtctactctgccttgagtcactatggttcgtaaaatcaatcataatatttaagatggtgttcaaagctccttccggtcgctgtttgttctttgcttccttgttccatcagtgatgagcgcattgtctctttaattggagttaagagacatctttaagtagtagagtagatataagcgaagaattgatttttaaaatttgttcactctcacattgtctaaaaatactttcttatttaatgtttcccacgtatgttcagtgaaagcgccatagatctgtcacctcataacccttcctatttatgttgggtttctcctaggtctcaggggaatgtggaaaattagttacagtcactcaagtttgaactgtgcctttgcctggtgggttttagaaaaggggtaaaaaagcttgtgcacttatattcatattcttagtagtatttctctgtactgtattgccagctataaggaggataaaagctgccttcccttcccttccctttggctgtgccctgcactgagagaagccaaaggcattgaagttagctgaggagcactgactggccaggtggaagaccttcctaagaatagccctggaaatgtccccaaaatagacagatgtgatcatttgtgattcgttcgcatgcacgcagacacacacgtgcactcgctctgtgaaatgcctgcataggtgagtgagacttgctttcatcgtggcaggagccacggagacgatggtgtttcagatggagtatgatttcgagaatttacagactctcctgtaaaatacgtatttaacagagctcagagttgagagttttaatgtttaagcaaagttgaaaaaacaaaatctgaacattactattatttgtttgttgaaaattcctaccactaaagattaaaagtcagggaatcctcccaccatagccgcttgctgtctttggtgttaaagcttgctgttggtgagtagcaatttcataattctcatgactaaccaagccccccgatagaatgttgagggcatgctcctgcctcttagggacagttaggaaggttattttatttgcttttggccttgccagtttttcttcagtactgatattttctgagttcatatgcttaatcctggtgaccctgacaggtctcaatcctgaccttgaaggaggctttaattattgtttgtatcaatattacttttccaaggaatttccagctttaatctgttgctgaaatgaaatttctgttgtaggaaattgtttaaaatgattaatcataacaagaaataccatagattaacaaagactcagaagagttttgttcatttgtaactgagattctgttgcaagcattcagctgaccagctcttagctttgttttgtagccatactttgaaaatcgcagtagttggtgcacgtctttacacacacaccagcgttcagaagagaaactcaccgcgctcacagttgtttcctttatcctacatccttcactgtgcaagccttaggcatttactgagttacttgtaaaacgctgtaatgtcactagagcatttgtgtttagaacccagcatgtatgtctcgatctgtagtcacatatgaagcacttcatgactatttttacagaaagatgcaaaacaaaaccttcagatacaaattggcagcatcttctaaagttccctgagaaatctcttactttctagtacaaaggacaatgatgcatttgacatagaattttgaataaatctaagagaaatattaaaatacctttgttgtctgttgaaaaaagcgagtccgtgaacgtgcgtccttgcccttgctctctgagatcagtgtagaagtttgttcggctttacttcagtggtaactgcgttttttgctctgaccggtgaatccaaggagtaaggaacttcttttcacagcactaatggactgagtttgctgggccgcctatgtaacttggagctatctgtggacttctctaatgcagcagagaaggttctgtgcctgtgctgtctgctgcatggagatgtgcagaaaccagccgcagctgacagactgtccacacagtccgaagagtgattccctctcgttctcagtagactcaagttcagcccacatattacgtcattagaaaagagctggagccaggagagggggtaggaacctcctccttaggatttcctctcgctgccgaggtggggctgggggggctggatcagcaggaggctgaatagctctaacaaggagagattgtgtgcaggttgaaggaagggcaccatctggaaacaggctatcatagttcagcaggcaattataaaataaacattttagtctgcctgccacagagcttttgagttggaaaaaaagaaagagagagagagagagagagagagagagagagagagagagagagagagagagagagaggggaagaaaagaaaaaagaaaagaagaaaagaaaagaaaagaaagaaaagaaatccacttcagaagtagctgcaggctgtaaggagctagactttccccagaagcagccacctaacagtgctattctgacagcctccgggacgcttaaaattgtaagtaattgtgtaatgtttaagagaaaattgcttttattagcttgacctttaatctcagcactcggaaggcagttgaatccctatgaacttgaggccagcctggaatacacagtgagctccaggccagccagggctaataagtgagaatctgactgaagaaacacacacgcgcgcacacatgcacacactgcagaccagccagggctagtgagaacctgactcacacacacacacacacacacacacacacacacacacacacacacaccccttgtttttatatgtagtcacctaaaacaagggaaactggtaaatctggtgaaagaaaaatcttaaattctgtaatacataattgatgcttttctgatcttaagttctgtgataggtaatatacttgcctataaaattatgcctcctgtcctagctagggttgctgttgctgtgaagaaacaccatgaccaaagacaacttaggaaaaggttgatttggcttacacttctacatcactgttcatcaccaaaggaagtcaggataggaactcaaacaggggaggaacctggaggcaggagctaaggcagaggccatggaggagtgctacttactggcttgctcagcctgctttatagcacccagccataggaccaccagctcaggggtgactgggccctttcacatcaatcactaagaaaatttcctccaggcttgccctcagctggatctcatggaggcattttcagttgaggcttcctcctctagcttgtgtcaagatgagttaaaactagtcaattcagtgtcaattgtcaaaataaggtggtggtggttgttgttgttgttgttagttgattggtatcatttaaaaacaaacacaaccctgaattaaaagaaaaaaagaaaacccaaaggatcgttgactccccattgactgtgaactgaagatgaatcatcatgtcctctggcccagccttttctgctataaaaataggttccaaaagagcaaaagagtaagtcttgaataactattttttttcatgaaacaaatatttagtaattcaatagctaaggaaacccgaatttcaacatcttcaatagcttggcttaatgctcaatgataagtagaatctgagtttttaactctcactcgaaagcatcgctttcttggcatcctagttgctgaatgaggccttggggcttctcatgctacacacgctgtgtgctttcaccccctcactgccttaactccttccagttgtcttgtaggacctgtatcctttacttactggacgaggttgttaccacttttgtagaagtatttcttagaacgcctctgtcatatttagctgtaaactttaaataataaataagccaactagaatcttaacaggaaaatgctgatggttattggtggttactatgtcaacagccaagagggtctacgaggctgtactgttgccatctattctgggttctgttttgtttttagggaaagcaagtgattggagttttcctggacccttttcagattttcacggggacagataagatagtagcttctaacctctgatttgtgtcccacagttactgagtggtgttttcattcactactactagtcggattgggagatgggagaagggagatggttcctctgagcctttaagtttgagagttatttagctttcttacttgaacaatttctgttactaaccatcatttttcaaaaattggagtgacagattttaggaccacataacacttgatttggcttgtttcctggaaaattaaacatggagatgagttctgtggaaaatcctgaaaagcacaactaaggaactacagagagtgctctgtagagtaaggtgtaatggcagccatggagaacagtgaaaggagcccccaaggacgagaagctaggaaagtggaaaggaggaacagtcgagcaaagagggagggaggagacgtagctcagccgtcctgcttgcctagcatgcggaggcttcatcactgtcagccgagtgactaggtagtggtgaagaccagctgataaagtgttataatgaggaggtccagaattgtgaccttggctaaaaagagtttttagtaccttgaatgtaggtactttgttttgctaattttaagacatctgcatttaatggtaaatatacctcagaatacatcttgattatactgtagttcaacaccgttttcaaccctttgtggatctgtatgtaaaagtgcacatcacagtccaatacaagtcagaaccgtgagctctaggccctgaacctctgtaccattgcatataattaagagcgagaaagaattgagaatggcttactcaggtttagcaaattgataaagtaacatcgaaagactcatgatgtcatgactcagcctttcagaatgttggagttgcccacagtgaggtaaaccccagtgccctgtaatgaccagccatggttgttgccgacgcgtgctttgggagttggcgtgtgtgcgttcctgtcactcagcgttcatgtcttcagtgctcctgccgcttggaccgtaacaaagagtacataatctggggatatatgtattttgcatgcagtgaaaggaacgacttttgaaacccaatccagatagagcagagctcctaacccactgggtacagcttgactatggaggacagtttatatcttctcagaagtttttcacaaattctccagtaatttcttagatgtgacatgctgttaccacagagttttggataaagaaagactcaagtaagctagtgtggcatatccctaaccttagtattatggaggcagatgagtttgaggacagcctagtctatacatcaggttataggccagctagagctatttcgatcccatctcaaatgagagaaaaaagaaacagactcaaatcttctgtctattttggatcaagcctggattaaatggaaatttctgccttctattgcaggtctctttcagatatacaccttagcaaatgacctgtcttacactgatttaaaaaaaaaaaaaagactcgtgatgtaggtaatgtgcacttaaaaataaacactctgttctttacaaattttacctttttatggctaataccagtaaacatggttctttaattttgtatataaaatatttttagcattccgaagttgcttgtttttcaaagccattattaccattttaaattgcacagatactgagtcatggacttaaaattagcagcacaaaccacatacatacaagtcaatgtaccaaatgcagtattaggtgaggattagagtccaggattctgtgggattaactgtgtataaaaggtaggctgtcagtcatcttgttacagaaaatgcagaagactgcgtgtggaccctgctttattagtgatggcactgggaaatgtgtttcatgaacctaacagaaagtggaaaggctagggcacctttaggcactgatgtgattggcccttgttttgcaggtgctatggtaattccaagaatgctgaagtttttttggccagtctctcttgttttgttttgttaaatctctgagtagggaaatacacatttctagtctcaaggacctaagaaagaaacgcatctctagcattctgagtataaattgtcaagttggtagttctctggcatcgccgttggtgagaatgctgggcagtgcaggcttgttcttgcccagagagaatgtcagcaacatgcagagatgcattcagtacctaggtttgactgctatttctagttcctggtacatttgacacaatactataaatggccgtgccttagattctgtttctttcatgagacgataaattactggtcttgaataagattgtgaaacacagctgatagtgtagaaaggcagagaggttttgtgtacgtacgttgggctggtttattcagtaggtgttttaacttgggaccgtccagtcctttagtgtcagtaagtgacagaagtaatgatgtgaaagttggtaaaagctgcactagctgtgaccaccagtcctgagcctttcagtgggagcatcctgtgactacctgagccttcacaagctaattcaagacagtaacagaaagggaaaaccataccgaagaaagtttctcccagtggcctgaaaatccctctgatttaggttgggatggcagagtgaacctctattccaggtgctgtggttatggtgaggtgaatcatttatttcaggcattggcatccttgcagatgtctggggggtagggggctgtttgtttgtttttttcatgtttctaataattttgagaatttagaaaggagatgcttccttcagcagagccagggccttttcagtatttcctcactcctactaccaaaacaacgactatataaacccagcgataccactgggaggtactgtaaaatgtatttcatcttcagtttgatcttacaaccgtgcgttttagttgagggctagacagaatgcagcctattcataaacactgatcattgttcatatagcttcacataaaaaaaactttgaaacatcacttcaaagagaaaaacaactttgcatttatcaaatgtcagcattggaaatgtaggctaaatttataaagctatttgctaatgtttcacattggttatatatttggttatagaaatctcaaaaaatgttatttcagtagtgttgccttttcttctccttctggggtggggtggggtggggtggggtgtaatagagaaaagctgatggagtcgttacctgattctcaatggatggattgacacttaggttacctcataactgccacatttaaagagaagcttctggttgaaagcaaactggctttgtgttatgaatagtgttcatgtgtggtatttgggaagagatgtcaaacttagggaaaacattaacttccccacagaaggccttgtctgtagactcaggaaagtgggttatgcctgactacatgtaaatactgagtttcagatattaaataaccttctctttggccactttgcccactgataaggacttttaattgcagcccaagactttacttgaaaacaacatggggaaacctgacaaggaccttgggtttgtatggtttgaccccaactctagagatctcaaccccaagagatcatgttatgttaataatacactctaaatataacatactggaaaacatacacaggttgagttttcttacctttatttacttgaagtcatccaaactgcaagtcatgtgcctggtttctgttgcaggcatctatttgtctgacttgacctacattgactccgcgtacccatccaccggcagcattctagaaaatgagcaaagatcaaatctgatgaacaacattcttcgaataatttctgatttgcagcagtcttgtgaatatggtgagttaaaagaatggtttttagagttaatttccgttttggtaccacatggccttagctaccttcagttatatttctctcttacgttttcagctactatgtactttactttaataatcatttatcatcttttgcctagatattcccatgttgcctcatgtccaaaaatacctgaactctgttcagtatatagaagaactacaaaagtttgtggaagacgataattacaagtaggtccatcttcaaatttggatactttatctagttctctactttgagccttaatcctttcatctaagtatggagtctactctagtgcctagccagtgggtcgcagtaattacctgtgtttcttttactcactgatacaactgaaccagtaccagcttcagctgggttgttgttgatgatgttgttgttgttttttaattaaaaataatgaagctcttgagccagcaagcgttcagcaggtagacaggcacttgaggacaagctgacagtctgcgactgattccaggacacacacgggtgagagggcagaatcagccacacgagttaccctccctcaaaaaataactagactttaaacacagtttaacgtttttaagctgtagagaacaggcattcaaaattgggggtttgggttttttttgggggattttggttttttgttttgttttgttttttcctttttcttatgtaatgggactcttatagctgtcctttgtaaggatccgtggctggcaaccacatcagtgcacatcagtgcaacttcagtgcacattgcacagctgcggtgctgcctcttggttttcttttggtttcatttgttgattatttttttctttgctttcttcatctgtatatttttcttctggaaagttataatttgctttttttttctgacattagatatgtgaactcttaaaatatttttaatgcacctaaaatttttgtttgaaacctttattaccattttcttccccatatcctattattaacacttaaacattttgtgtcagtgactcacttgaacatactatgaagtcaggttagcctttgaaggttgaaggttcagagagctcctcccctgtgttataactgtcctgagtttgatgttcggagtattactattcaccggtttttcttgtgcctctagttactggtatagaatttatatttcataaatacattttgtctagggaaataagatcgattctcttgatgccttgaaaactcaagatacaagtatttattaatatctctcttctggccaaagaaacttactggtttacgaagagttaaagcgtcatgtaacagactagactcaagtgaaacctacacaattacagagagtggtaaacttttactgactatagcaagattgtgataagagttttgttttgctttaattaaagctaattgttttgattttgagacagggtccctctacgtagctctagctgtcatggaactcactgtgtaaaccaggctgaccttgaactcagaggtccacctgcctttgccgtctgaattctgggatcaaaggcaacaccaccatgcctggcttaaaaccattctcattttcctgaaggacatagacttagctagacttcagatatttccaaaatgacacctgacaacacttcatatttctaggcaggctggtgcgtcatacggattttgttctccttggtggtcagaatcagagcaggcttagcaggtgctgagtaaagcttctgccagttactgtgcttgttgcttagattaaaaagcgaatagatagtgtactttttctcaaagaactcagtgtggcacatgacacatgcctggtaacccggggtcagaggattccttagatggttgtgcatctccgtgtgagtgctgggaatctagcctgggtcctctggaaatcagccagtccttttaaccactgagccatctctgcagccacttaatgtggggtttttggtggataaaaagaaaatagacacttaactaatggaaatgatattcatcctctgttcaggcaacttcatttattatggccagcataagtgttccagacaacatctgtgtctttcagccaggtagaaaaagttcttcatttggttttaacacagaacagtcttttttcttctttgtgacttggcatcactcttatgagatggaagtttgatactattgatacttgaatagcagtgctttcatactgcagttaagtgccataggtagccctggggtgtagccagccagctcctgttctcttccatcctgagagggtgcagtgcccaacagaatgggtgtgcagggcacacatccatctacactgccaaccactgagccgtctctccagctacctattgaggttttcgtaaggaaatatgacattaatattttgccagtacttggtttcttacgttttgctcttttgaaatttaggctctccttaaagatagaaccaggagcaagtactccacgctcagctgcctccagggaggacctagcaggtgagtccggggctggtggtttgtgcacggtttcttggtaagggtgttcccaaagtggggctcattatctcccaaacagtagaccaggtaacctgatctcagatgagagaactacactgtagaataagtgaagaatttgcatgactttcactgctacaaaaaagcaccttctcaaatatatcaatataaaccttcaaactaagcctccctcttagtacatagcctaaaagtcctcgaagaccaggttggtcgggtggggctaagctacgtgacggtgtctggatgaagcacactcggaactgagcaggcgcaggtgactctgtgcctctcacacgcgcctctcattcctttgctggtttgtttcttttttaatggttgattttatatatgtgagtacacaccagaagagggcatcggatcccattacagatggttgggagccaccatgtgggtgctgggagttgaacttaggacctctggaagggcagccagtgctcttaaccactcactgaaccatcgctccagccccacaagacagactcttactgtgtggtttgtgctgacctctaactcgatgtcctcctgcctcagcctccccattgtgggttttaggtgcacacttccatggccagcatttttggacatgctgccactcactgtgtagccctggctggcctggaactcccagaaatccacctgcctctgcctcttgagtgctgagactgaggctgtgtgcccagcagctttttattaaggaggtattttgaaagtcatatgctgtgaggtgatttttactcacataaataaaatccagtgttgggcaatgtagataatttctaacttgagcacttgacctagtctatacatttctttaagtaaattcaaagttttatatatatatataaaagtagggtatcaaattgaaactactaaatctaggactcagaagacctaggtatttagtctagattttgtttttgaattaagagtgcacgcctatctctttttctcatatataaagtagggaattatttatactgcctttgtttactgtacataagagagagaaaaatttttgtatagttgatttattttagaatttggaaaataagtattttcttcaagtcaatcaaataaaactaacaggatctaaaatttagagcacagttttatatcaaaggttttgtttttgtttttaaggatcatccttagaaagcttgtgacaatttccctctgtcttctccccttgaactgttaggtcctgacataggcgcctcaccccagggagggaggaagagtagtgctgctgctgccgccgccgcggctgccgagggagccttactgccacagacgccaccttcccctcggaacctcattccacacggacacaggaagtgccacagcctgggttacaagtcagcaagtgttctaagttgtttgtagatggattgttttatttctttgttattaaaacatgcttctacattctgtttacttaagtagaaattaggtgctgtgtgattgcttttgttaataacatccgtcttcagattcagtaaaaaactaccttgtttgcctaaagagatttattttttcttatacctggatttggaattgagtattcttgaaatgcctatatttgaggaagataaattaggagtttagagagccatagtaatacactgaacgtttcttgttaaaactgtaaccttgttatcaagaactgttatgtgtcataacaaatacaaataataaattaagccctaaaaatctactgtttatatttctaaatacaaaaggaaagaaagagggagggagggagaaaggggggagagagagaggagaagaggaaagaaagagaaaggaaagaaagaaaggaaaggaaaaagaaaagaaaaaaaaaagagaaaagaaaagaaaggcaggcaaatcttgcttagcatcaataggtttgcactaatgattcctcaaggagggacgcattctcagtgggcatggttctgttccaaaacaaactctgcaaacaggttgattgtcttttatctcctgaactagaaacataggaagttataaagaaagtttctctttgtttctagtttcattcataagatgaacacagcagagtttaagagcgcaacgttcccaaacgcagggccacggcacctgctggatgatagtgtcatggagccgcacgcaccatcgcgaggccaggctgagagctctacactttccagtggaatatccataggtgagagactcacccgcacttccagctgctgtaaaatacctcagctgcaaaaccattcatcaaccctagcacagtggttctcaacctcctaacgctgtgaccctttaatacagttccttatgtcatgggaatcctccgctatagaaataattttgttgctgcttttgctagttaatgaattttaatatggatatctgatatgtgacccctgcaaagggttgttagacacccccaccaagggcttgagaccactgccctagtataaacaaaaaattttggtttaaaacaaaggtacaattaaatataagatgatgataattttaaaactattaatggttttgactctaaagaagacttttgaggactttgagaaaagaccagagactactttaattggttggttaactgcatgcaatttggatatggaagagaagaaaggaaagagtcaaatgggattccaagtgccttgacttcagcacccagttggctggtggtgatcttagcacacaaaagactgggagagaatcgatgctgactgctgacatacatattgaagaggtggatgaattttgcaagtcgagaattttattttgaaattgtttggtccttactagagatgccaagtcactggacgtatgagtctaggctccctttgggtagtgtcaggtctacagctatatgaaaagcaccaatatctcaaactgtaagacttgtttagatcacttagctgcagtataaataagtaagactgttctcacatatagaagtttataggaattattctttaatagaagatggactaacagaggaaactatgaaggggagaagcagatgggctcctgcagaagcccgttgtcttgaagagggaagtcgttttgtgtgtatgtgcaccccacgtgtggagttcgaggttgtcctgggatgtcctcctctgtcactctttacctgatttttgaaatagactctttcactgaacctggaacatgctgccaaccaaccctgaggatcctccagcctcttcctgctggtgctggggttacaggcatgtgctgctgtgccaagcttagattttcatccttggacagcaagtacgctccactgaaccagtgccccagtgcagaagagggaaattgtaagcacagcagcatgtggtgcagagccgaactcagatgctgtgtcagtcggtttcctagctgcctgagatgctttccgctgtggttgatcaccctgtgtctttctgagcctgcagcaagggagccgtcatggtggaagcgtgcagcagagcagaaccatttaccttgagttgtaaactgaaaaggaatggactgaggtcctctaggccctccctagaacagtcccctcagtgccccaccacctcccaatagggccgagcgtggggaccatccctttaaaacatggacctctacaggatagcctaggttcaaactgtagccagttggcacaacagtaatcccagcactttggaggctgaggcaggaagagctcagtttggaggataatctaaggtagacagccagactctgagagatggagagagagatagagagagtgtgagagagagctagagcaaactctctaatgatgcacataggccaaaatgcctcagataaccctggagctggagccaggcatttgtgagctgccagcacacatccagggaacacaactcaggacctctgcaagcacagtagaagctcataactgctgagccctttgtctagcccccattttttcttcttaaactgtgttttgtttttttgtttttttatctagtcactacttctttttataattaaaaactgtacccatagtatggtcagctgtgtttcggattgtcacattgctcaagggctaagctgtattgatgtaacctctcagtgtcagtagagatttattatctgagctacggactccctcagcctgagaattccaaaccctaaacacagaattgcttctgaccccccagcgccacccagcacctgtgatgctggtcttctctttctatataaatgctgctaattaaatgacaagacagattgttgcctgacgtaatacctctctatcaatgttcaaagtagccacgtgtgcagcgtcagccttgatagagggggaaaaaaaaaaaagaacctgttttcagttaaaagcttgttattcaccaggcgtggtggcgcacgcctttgatcccagcactcaggaggcaaaggcaggcagatttctgagttcaaggccagcctggtctacaaagtgagttctgggacagccagggctacacagaaaaaccctgtctcgaaaaacaaaaaacaacaaaaaaaagtttgttattccagtggaatatagtgctacttaagaaaaaagattttgtatatatatttcgcttttccctctgtgcattaaaattatattctaatttagctgtagttcttacttttgttgtgaatgtgtcttgtcagaaatgtagatgaaacatttatgaatctccgtggaatcaggatttattgaacattggtttcacaagtaccacaatttcatggcagcaatttgtcagatattgctacttgccaaaacaaacacagggtctcttattccagtcttaattgatattagctcaacgtcagatattacatgtgacacaggcaggttgtggaatggctacagaggatcaaggaggcagggagcctcagctgggaaaccggaaatgaggtaacaaacaggcaggaggtctgtgtgaggggctacaggatcagacttgagctgtagagctgagtgcagggacagagaacagaggcgggaccaaattcagataaagaaatgaacagagacatggtcagtacatccagacagacaagcagggagacagacagacaataatttgagtaagtcacctcaacagaggtgagctgacacagagagtcagaacttctcttcctgtctgtcccctgaggcacacaccaatggtcaggtagttggttggagctggcaccatcagagggctatgacctctgtgaaatcaggctgcaggtgctgccccctccttgatctcctgtctctgttaagtccttttatgaggtctgaatatgccccatggatgcttacagtccccgttcacaccggtaaatgggtagggtggcatcatttctgttcatgagacttgtctaagatgcccaagcctctgggtttgaatcccaccactgaaaaagaagtcttgagaggaaaattacttatatgtgatagtctcaatatgaagttaagacacaataatcgtttactgtttgcccacatgatagccttaggagaagtaagaaaataaatacaaaggcagaaacctgaagagatggcctccagcttgaggcacttagtctaacttaagtaatcagataatacattgtacttactgcgggaagtctttcagtcaagctgtgtcctgctgggaactctgtggtaattctactgagccctaagatcattgcttagattaaatatttttgttctatgaaaacttcgtatcactcatttttaaaaggaacatttgaaattatatttaagtcgtctcaatttcaggctacttattggaaacttcctctttaaagatttctcaggtgatgccatgccctggggaacaccatttcaaatttcattaggctgtttatcctcatcatggtatactggtctcaaaacaagaaattcatatgccgtgaacctctctcaatttcagttacagcaaacttagtaagaaaaggccttttctctctctgcacactttgatggtagaagacttttggttttgtggttttgagcgtctgattcaggggtagaccagttctcttccattaagctacatctccagcccttgtattggttgttgctgtttgtttttgttttcagacagggtcaaatattacttgaaccaagccgtctttgaatttgcaaccttcatgtctccccctctgagtactaggattattagcagcattaacatattattaatagctaccaccagaaattttatttttgaaatataattttatttatggaaaaatcacttctgtaacaataatataacaactttggttttagggagcagtgatggttctgaactaagcgaagagacctcatggccggcttttgaaaggtaggagaaatgatttactaaaactgtttcaaacttacttggtctgtcttaaggaatgtatgaatttgaatttgaagagatacatgttacatatcactaagcgacttaagttttttactggtcagaaaaaatgacaaatagacatttaaatctggaattgtacatgagaatggctattggtgatcgttatgtatgtttatttggtgtttttacatgggttttgaatttttgaaattataatgtagacttttaataatgaatttctaataaaaagtttaaaataaccataattaacttctatattccaaaatgagattatttccttaggtctgggtaatttaatggtaagacatttatttatcactttgttgctttcctaaggacagaatgacagctaacttaaaattacaagtaaagatggatgtttgacataaagatctgtgtatgtgtagtgctttgcacagacctgctgtaaggccatgctgccttctcctccccttaaagctataaactatgtcatctgtgtggagacggtgctctccagtgctcatcaaacagaagacctccctgagactaatgaaaaggtattcacataggtatttgctaaacgcccattcgaaatcttatgtcattacttcagtatgcttgggctcaagacatttgacttgacagaaagaattgtcccatttttacatgtaaaccaagacctgaacttgtaagcagtgagtgcagtggggagttgctgttttttatgcaatactaaggagtggacctagggccttctactgagccctaagatcattgcttagattaaatatttacgttctatgaaaacttcgtatcactcatttttaaaaggaacatttgaaattatatttaagtcatcttaatttcaggctacttattggaaacttcctctttaaagatttctcaggagtatgacaatttcacttaaacactctactttttgatcttttatataccgagtgtcctattttgttatcaccattggggaatttgtaacaacttgattttatgtattctcttctggagttttattttcattctttcttatttttttttttaagttttatttttattttgtgtgtataagtgcttttgcctttatgtatatctgtaccatttcatgcctggtacccacagaggtcaaaaaagggcatcagatcacctagaagtggagtggcagatggttgtgtgccactgtgtgggtgctgggaattgaacccaggccctctgcaagaatggacagtactcgatgctgagccatctcttcagctcccactttcattcttttgagtttacctgaaacagagaacataaaagttacattgagtttgctctttgaatttgtaaagagtgtctttcccccgggaaaaggcgtaacatcagtcttggttaaggtgtatattgtcattttttaggttaacagtattgtttcttaggttgctcaaactgtaaatacataacccagtctaccactgtgttagtgtgttctcatctcagcaggttacctaggaaggcagtttataaggtctttcataactcaaaatagtgattttcttgtataaaagtttgttttacatacaattgccattaacatgtctgtacttgtgccaaattcaaagcagtggctcttcagacattttttaaacagctaaaaaaaatatagcccagaaaaatttacacttgaaataatagtactgtcacacacacacaccaagttccctgcatcaagcctggggccttaggcatgtagcaaatgctgtatcaggagctatagcctcagcctctgtattctaaccacagtgttcctagagacataccaaataccacagtaggtttttacttcgggtatcatatatcacatccttttgactttcccaactttcccaaacaaacaccattgtttctgggtatatttcctgcatcaagtacgacatgatctgggatgaacatgggttcctactgtccttatcatttattgcctttgtgagctgataggaaattacaaactgtgagtatttgctccctagtttatctctactagtttactttgagttatagtagattttctcattttttttaagtttataagccacattacttttaggtgtcttcagagggacatacaataaaatttatatatgcccatataccatatttaaactggaatctaagaagagcaaaggggctttggagcatcttttcaggtttccatactatttggccataaatagttcttaaccttttgacagatgtatgacaatgagtgcatgtgttactgtatacgatagcatgtactttagacctgtgtttctagagtcaatagaaaaaatttaaatgtgttgaatgttttaaaaacgaaccatatcttaccccttttaaggattactatagaaagctagattacataggaaactggaatactattctaggtattgatgatgatcctatgaataaaaatatgagtaatatatacaatttataatggaatccaacaggaacagattataccattctctcggcccggtgacaagagtgccgcgaaatggctatcgaagccacacgaaggccagcaggtacaatcccctgcatcaggggccatagaactcccttctggtgttggtggctggctcatatgggtgtggtctgacatttttttctcttcttcctcagctaattggttttaaaactaaacaaattgcccatgaaaattttctttaaaagatttaatgcagtttaaatttgaagtattctttctcaatcacaaggctaattattaaaaattgcatctttatgtcacactttaaaaacgctattagacctttaatgacacactttctagtgctgctaattatggctgagctatacaaaaatcaatttatttttcttacgttgcaatcagaccatttatttttctagtaagtttatatcagtttgtcctttcaaggtaagctttttcttttccttggatagaccatagagcctggatttagaaacatcttctttcattaagtaatttttattgagttctctacttagctgggcctctctgaactcttctaactgtgggagcacctaaagatggtagatgcaggggggcgggaactcgagtaacaggaagtcacctcagagcaacgagaggcaaaccctgtcagtttgatggtgtctcatcccgtgtgtcccctccatacaaacagctggagcatgaaatctctaggttgtcactttgaagacacctaaataatcataaagaaaattgagcttctatattcttggctgttttaagagctgtacatctcataacacatcaccagagactggcatttaaatcattctatcttaaacataggttctaaactcaactgagggaagacattaaaatgaacgcatatgaaaagggaattgaagtgttaggtttctctgttacagagctctctgttaggcttccaaatgtcactaaaacttcttacccagaaagccagtttctaaaagcccgtgactgacacagttacttttatttaaatactttaaaaggaagtgtgagttttttggggttgttttgttttttttgttttttttttagggagtggggtggagtgtttgttggttgtttattgtttttgtttgtttgttatttgtatttctctgttttgtatacttaaatacttgtaacaaaatcgttgtctccttgccaactgtttgtgatggtttaccacagtgatgtactgtggcatgttaaaaaattacctggaaatcttaactaattttagttaaagtaaattgctgctttctttctaaagtccactttttgaaatatgtgatgaatgtgtatttaaacatctgctggccttaataacttcctaattaacctttacgacagcttaaaactttaaaatcagtaagtctgtaagatcctccgtatcttaccatctctcaataaagtctcagagttttcaacataagaataattggattgtttatgaaccctctcagtgaccaccgcagacacactcttagccactttgcttcgtctcattgttacagctctgcggagtcggaagatttggcggtgcatctgtaccctggagctgttactattcaaggtgtgctccggaggaaaaccttgctaaaagaaggcaagaaacccacagtaaggctcacctcttagtcattaacccatacatttccttactatgtttctttctttgtttgtttttaatgtaaatcctggacagggaaaactctgttcatcaggagggtgagcacacagacaggaagtgtacctggttgttgatttgggtgttcacaaagaagagtgctcggacatgagcttcagccagtagaaagcttctgttagctggccggaaactgcactgggtgtttgggttcccagtatagccctgaatctttctcagggtgagcttctaaccataaaaactatgttctgggttggcataccttcagataacaagttagcttgaagtgtaactacagaagccagaaggcaaggttcccagacctgtgtatggactttggacttggcctttgttgtagttttggcaggtggtgctgtgtgcatgctgagaaatggaaattgaccaattttgttccatcagttcatttaaactttgtaatgcagtattttgtcatgtaaaacagaatcccaattctaaatgttctccaaacaataatcatactagagacagaaagttcatgggaggagcctttagtacagagagaaagtttggctttctcagcaccagggtagactaagggaagtttgtctctttaccacaaatgactggtagatgaagagttagctgaggtgagaaccagaagctgtttctacctcagcaatcctctttgaatagaacatgaatggcgttaggtttacaccttaaaattaacattaggtttgctactgttgagcagtggtggcccacgcctttaatctcagcacttgggaggcagaagcaggagaatctccgagttcaagcccagcctggtctacctacagagtgagttccaggacagccagggctacacagaaaaaccctgtctcaaaagaaaacaaagaaaaagaaggaaaaaaaaaaacattgagtttgtctttaatagatcagcattgatgagattctcgtagcaagagaaaagactgctgctgtggtgttggtgaggcagggtgtgtgctggaaaaccattagctttttgtttttaaagccagactttgttttgtacaggagttatagaacgacgtgatagaagaatataataaaactttgaggagtgggtatgtaattgttgtctatagagaaagagtacagtgttttaatggagtaaaaaataaagaaaaaaatactaagagattggtaaactttagtcactcttaccagtggcacaactgggcttcctcctgtgatactctgctcctataatatggtgccaagaaaccagatacaactagaggtcccaatttcatcaggagaaggagaagacgagggcatggggtgaaggtgtgagagactagatggagtgcctgcctgtggggtgtagaccagctgggaagagtggagaaaggacatgggattggggctagaaggtgatggcaccacagagtaatattgagtactgatctgatgtgtctgtgtctatgtacatattcatagttcgtgcacgtgtgtactcatgtgcatataaatgcacaattctgcacgcagttggccagtttcagggtcttcttcatcactacccccttattttttgagacagggtctcactgaaccacaagatcactggatggccaggaatctgttgtctgtgtatgccccagatacacccagctactacacccagcttttacatgctggggttctgaacccaggccctgtgcatgcacaccaagcaagcactttactgtctccctaaaagttacaggattcttgaagaattactggatccacactaacgtatgttcacatgatgggggggtatctaagatgcagatatcagaagtgctgtaacctgcctctgaacttgcaactccaatagctgaaattagagtagagtgctatcacaaagaaggggaagccaagccctttcagtagttacctgtgtgtttatcctccacaggtagcatcttggacaaagtattgggcagccttgtgtggaacacagcttttttactatgccgccaaatctctgaaggctacagaaagaaagcatgtgagtattcctcctcaaaatccttagctttgtttcacaacctcttcctagttgtaaagaaaacacccctccctagtaggacatgggaccatgtttctcacccaccaactctcatgcttcctcctggtgtgcagtattggagttggaaatgttagtataaggggccactctggaatgtttgtcttagggttttactgctgtgaacagacgccatgaccaaggcaactcttacaagggacgacatttaattgggactggcttataggttcagaggttcaatccattatcatcaaggtgggagcatggcactatccaggcaggcatggtgcaggaggagctgagagttctacatcttgttctgaaggcaaagaggagaagactggctttcaggcagctatgatcagggttttaaagcccacactcacagtgatgcacctactccaacaaggccacacctcctaatagtgccactccctgggccaagcatatacaaaccatgacagtgtgtaagggatcattctggaatgtgtataaggggccattctcgaatgtatgtaaggggccacactacaatgtcttggggtcgcttgtgtgttctcaagttttttgaacacttgttttttcattgcaagtgtgaaaatggcagcttacaaatagctatcaaggcatcagacctttctcagccatgagtttgggtcagaacatggctcaaaacctttgcctcacagcctcagttcctgttatgtaaaatggaaatgaaaacaatacctgaaattctcttctcacctgggcatgcctttaatcctagctctcaaaggcagaggaattatgacctctgtgagtctgaggccacactagtgagttccgggactacttagggagactctgtctcaggcctgagagatggcggagtgaggaggcgagcgagtgagcaggcactgcactctgcttcctatcttcccttttcctttagaagttcttggtgctctctctctgcacatagcctttacttatggaatgattacgttttatagtataccaagtgttagcttttattgtggtatttcaaacagaaattttgttttgttgattatcctccccatctctccccaggcccctagcccagccctcattcttcccccagaagtcacctttcccactgttttttatttgagaatttcatgcacaagtacatttatgtgaattatttctgcccaactcctcttgtatctcttgtatgacattattttcttttgtatatacacacatatataccctacgcttggtatgcaacctgccaaatccagttagtgttgctcttatttgcatgtgtttagaggtgaccacttaggactcatactgggaccttagggagggactgaaaagattaccatgagttcaaggctaacttgggctacttatgagacctagtctcaaaaatgaaggcaagaggaaagatacttgacggccatatgcctatattgggcactattttgttatattgctattttttgaaatttaaaaatgaaaacatactgatattaaaagatttaggtaaagtgtaatcattgcaaaaaaaattaaggtatgtttaaatcaatacatgataatgattcaacaaatgttatttgattggttaaaatttgaaatgtgtaaaaaagaaaagttgtatttttataaagtaagaataaaccaggagagtagagcaggaaagtgaccagaaggtaaaatgcactaactaaccaaccaccttaattacatgctcgctcactggggaagaatggaaagactaagcctgcatcagctgtgaaataagggttgcgtgtgtgtgcctgcatgcctgcgtgcatgtgtgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagttggggttggcttagacttgagtagtttagtctattatctgaatggcaggaagcacggtgacacagaggtaggcatggcgctggaaaggtagctgcatctggatccatgggcaacaaaagagagaaacactaggcctggcttgagcatgtgagacctcaaagcccgcccccagtaatgcacttcctccaacaaagacccgcctcctaatggtgcaagttcctgtgtgcctatggggtcgttttcattcaaactaccacagcaaggaaagttattgatcagctttaaaaaaaccacacatcacagtaaaaatagatccagttagcatgaaactgtatcagcacaaagaggccctgtttgcaagcataggatggagttggggagaggcatccctccccacacatgactgactccagacttaagggttcagcatactccctctgtaccatgggcctacactgcatgacagggtagacatgcaacagaggttaagaagcccatgagctgtcagaggatggcctagtcggccatcaatgggaggagaggcccttggcttgttaagatcatatgccccaatacaggggaatgccagggccaggaagcgggagtgggtgggttggggagcagggtggggggagggtaaagggggctttggggataacatttgaaatgtaaatgaagaaaatatctaataaaaaatgtatttttaaaaagttatcagctgtcaagtgtgctatcctaatgtattttcaatgtcagttttatagcttcctggttttctttttcttttttattttattttttgtgccattaacattactgtggtactatagttattcctttctagtaattttagctgtaaaagatagtgagcagacatgcttacatccttcccaaataagatgtagcaccttccctcgcctgagtcatcttgcagtcctttgtagtcagcgctctgctttccttcacctcgggttgcatgtcacatgtgcacctgtgcactctccctttttgaagacagggtctcactatgccagtttggctgacctaaaactcctataaactaggcagggattaaaggtgagcagcgccacagccagccagccgcatgtgtgagtgcccgcacttgtgcacgtgcactcctaagaactgacagtcactgttggtgcctgcagttgttgtttattttttttcacagttggataggcttgtattctatgagcttatcataattcctgcattccttaagctgtgggtttttatgtccagattctgtgggtatatcctgaggagtgcaaataccaagcttttccataaagggcaaaccccggttcctgctcactagaaatgatgaagctggctccctttggtctttgctgcccatagcataaagcctagctttattctgtgctgttggttatttagtgagcttcacccttcttgtgtttttgcttctacttaatgcctgtgcaggtcttttgcttgttcttattctaattaataaaagttcttcattaaaccaaggcacactccactagtaatgtcacggtagaagtgttgttcattgttctgctgtgtactgtgacttctggcgggtttgtctgttttagctgctgctaggattgagttgctgctacttaaacattcacttttcgtttctgttactgaggttaacctcattttctactcttcttagctcccctttctcaagagaaagaatagttaactataaaaataaccagcatttctaaagcacctaccttttttttttttttttaatctatcttgcttttgcaaaatgcaagtaggaattgtctgatagccttgcgggcacatgaaatattcaggctaaaggcacacaggtgtttgggaacagcagattcccagcatgcctgtcgggaatgtagagtggctgcctaagagggcatgcggagctgacctgtgccagcgtccagtcacacagcttatctcgtgtggacacactgagataagctccctgacacttttaactttgactgagaactggacataaaagtcactggtcctctctgttttctctgctcctctcatctcagttcaaatcaacgtcaaataagaatgtgtctgtggtgggctggatggtgatgatggctgacgacccagagcatccagacctctttctgctgactgactccgagaaaggtgaacggttagacagactggggtcaagtactgcagaccctaactccggatcctgatccggcttctgctgtattatcaacagagaagtatttgaggacttgtatctattgggaggacttttattccatattgtgttttaagcttgaattaaaagcccacgtagtacagatcatggagtctgtatgccatactttggacaaatgctcaccaggtgtaaatgcagtgtgcctcgtcatctgtacccagcagtaacatcattctcaagttctgaaaattaccattgcccttccataacttttattgtgactttattgcttgcttagctcaaatccaattctaaaataaaataccttacatacaatatatagaaacattcgttaggactgaccataggagtctgggaagtgggtgagaagaattggagcgtgggcttgtcagagttcccctgcctggcctgcggcacccgtggtggctctcataggctccacccgaagatcccgagcagttgctcctcttccttcacagcagctgccagctgtttctgacagctaccacgtacaagtccatctggagaattcttgcacatctgttccaaatcgtccacttagcaactcttactgaagtagatcacctttaattaacttcaccactgaatatttacatctgttcaggtgtgatttttgtatcaacaaatagcttttcatgtattataattttaaattaaaattttaatttgtatggtagatgcaagaaaaaagtcgcaccaaattggctataaatcagcttacagagtaagaacaccttactcccagctctctaaattaaagcctcagtcccgtagaatctcatggctactcatcataaaattgcactttttaaatgggatattgagttttattaacaaactctttggtttccttccatcttcttagcaaacttcctagaactatttcggagtacccaggtttttatggttcgtacaagcagcagtatttactgtgtagattgtagccttgacaggttgcagttgcagacctctctattccgattaagtagcgatgcttacctgagttcagcaaacagaacaggactaaggggctttatgagcatcccatgaagacaggacagcagcctctgcaggtgaggaggcttcaggagcctctcggagggctctgagcactgctgggtgcaggctctgcatcctaggagatgagtggcaaaagaagacagctgggctcagcacgctgcagctcacagatcagtgctcgccccaccccttcctcattactttatggagccgtgtaaaacaccctcatcacgtacccgtcttgtctcacattgaatgagattagacacaggagctgccaggttcacacagggtaacttcctaaaagagaaacacttgctgtcttcctggggctggagattttaaactcagtggtagagcacttagcaagtcggaagcccccagagatccccccagaagatatgaacatttgtaataacttggcatatgtcttaacaatgttggtgttatataactggctatttgatgtaattaggaatgactatttaagtggtagatgtatagaatcatgaacaggtgaaacctctgtgctgcttttagaggatgcattgagaagcagggctcggggctggcatgagcagagttgtagactccctacacagagaaggaaccataatcacttttactgtatgcatggtagaaaggtgactttctaaatgttaggtcctgtgagcagatggcataaagaatttccattgggaaattctgaaactgagctctgtagtcatatttcattcagtcttacatatctggcaggaatattgtgttatagtctttaaactgattattttttacttgcttttggcaattacaggaaattcatacaagtttcaagctggcagcaggatgaatgcaatgctgtggtttaaacacttgagcgcggcctgccagagtaacaagcaacaggtgaactctcctcctcctcctcctcctcctnnnnnnnnnnnnnnnnnnnntcctcatcctcctcatcctcctcatcctcttcttctttctcctcctcctcttcctcctcttcatcttccttctccccctcctccttctcatcttccttttcctcctcttcctccccttcctcttcctccttttcttcttcctcctcttcctcttcctccttctcttcatcttcagaaactgtatcttcaaacttttattcatgtgtttaagagacagattgttttagaaagatataagtagctgagcacacctactaaagatataaggtggtgcatgcctttaatcccagcactcaggaggcagaggcaggtggatttctgagttcaaggacagcctgggctacactgagaaaaaccctgtctcaaaaaaaagaaaaaaaaaagaaagaaagatataaagatataagtaaacaaaactatgtaatataaactagagagagaaagacaggtaggtaaatatgtgactgagccttcccagagtgatgctgaaatgagtagttggaaggaacaagctgcataagaacagggtgagtggagggacagtttggggacagcaagtgtgcagataaagctagaggtttttagaatgcctgtgtctggagtacaggcagattatctagtagaattctccatgcaaaagctagcatgtcaggctggagattgccccatggctaagaatgcttgctgctcttgtacggaccagagttcaagtcctatcacccatatctagtgatccaactacctataacttcagctccagagggtaacaggtttcagagagagtctgctggcctgtgagagccactgggccactttatgggtgaggaggggaccactgacctagcagctctgccagcacttaggagtcctgtgctagtagctccatgaaactcagtagcccttaggtagagagtcctgagttttagagactggaattgtgccccatgggaagacacttgaccagtgtgttgaagcctctgagcttcatccccaacacagtaattcttttaattcagacatataagaaatcaaactaagaacaacattatgaactaaccagtacccgggagctcttgactctagctgcatatgtatcaaaagatggcctagtcggccatcactgcaaggagaggcccattggacttgcaaactttatatgcccagtacaggggaacaccagggccaaaaagggggagtgggtgggtaggggattaggggggtgggtatgggcgacctttgggatagcattgaaaatgtaaatgaggaaaatatacctaatttaaaaaaaaaaagaaatcaaactaaatacagtgtaatcttaaagtgctaaactgttgcatatattttaagtcagaaagtgtcagataattttcctaatagatttgactctttagtatttctgaagttttcatagaaaagtccttcatgattgctataaaacagtcagtgtagctttttaaattgatggtaattgtatggaattctgttctacaaggtttgccatatttctttgattcatttatttattttggtaaacacccattaggcccctgtaaggcacaaaaactgtgtccttcctcctgtccaggcacatcaacttggaaaagcgtattaaccgtgattttctagtgatgtggcatgctagactcactgttgtaaaccacacaaagcaacttgtaacaaattccctgtgaaggacatttaaaccgagtggtggctcatgtttaactcctagcactcacaagctcaagggtggcctgggctaaaagctgagtctgtctcaagagagatgtgtaggtcagcgtgatgtgggcttggctaaataacaagacaaaataaatgctgaatttggtttgttaaattttatataaattgttaaacacattatttaataggaaactatattttatgtgttacataataatacaatttatgtgttaaatttcaagttacagaatcccccctcaccgcagagtgaatttgagggatgattcactttaggacattgtgacagagttattcaatgacagagatgtatccagggacttagtagaaacagctaagcagtcggctggagtggtagccatcagtgtgggctgcttgtatttttcaggttcctacaaacttgatgacttttgagtaaacgcctgagacagaagaggagtgctattgttcccgtgtggaaccgggacctgccgagagccccagccgcaccatcccgtgccaggaagagcccccaggctccagcccagcctccggagctcagaaccaaaagcactaatttcagggaatgaagtgagatgttcccagagaaaaacgatggagttgcaaagcaaactgccatgaacttcgcttcttctctccgaactgacctgtggaagccactgccttaacagagtgcgaggagagccgacaccaaatagtgtgtgtgcgtcttctggcggtgctgtgcttggaataaattgtagctaatttgcatttcttttaactttgtactaattttggaggggaaaccatcttttttagatacactttaaaatggaaaaacatttcttatggattccatcaggagctgttttaggtgcagtgagaaataccctgcaggttctgctcagcctctgccagtggctgcctcacgttcccacagcaagacctgggagggacctgctgtggaagctgtgggtgcaggctgggatagatagggagggcatgcctcgctttggatgagggatccatttaaacactaccgtttggaattgagggctagaaggagaacatgatttcctgcaggagggacaaaggctgagtgttcacgtgccagcaggctccagaacacaccagggttaaagtttaactttctgtatgaattcattgttgggcccaaatccgcataggagcacggtgatcccgcgctcgggtttctgtagccttttcacgagtcaggtgggttatccagccacgggtgtcccagggaagaccctggtgtttcttgtgctgttgccccttgcagtgtttaatgtgcagtatgccagacttattttttattgaatttgtttttgttcagtatgaggttcaaaagcatacttgtttaaaaggttcttcatgtatatgtatgtattttattgtaagacaaagcaattttaagaagaataaaggcaaagtttgcagttctaggaattgaaaatataaaaccttttcttgtatgacttcacaaaatgtaccagaacattgtattcagaaagttactgtcggtccccagtgtgaaaaccatgtttgttagtaactgaccaagcattggagagagctctcctaggcaataacacatttaatttttaaaacgaatgttggacttgacatagcttagaattttaaccaaaaataacgcttgactgttgagggtccccacttttacagtggctccgtgtgcaaaggccttgactgacagacacctcctagcaaactgctctttgggtctcatgtaaaatgtctcacattgtgtccttcaagaattgtatactttatcagaagtattttatcaccaagcccattgagcttaactagaaaatactgtctatacagtaattacagtacttagctaaaaaaaagaaattagtccaagagaaaatgaagagccttttctgagtgtttctaatttgaataattcaaagacgtcatgtgacagaaataccttatttgagacttcctagacaagcagggaaaggcacatattgccgtgagagaatgatttttcagataacggtctaagctaacccgtgttgtgttgagtatacgcagacagatccgcagtggccagcggggctacagcgcaggctttccccgtgtgtcttacttttgtcttgcctcttttttttttttaaagcaattccttagtttgttttgctccagaataatgttttaaatagtatgcatactgtttttgagatactgtgaatgagagcccgtggctgttgtagtactactctgtcatgaatatgctaaagccgttacaatgtaggtgaatcaggtctggggagatgggcagctcgcacaggccagcctcacagttttgccaaagagaaagggctgagatgggcgttgtatttggtacacccagctctggacacttacgggtgtgtagaggaagaaccggattcagatttgatcagccaggccctattagcaccatggctcctggccgaaagtaaaactatttttctaccttgagattgctctaaagatcagtcattgctttttaggatgattttagaaaccgtgagagatgcattagagtaggtgagttgttttttatctgtaattcaccaaatggtatcagattacaattgaagcaaagaaaacattgccaaactatattaaatatttgagtattttacttactggagaatgaatcctgttatgcttaccctcaggtgcaaattagttctcaccagctcatttcccacagacagtaaagctcatttgtttctctcatagccaaggagaactctttcagaaactcgattaaaatttaaactttacaagcagaccgactgggatattgtatgttctggtatgatagtgtgtagtagtagccatctctcatctatcaaacagagaggcttatttttcagcagtctgttttaaaagtgtacctgtaacaatgactgcataatgccccaagcaccgttttgggcttcatgtgcttgcttttcagaatatttcaatatgctggctaaactgtaaggatcagaagagttgatggaatacagccttctgtttggtttcgttcagtgtgtatttgtgtaaacagttcagaaaggatctgccttgggattgtgtttttccctctttgtaggcctatgttcccgtagcagttatttttctgtgtcaacaggaccacccactattgtgccaccttcttacaggctcttgatcctgacgttgagtcagtcacagtgttcataactgcagagtttgcagagtttgatttattagaagcccaacaagaacattgttatcccggaggaatgagccatgcttagcccctccatggttggagcaaggatggacacagcctcgtcagtctctggctgcatttcctctccaatgacctcagcagaaagtcttctcctgagattaaatctgtaaattacatacatctaaaactgaggcagtctattgattggaaatcagtactaatagatttaactcattggccttttaagagaacatacccttcctgtttattgaggcacattcctttctacctggattttaagccatcatgcaaaacctcctgcaaacaagagttactggtattgcttactggaagattggctttagtcagaagaaattctctgcccgcaatgcttttgaaagacttggatccttttgaaatggatgctgagctgcactgtgcggggcaacagcagtgaggaccactgctgcttgtggggtgacagctagcggtggttggggtgtggctgacaagcctccttttagggcttgcattcattttcttttatattatttcttagaaacgtagtgccatcctggttttatagctgggggtttattgcttcttcaagcctctgaggtacaagaattgctattaaatagtattgatgataaattgcctatgaaccacttcaaaatgacttaagtaccttttggatttgcttctcaaaaatggcttgtgtctaaattttcagtttgagaatcttctgaagagatgtgtacacaccagctcttcagcccagtgaaagcaatttctttttccctatctccagccatagtgtggggaaattgggtcagtgtctcagcgatctgaaggtcagtgttagggcattgaggatgactgggatcacctgcccacctaaccccatgacttgagggccgtgcttgtccctctctccacccactaaatctggcagtcgtaaaggagactacagacatttggatgcttgcaggcctctcatcttagatcttagttctttttcagagaagcctcccccaccctgttgctctcacgtccaggtaggtgagaaatagagccactcaagtcagcctcttaatgttggctttgaagaacctccatcgagctgagtatacatattttgtgttgttttgagcttaggtttaatgatgaggcctgttggggaaatccgaaaggagtaagatgcacacagaagcagttgttgagatgtcactaaagtcctgtgatggcagtgtgttgagccagaaatggaacttatttcagtttcctacttgagacagaaggaacaagcagtnnnnnnnnnnnnnnnnnnnngcactaataataaatcagagggaagactcagccagggtggggtttggaaacatcttgcttaagaccttggaagtccaggagataccatcatctgagtaggaacactgttttcagggtccttagagaatagacagacacacagacacaaggtctttggacacaagggaagggctagctgttccttgggggtttcagacggtctgcaaaatagagttacaggtgtccatagagcacttgagggtagaaaacagaaaatgccaaatatcagcaggatatttcaaatttatatgccaagtaaaaaatgtcatgtccctgaagatgtcacctgaactactcaaaaggattccaagaagtactaatttaacaggtgtgactaaggtagctgaggggacactgaagtgtttctcaagtgtttctgcaccttggctgttgacacttgttctttgacagcctactgaaggacctggaagaaagaactcaaacatctgtagggataattacccaaagctaataatctatacaaaacaaaaacaaaccaacccacaagccattttcgttgtgtgttccagttaacttgaggtacttaatgatgaaccattcgcttgcactatgacctccttgagtgatgtgcaacttggctcctctctgcttttgtttcattttaatatgcagaagtgagtgtgtgatcttcagtgtgtttgcataagctaacctaaaatgaatttaacaacagttttctgaaatatttctatcgaaataaatgacttaaaagtatagattgtgtgggctttttttgttgttgttaccgtatttacacttaaaatgcagccagctttgtgggtttagtttgggtttttaacctttcaagagaaatcaataaggacagtggctgcagaggaggtttctgccccgaatgggattgtgttcttggcatgcagtgtagacagagggatcttctctcccccactgaacgtgagcagtgcccccaaaggcctcattgctgaaacactatcccgtaggttccaaggcacaactttatgcctccaggactgaacattgaagcttgaacattatgtgtgcttgccaaacattctgccactgaggtgcatactccctgactcctcaacacgggatctcagttgcttgggctggctttttaagtgggccttgaatttgagatcctcctatttgatctcccaagtagctgggattaaaggaccacaccgccatgccagacaagactcgtgtgtgtgtgtgtgtgtgtgtgtgtgtgtgtgtgtgtgtgtgtgtgtgtgtgtgtgtgtgtnnnnnnnnnnnnnnnnnnnnccagacaagaatcgtgtgtgtgtgtgtgtgtgtgtgtgtgtgtgtgtgtgtgtgtgtgtgtgtaaccatgacttagtttccaataattttctccactctttagtgacctttgagaactcagggctttttgttttggtttggttttgatttggtttggtttgaaggcatttattgtagaaaggcagagagagggagagagtagagaagtagagagcagccatggccacatggagagaggggggaagggaaggcagagtgggggtagcaaaggagcatgagtaagagggagaggataaaaggagaactcaggcttttttacaggaaccaaaagcgtatgagagctgtctaggggtcaacctgtcctgcttccttgttcatgcatccgttttccttaaatgcataggtgggtcttcaggttcagtttactatataatttgcttgtcactcagccaagaccacattgccttaagtactgtatgactgtatcttttttcatcttcaaagtcaactcaactgttcctgagtcctgtctccaggatcatcttgtccagtgtaatgaaagtacagtctctgctgtcactgtgactgtaactgctttggtctatagagtagtttgagaattagcaggtttttaaagtttgttcgtgtaagacatgaaatgtctgtctgtttgtttacagcttttactgcccctccaatattatttcagtttccttgttagtggtcttgtatatcttttgttagcttacatataggtaaatttggttttactttgacttttttgttcatttttccctttctctctgagaatgctattattaggtgcttatgtccagcagcttttttgaaagtcagttctatagcttgtccatagatttttgttggaatcttaactacaaacagaatagttgtctattccttcatttagctgtgtgtacgcctgtctgacttgccacatttggcttcgactagtgtacagtgccaggtcagaggcagtgatgacatttcaagagtctaattacccagtcctcagtggacctcgagagtgggtgagacagagacagagaagttcaaatcctcaggtagaaaaatgaatcactgtttactctgagccgccattgctccctctgtactaagtagacctctggccacaggacattacagcgtctgtggaaccaacacgcagcttagactgtttctgaattgtaagcatttttgtcccccaggagataacttgccagaagaaacttggcacacctgggaaagggctctttggacaccgagcaagaagacaagcaagggttgctataaacactactgtcggtcatcagctcaatgtcagcgatgcccagactcagagcccctggcctgtgtggtgttggatctcataaactcaacatgttgaccttgcttgttggaaaagttcagcttttgtccactgtaactttgcccttcctcttcaaagttcagcctactgtatctggaaagcaataacctgcactaacaccacaagagtattttcagaccctgagccatgatatgttaaggtatttggtgagtgccagcaagtgaagagctggaattgagacagatcaaagtccagaaaagcgagtaagtcaccttctgtcactcatgtatccaaggtgttcattctattcaacctgagctaaaagctaaatacatcaacctaaagcacattgaatgagagccttctaaacgagcaaggaaggtgcaaacacaccttcctctctaatccttatagtaagtctagaaaaactgtcctgcttatgggacagaattggcaaacataccccccccaaaaaaaagaaaaagaaaaaaatatcctccttgaaaaaaccccaagcaatacaaaaagctgtcggatggaagctgccttccccacctgccagactgtcccctctccaccccaccccatagttaataaaaccattatccttgaatcagttcctagaatcatttatttctgactcaagctctggcaacatcttctacctctctcaatcaaatgtctaacttcagaccctcacatacattctagcacactaaagcatgcaaaaattactgctgtctcaaaagtcgagaagtgatacagatttgcctatttgttttaatcgtaggggatcagaagcagcatcctaaagtggcatcaaagggccgccttgcatgaaacaggttacataaatcgtctttgaaagctgactaaacgagctggcattttccactttcctataacagataagtagctccagatggtggattcctcagcctatgcgtctatcagatgagacaggaaactgtctgtatttaaccatttggggcctataagatggtaatttcatgtgccttttcctggtacttttcttaaaagcaagtcaaacatcacaaaattatttcaggtctttaaaaagcaatccgtatcgggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagtggttcatcttttaaagatatatttactttcattcatatgtatgtatgagcctggttgagtttatgtgcatcttatgagtagcatccacaaaggtcacaagagggtatcataacccttaaaactggagttacaaatggttatgagccattgtgtgctgagaaccaaaactggattgccttcaagagcagcaagtgctcttacccactaaaccatctctgcaggccctgacggtggtagctcacttctgtccttcaattttaaaatactctgtttttctcacctatttttccttcctaccccatctccattcttccctatttgagtttgttcacataagtgccatctgtcctatggtggttctcatttgattccctgagttgaaatctacagtcggaattaagcagccatggaagaggaactctgagaagaagtggagcaggaagtgacagccatgtgtcgccaactagataaaagtttcattggtggaaacttgtgatacatctatggcttcacagtcaaacgtagttgggaaacattaaatggaaagttccagaagtttcatgccaatctgagtgcactgtctgcccagtagtcatttaataactgccgtgggttttttgtctttttttcatcgtatctcatgttcatgtgaaacttgtttcactgtagaggtcccaaaatgggagagtaatgactagcagttcagataagccagcaaggtaaaggatggaaagaaacaagatggcagtgtcactgagctccacagtaagagcttgcttttgaaattgtgaaaaaaaaatgtgcaaactttggtaccaagcaaatccgaaaaagttgtagccattgtgccaagataccagaagcaatacaggtctttccagtagtaactgaatattaatcccagcacttgagaggcaggtggacctctgtaagtttgaggccagcctgatctaactagtgagttccaggacagccagggctacataaagaaatcttggagagagattagggggtgggagggtgataaagagagagatggaaagaccagccagatagattagaaaacagaatccctcttttcgctgccttcaaataaataaataaataaataaataaataaataaaaacccttaccagcagagaaaaacactatctcagggtaaaaggataaaagaaggtattctaagccactgggactaggaagcaagcaggtatagcttgtttgcttctaatatctgacaaaataaactttaaaactggtcagaacaaaatgagggcactttatacttatcaaggtaacaatccaacaagagaaaattataattctaaacatgtgtgcaccaaatactggctcattcaatttcataaaagcaagaactattaaatcacagattaatcccaaaatagtgactttgataccctcccttcatcattacacagagcagctgaacccccaacccaaaaaagaataaacattggaatttgtggagagccgtgcagcgagcaatcgccattataagatggcgctggcttccactgtgcctaactagtaaacaagccttgtgcacaagtgcgagagtaaactcacgcctagtcactgcccatcttggggcgtagtaatgaggtgatgggtgagcaacaaatcaggagctgacacaccacatcaggtgctgaaacaccacgctgagggctatataagcagcgccattttccggggtctgggtcttccctccttaagaagcaataaagcttgccgcagaagaatccgaagaatccggtggtccgagtgtgttcttgccagcgagaacgatagctcgggacaggaattaaagacaccataaatcaaatatggacctaacatggatggtacactcacccaaattctaaagaatacacatcacagcctcagcagccctcggaacctctcaatagaacacattcaagggcatgaggtaagtaagtctcagtaaatatatggaaaccgaagcatcatcctgtattctatctgcccacagtgggataaagctggaagaaataacagcaagaaacgcaacagaagtcagacagactctcggaggttaagcaacaccattacatgatgaagaaagaagacccgaattaatacatggaaagggagacatagcaggcaggcaggacattccgggtcacaaagtcacactttcaaattgtatactccaccaaatgggaaaatctaaaagacacgcatgaatttctagaggcatgtgacctccaaagttcaaccaggatgat

SEQ ID NO: 548 - DNA, 2176 bp, Mus musculus
tggccttggacatgaagtaatcagacctctgttgctgttactgtaggctcaggggctgatgaggaaagcatggacctaatgaacgggcaggcaagcagtgttactatcgcagccactgtttccgagaagagtagcagctctgagtcactaagcgagaagggctctgaattgaagaaaagctttgatgctgtggtgtttgatgttcttaaggttacgccagaagaatacgcgggtcagataacactaatggatgttccagtgtttaaagctattcagccagatgaactttcaagttgtggatggaataaaaaagaaaaatatagttctgcaccaaatgcagttgctttcacaagaagatttaatcacgtaagcttttgggttgtaagagagattctccatgctcaaacactgaaaataagagcagaagttttgagccactatattaagactgctaagaaactatatgaacttaacaaccttcacgcacttatggctgtggtttctggcttacagagtgcgccgattttcaggttgactaagacgtgggcgttattaagtcgaaaagacaaaactacctttgaaaaactagaatatgtaatgagtaaagaagataactacaaaagactcagagactatataagcagtttaaagatgactccttgcattccctatttaggcatctatttgtctgacttgacctacattgactccgcgtacccatccaccggcagcattctagaaaatgagcaaagatcaaatctgatgaacaacattcttcgaataatttctgatttgcagcagtcttgtgaatatgatattcccatgttgcctcatgtccaaaaatacctgaactctgttcagtatatagaagaactacaaaagtttgtggaagacgataattacaagctctccttaaagatagaaccaggagcaagtactccacgctcagctgcctccagggaggacctagcaggtcctgacataggcgcctcaccccagggagggaggaagagtagtgctgctgctgccgccgccgcggctgccgagggagccttactgccacagacgccaccttcccctcggaacctcattccacacggacacaggaagtgccacagcctgggttacaatttcattcataagatgaacacagcagagtttaagagcgcaacgttcccaaacgcagggccacggcacctgctggatgatagtgtcatggagccgcacgcaccatcgcgaggccaggctgagagctctacactttccagtggaatatccatagggagcagtgatggttctgaactaagcgaagagacctcatggccggcttttgaaaggaacagattataccattctctcggcccggtgacaagagtgccgcgaaatggctatcgaagccacacgaaggccagcagctctgcggagtcggaagatttggcggtgcatctgtaccctggagctgttactattcaaggtgtgctccggaggaaaaccttgctaaaagaaggcaagaaacccacagtagcatcttggacaaagtattgggcagccttgtgtggaacacagcttttttactatgccgccaaatctctgaaggctacagaaagaaagcatttcaaatcaacgtcaaataagaatgtgtctgtggtgggctggatggtgatgatggctgacgacccagagcatccagacctctttctgctgactgactccgagaaaggaaattcatacaagtttcaagctggcagcaggatgaatgcaatgctgtggtttaaacacttgagcgcggcctgccagagtaacaagcaacaggttcctacaaacttgatgacttttgagtaaacgcctgagacagaagaggagtgctattgttcccgtgtggaaccgggacctgccgagagccccagccgcaccatcccgtgccaggaagagcccccaggctccagcccagcctccggagctcagaaccaaaagcactaatttcagggaatgaagtgagatgttcccagagaaaaacgatggagttgcaaagcaaactgccatgaacttcgcttcttctctccgaactgacctgtggaagccactgccttaacagagtgcgaggagagccgacaccaaatagtgtgtgtgcgtcttctggcggtgctgtgcttggaataaattgtagctaatttgc

SEQ ID NO: 549 - protein, 608 aa, Mus musculus
SNQTSVAVTVGSGADEESMDLMNGQASSVTIAATVSEKSSSSESLSEKGSELKKSFDAVVFDVLKVTPEEYAGQITLMDVPVFKAIQPDELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYKLSLKIEPGASTPRSAASREDLAGPDIGASPQGGRKSSAAAAAAAAAEGALLPQTPPSPRNLIPHGHRKCHSLGYNFIHKMNTAEFKSATFPNAGPRHLLDDSVMEPHAPSRGQAESSTLSSGISIGSSDGSELSEETSWPAFERNRLYHSLGPVTRVPRNGYRSHTKASSSAESEDLAVHLYPGAVTIQGVLRRKTLLKEGKKPTVASWTKYWAALCGTQLFYYAAKSLKATERKHFKSTSNKNVSVVGWMVMMADDPEHPDLFLLTDSEKGNSYKFQAGSRMNAMLWFKHLSAACQSNKQQVPTNLMTFE

SEQ ID NO: 550 - DNA, 91749 bp, Homo sapiens
  misc_feature (1)...(91749): n = A,T,C or G
cttgaagatttccaacaatttgtaaaaaaaaaaaaaaaaaaaaccacatagcttagaaatataaaaaaaaattaagaaaaagggatggcgtgaatgtataaaatatatgtagatactagtctattttgtcttttactaccatgagatatatccaaatgtattaagaaaagttaatatttatcaagacttatgcacacaaagaccttgtgttctgccatatgcggtcaagagaactattaagaaacataaagatgcagtattaagtcataactgcataaaattaactgtagtgcataccattctattgtagtaattttgtaaccacctcgcgttgctattacagtgagctcaagtgttgagagtatctgctgaaaatgatgatgctaatcagttatctccacatgagcagttcctgtctccagtaaattgtgttatgacgttaaaatgtgatctctcactgtgtttagtgcaatatcctaaccttgaataataccatgagacccataagaaataccattagtggtggtggaagtgcttctaagaagcagagaaaagttacgacattacaggaacaggttgaattgcttgaaatgtaccacagattaaggtctgcagctgcagttgtctgccatttcaagataaatgaatccagtgtaaggagcattgtgtttcgttttttttttaaaaaggaaatttgtgaagtcatcacttttcatacaccagcaggtatggaaaccccacacgttttgtgaaatattgtgtcttttatcttgtattgaaaatgcagctttttaaatgggtccaggatttctataagaaagtatacccatagcctcaaatattattcaagaaaaagcaaactcattatatgacaacttaaaaggaaggtgaagtatctaaagctggagaatttaatgccagcaaaggatggtttgataattttagaaagaagttttgcttaaaaattgtcaggataacaggagaagcagcttctgcctaccaagcagcagcagacaggctcccagacaccattgagaaaatcattgaggagaatgggtatctgcttgaacaagttgctgttgttgttgttgttttgagacggagtcttgctctgtcacccaagctagagtgcagtggcgcgatctccgctcaccacaacctccacctcctgggttcaagtgattctcctgcctcagactcctgagtagcttggattacaggcacatgccaccatgcctggctaattttttgtatttttagtagagatggggtttcaccgtgttggccaggctggtcttgaactcctgacctcatgatccgtctgcctcggcttcccaaagtgctgggattacaggccactgcacccagtctgaacaagtttttaatacagatgaaagtgtcctactctggaaaaaaaaaatgccacaaaggacatatattagcaaggaagagaggcaagcaccacaatttaaggcagatggggataggctaactctactgttttgtgcaattgcggttgggtttatgatcaggactgcccttacctataaagctgctaaaccctgagtcttgaagggaaaaggtaaacaccagctgcccgtctttggatgtaaaataataaagcctggaaaatgagaaccccttttctggattggttccattgatgctttgtctctgaagccaggaagaaccctgctaataagggactgcctcgtaaagttcttttgattctgagcaatgcgcctggccacccagagccccgtgtgttcaacaccaaaggctcattacactcagtactttatgaaaaggattgtcggtgatatataagaacccttatatagaacatcatcaaagtctaaaagaattgcactattgaagatgccatcattgttaaagaaaaagccatgaaagccatcaagcccaaaacaataaatttcagctggagaaaactgtgtccagatgttacacgtgaattcacaggttttatgacagagccaaccaaggaaatcatgaaaaagattgtggatatggcaaaaaaagttagggagctaagagtttcaagatacggatcttggagaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaattttttaatacttttctgactcctcaaataaatgccaagaggttttggaaagtccgtccaattcttagaacatttctgcatcattaatttaatggaaaaaatgctttgtcacttgaggaaaactgttggaaggtgactgaaaggaaatcatgaaagagattgtggatatggcaaaaaaggtagggagctaagagtttcgagatatggatcttggagaaattcaagagctaataaacaccacaccagaggaattaacaaaaggtgacttgatgggtagaagggagggagggagggagaggtgtgtagtcacattctttggaagcagctgggttaaaattccgtttgaagccctccattctaaagaagcttataattagaaaacaagagaaaatgtttttgaacctcataagatggtagtttctgtatcagaaaacatttcccccatgaaacagtgttacatcactagcctatctcatacaacaataatcagaactacactttacccttgaatgtctctggagttagaaacaccaggctcccagaagtcgaaaatttgcaggtaaaactcaactactcatagcctaccattgactggaagccttattgataacataaacagtcgattaacacatagtttgtatgttatatatattatataatatattcttaaagtaagctagaaaaaagaaaatgttattaggaaaaatacatttacagtactgtattgtacatcataagtttacatagtctgtttataagatatattgactgaaatggcagcaggacctcagtctatggtacatatcaagcaatgcaacttgttcttgaaatgtcatgacttttctttgcttcttaggagcacttccagcatctctagtggtgcttcttatgggtcccatggtgttattcaaggtttaggatattgcactaaacacgatgaaaaataacgtgagaaccgtgagaaatcacattttactgtgataatacaatttactggagataggaactgctcatgtggagataagtagtgtcatcacagggtgttttaagggaatactctctacacttaaactcactgtaagagcaacacgaggtgggtacaaaattattatagtagaacagtatgtactatggttaattttatgcagttatgatttaatattgcacctttatgtttgttacatttctctggactgcatatggcagcatgtaaggtctgttggtgtgcataaattttgataaatgttaacttttttaaatacatttgtgtgtattttatggtagtaaatgataaaatagactagtattttatacattcacgccatccctagctttttcttaatttttcgatactccaagccatgtggtttgtctgcaagttttttcaaattgttgcaaatcttcaagacaaaatttccaaaatattttttgaaaaaaatctgtgtatgagtggacccacacagttcaaacccatgttgttcaagggtcaactatgtacctcattttgataagagtgttgtgaaacttacattcatttctcgtgggagtgtaaatgattcagtatttcaggagggcagtttgacaggtagcagagccttgaaaaggttcatactctttgacctcgtgatttcttgtaggactatatttttaagaaataatcagaaatgtcagaagaggtgcaaggatattcattatttgtaattatagcattacttaacaataggaaaatgaaatcagccttttgtgtaaaggtctataatggagtttgacttctttgtcaaatggctactttgagtggtttgataagtttaatttgatagacactttgattatagcattaatataagttttgtaattatagtaattggctaaaaacgaattcagttacttagggatttaatcttaggaattttatcctaaaatatgacatctttatgtagttgtgtatgtatgctgtgattttggaaagaacaaaaatgtttctagcagtttgatgttttcagtatcattgtcataatatttttgtgtgaatataatttttactactaaatgttttctttttttacagggagataatataaaatgatcatatagctaggctaattgaatatccagaaatttttatttttgctatagaattgctttttatcatttcattatttctttcagaaatttcaagcttgaaagatatgatctaattttagatttaaaaaggcagtttttatctccacagcattcactccttatctactgtgtagaaataattgtcatctctcccctcagtattccctatctcagttgctcaaagcagaaacctggaatcttagtacttctgcagacttcgtttttagcttacatcacatgagtccaattcttgatgaagtcctgtctgcctccagagtatcttgagtctatcgtatccatatccactgacagtgccctggttgagggaacattacttttttcttgaaggactatagtatcatcttaactgtttcctcaatcttcccctgactcaatctattcctttttttttttttggtttctaatttaatttaagattttattgaagttttgcatgtatcatgtttaagaagtcaaatatttgcataagagaacaaaatatagcaaaatcctaactcagttattcgcatctttccaacctcgatcctggagctccactcccacccagatctcttagctggttcttcttttttttttttttttaattaattgatttatttattattatactttaagttttagggtacatgtgcacattgtgcaggttagttacatatgtatacatgtgccatgctggtgtgctgcacccactaactcgtcatctagcattaggtatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctgttcatgtccttcacccatttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttggtgtgcagaagctctttggtttaattagatcccatttgtcaattttggcttttgttgccattgcttttggtgttttagacatgaagtccttgcccatgcctatgtcctgaatggtaatgcctgggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttggctagctgtttcttctttgaggaatttatgtctgtttttcacataatatatctaaatccttacttttccttgatttttctattttaagtatgatatgttaactctttactatagaagatgatttcactgtcttatattctctccccccatttatataattcatttctccttcttttgcacatacagttatatcacaattttgactaagtaactatattttttacaatcgaactgtacttaagttttgttttctttgagctaaaatgtactttagttttctttgtatccatcactaaatttctgccagaagtgaatgtactgaatgtctcttcttaatatttccaaacacataaggaattttttttttcactttcagaaacagatgtctgttggaatttctgtcctcttgctcctttcttgactcttgttcttaaaggtctgctcatagctttgccccaggatctcccattgctgttaatcagaggattcccaatatatatatattttttttctatattggcttttcagtttcctgggtctcatatcttcctttttctttgtttgctagtttgttttgataaagcacatactctactagttctcagagagtaggtacatagaagacaaattctctgagatgttcatgtctgaaaatgtctgtagtctactttcagacttcattgatatttgtgttggatatagaattctagaaaattgaattcttcaaaattgaaggcattgcttcagttgttttttaacttccagtgctgctattaagatatctgataccttctgatgcctgttttccatatgtgctgttttttgttgttgttttgtttttgaatctctgatcagttttctctgttccctcttaaaattactgttattcagatgttgactcttatggtcttcaaattagcataacaacattttactcctatcattaactttttgtttaaaagatttagtcacctttatttcacaactcttctactgactttcaaatttctcttatattttttatttctaaaagctctattttgttctctgaatatttctttttatatatcctcctgtttttgcttagtgggtacaatgtctttttctcatgtattaaaaaataataattatatggttttggcttctttttttctcagttttcttcgctccctgccctaactcgttctctgccctaactctatttcctcagttctttttctttttttgttgtggttctctctctccctggctattgttgtattacagaagtttgttaacctgtttcggaccttggactcgtccggcaggctgaagcctatggaatgctaacccttctttaaaaggaaatcagttctattaaaatatacttaacaaaatattttgtaaagctgttacacagcaatacatgtgcttctttgcccttaatgtattaaaatctagaggtcagtcttaaatactaccgtatctgggtgtgataattcatgcctgtaatcccagcactttgagaggctgaggcagtaggattgcttcagcaaaggacttcaagtccagtctggccaacatagcgagaccctgtctctacaaaaaatacaaacaaaattagccgaatgtggtggtacacacctgtagccccagctacttggaaggctgaggtggaagaattgcctgagacagggagataaagctgcagcgaactatgaccctaccagtatactccagcctgggcaacagaggaagaccctgtctcaaaaaaataaaataactaccataagtttgaagcagtgatgagtgtaaatgatatttttaaggtatctgcatcaactgtaatgtgatatgaaaatatcagtgattttgattggtaactacatcacatgtgttgccaatgccactgtaatctgtagcctacatttataactaaaaggactgtcttatttcagttagaggttagtgtaaaatgaaaattaattttttaatatacaagtttgtgggcattttgtattctgtcgacaggcactttttggggatcatgatcccttttattaaaggtttcttcaagtgtttggggtaattgactgttagctcaaagagtgagatactagaaagctgattgggagctctgggtgactgaatagtcttcactgtatgttgtgggatgctcatctttatctgtggatcttttcctcttgggattcaaatcttttcagaaaagaatccaccagtattctgcctgtggaatgtaaatttgcctatgttttcatagtcattgtgctctcttatgtcctgctaatcaaatttgcttttgtgatccaactgaatggatataatattatgtatgttcccattaaataaagtgattctagaaaagaacacaaactgtctttaatgttttgaaagccttaatctggcagaaaaaaactaggctattacttaaatttaattttcaccttaattttccaggagctttcaagttgtggatggaataaaaaagaaaaatatagttctgcaccaaatgcagttgccttcacaagaagattcaatcatgtgagtttataaattttgatactgtgtctgaaattcagttcctcaatatatactttttccttaagaaataatttaactttttacatcagttctggaatattttcagccagtatctctcaagtattgtctctgtgcatgatctctttttttctctgtaactcctattgaaaatttattggaacttgacattctttcctgcttgtctcttaaccttacatattttctctctgtttttgtcctccattctgagtgatttcctcagatctacatttcagttcactgattctcttcagatgtgttttatctgtttcaaatctctatgcttttacaccagtcatgctcttttcttatttttattttatttttaaaatttattaattttcaacatagtttctgtgttattattggaacttcttggggtactactactctatttctgctcattcttaaagtggttttttcaaagatatatagtgaattttgtatctttggcttgaaagctcgtgtctgtttaagctttattcatgagaattttgctgctgcctcaattgagggaatacattattctaagaggctttttgtttgcttttgctcatacgtagggttgtcgcagacctgggactgttttttatgtttattgttttgcttggggcatctttgtacttctctgtagtaaaaatttaaataccaaatccagttaaaggcagcctgtagttaacaaattcttcttttaaaattaaattaattttttctttttttagagacagggtctctgtcacccaagctggagtacagtgctgcagtcatagctcactgcaaccagtcctcctgactcagcctctcaggtagccaggactacaggcatgcaccaccacgccagactaatttaaaaagaatgttttgtggagatgaggtctcactatgttgcccaagctggtctcgaactcctggcctcaagcgatcctcctgcctcagcctcccaaggcactgtgattgtaagcatgagtcactcttctcagtctacaaattcttatgaaagagtttttcttttttctccttgaccacccagagcttacattattatagatgcacttgtatgttgtctccctttttcaagggagttgaaaaataagtgaattgttttagtctgccttttcactgagattgtagacctttgagtagcattagatagaaatggaggagcggagaggtgtgaggccttgtattatgtctttgaaggagcattaagtcccaagcccctaatgtcaccgagataggaaatcctccaagggcagttacagtacccactcttgtaaccactgctttgcttttatttccttatttgtttttgatctctagaggaaatcctttatttttcttccaattcagaaatacattaaaaaaaaacagtttgttatatgtaacccagcaattctaggggttgatagcaaaaatactttttcttgtgagtccagtaattttatgaaaccatgtcttggtgttggttattctgggtcagtgttcttaaatgtagttggctttaatggactgtcatttggggagcacgtacacttacccttccagtattggggtctcggggtggctggatttattacatagtagcttagggctctccaagagaatgttccagcaatcgaggcaggggctgcatggtcttttatgacctcgtcctggaagtcagtgtcactttcactaacactttcttcatcaaagcagtcacaagcctgcccagattcagtaagaagtgatatacgtcctaacttttgatagagagtgacaaagaatgtatgcttaaaatcaccacagcatttgtctaagccaggtgcagtggcaagtgcctgtagttccagctgctgggcggctgagacaggaggatcacttgagcccaagagttcaagaccagcttgggcaacatactaagaccttgtcttaaaaaaaaaaaaagtcacgttggccaggtgtagtggctcatgcctgtaatcccagcactttgggaggcagaggctggtggatcacctgagctcgggagtttgagaccagcttgggcaacgtggtgaaaccctgtctcaatttaaaaaaatacaaaaattagctgggcatggcagcttacacctgtggtctcagctacttaggaggctgagtcaggagaatcacttgagcctgggaggcagaggttgcagttagccgagatcaccccactacactccagcctgggcaacagaacaagactctgtctccaaaacaaaacaaatcaccataatatttgtattaaaatttgcctgatgttaaatttaattaagttggtgaacatgcactttagatttgaattcgtagttgatatttgctaaggttattgttaagatttccatagcataacttgattttttttttttttttaggagtaaaccttgttagaactggggaggattattacttttagtagcccaagtatagtaacaagtattaaggtgactttgtaaaatatgtatactttatatttacatatatatttgtaaaatatatgtaaaatacatacataatgacatttctttacagatgaaaattgcaagtaaaatctgaaatatttctcattaaaaatgtgaagaaatatgaggcagtggcattatttgttgcacaataattttgaactatattctgtatttagatttgtataagtgaaccaacttacagtgctttgactttttttcatagtacatgaattaaagtgtattacatggacatattgtatcatataataagcaaactattcagagtagagcattatcatattatatatctaatctgccttctaataaattagttttaattattttttaaatcaagatggttttatttgaaagcattacaaaatttttgaaatgcagttttaatcttagaatgttaacttagatatatatttttttcttttgatattttatttacaccaagaaaaccctacttgggaatcttcacttatgattctactcaatctaaataaacagtcatgtagaattacacagccacagaaaaacctgctataagtagcacctttaacaatgtttaattttagagcttacctaattctgccaaaattttttaaaatacagcaaaaaaacttacaaattaaaaatcatagtgatatttatttaaaatttttatttacaggtaagcttttgggttgttagagagattcttcatgctcaaacattaaaaattagagcagaagttttgagccactatattaaaactgctaaggtaagaaaaacttgtgtttttatttttgagttcaaccattcataaatgtttgtaagtgaataaatattcgtgatgctttattcactgtttattgatactggaaaaataagactcattgatataagtcaatttttaaaattggatgcctactttctctgccttttcctttattcttcctgttttcctaccttttcttttatattcttcctcccactctctgagtagctgaattatgtgatctgttttactgaataagtagacaaaggttggattatggtaaagtatgatatttataaaatattggactattctgcaggtgatgaagaaagccataaagaattaagtaggagaatactacttcacttctgaagtgaaccatgtgaagaataagactttatttttaagagaatggtatatgtgatattaccacattgttaactgaacagttattgtgtgacatagataataaatacagcaagagaaatggagaatggatttcaaaggtagttggaaattagaagggtgagacaggatgttctacaaaggataccaagattttattaaaacttgtaacaactctgaatttggttggaggggcagaaagggggagtgagcccttccctctccatcatgaagggtcaaggccggcagcgatgtaacaaaagacaagttaatgagagaaaagcatagcagatttattacatgtgcataggagtcatacaaagtataaactcaaagcagggccaaatggttgatgcttaaatatcttcttcactggggagaggggagttttgggggagggggtacataagagtaagtgattttcaggtaaaatgaatgagcccagagaacgaagtcctgagaccaagtttctctgagctctaggggaggtggcattacaggttatgggagagcgaagggagaagaacatgttaagcaaagacagatatctcaaggaagtatctcagataatctcagagctaccctcagaaagaatagttggggtcgcctatggttgagttaatctttcctagatctggacaagggagaggatgctcagaggaagcctagctgttcatttcaccattgtagattttctttacagatgtgaatctcctccacaaagggcagcttttcagggctatatctgtccgtaggccctctgaatagctatctcaaaatatgtcaaagaagtatattttagggtaatatatttttggtttcctttaatgttaagttcactaagaagtatggtaattgtagccacgttcattcattactcttgtaataaatacgtaactttcctcacatgtgaatgaaagaaggcagaataaaatgaggatatcatgtttacagttattaaaagtcataactctttcctattttccttaagaacatgggagcaattgtattctaacattctatggcactaggtggcagagctagccttctacaaatttgatattttgcaaaagtgtcaaaatatttttagaaattctttgtgatgatatgttaggtaaatactttttttttttttttttttttggaggtggtgttgcgctctgtggcccaggctggagtgcagtggtgcgatctcggctcactgcaaactctgcctcccgagttcaagtgattctcacatctcagcttcccaagtatctgggactacaggtgcatgccaccacacccggctaatttttgtatttttagtagagatggggtttcaccatgttgggccaggctggtcttgaacacctgacctcaagtgatctcccacctcggcctcccaaagtgctgggattataggcgtgagccactgcacccggccaatactggtttttaactaataaaaattaatgattcttcatggattctgcattattattttctgatatttttgttagtttttaaatttacttgtatgttccactcaaaaccaccaaattttgctcaaacctaccactgtcttcatcaaacaatcatttaacttcagttcagactttgaattatttttgacagcacttgccttcatcccaagctctaaactcataattgtttttttctcattgtcccttaaacccttctattctgactctctgccttctatactgtttgttataaaactggcaggtctcttacttgagtattgttatcagtcagcattctccagagagatagaaccgtagcattctgtataaacatgtataaagagatctaaatataaaatgtataaatagattttaggaattggcttatacaattgaagggactggcaagtatgaaatctgtagggtaggccaacaggctggaaactcaggagtttaggcactagtcttgaagcagaatttcttttccaggaaacaccaattttcaatgttaaagcctttcaactgatcaaatgaggcccacacacattatcaagtggaatctcttgatttgtagatgttaaccgcatctacaaaatatcttcatgacaacacctagattagggttcgattaaataactgatactaatagtctagacaagttgacacatcaaacttaccatcacatagatacaaaagaatataagaatatttaaagtatcaaaagaatgataatgtggatacccatgcacccactgaccactgggaattttcatatgcctcttcatatgccacctccttcccttctactgcaatgggaactactgccttgaattttttcttttacagtgtgtatgtttctgaatcatatgttgctgcaaatatatgcttttggattttgtttaaattgaattattccatatttacttttgtactttcataactcagcagtgttacttaatggttttgggagtagctctgttgtagagtatcctatttgtatatatcacaaattattcaatgtactttggattatttccaaattcttggctattatgagccctgctgccataagcattcttgtatgagtctcttggtgcttatgtgacggttgaagccctagaaatacagagttcgtactagcagtgaaattactgagtctctctctctctctctttttttagacaggatcttgttgttctgtcacccaggctgaaggccagtggtgtgatcccaactcactgcatccttgaccttctgggcccaggcaatcttcctacctcagcctcccgaatagttaggattacaggcatatgccaccacctgtggctaatttctgtttttttgttttgttttgttttgtaaagacaaggtctcattatgttgcccaggctggtcttgaactcctgtgctcaagtgatcctcccatgttggcctcccaaagtgctgggattacaagtgtgagctactgtacctgtcccctcatctctttagctttgttatagataacctccaaactgatttatatttatatatgctcactagcaatgtatgaagatgcctgttgctccacatccatgtcaccatctgatattgtcaaaatttttcattgttgccaattctggtggatgtgaaatttatctcattttagttttaattgcttttcattgaatctgataggagtgaacatcttttctatgttggccatttaggttttctctcttgaaaggtctgtttaagatctttcagcagttttctgttttggtattggtcttttattgtgtgtgttttggtttttttgtttgtttgtttttatttatttatttattttgatggattctcactctgttgcccaggctgtagtgcagtggtgcaatcttggttcactgcaccctccacctcctgggttcatgtgattctcctgcctcagcctcccaagtagctgggattacaggctcacaccaccatgcccagttaatttttgtattttttttttagtaggacagggttttgccatgttggtcaggctggtcttgaactcctgacctcaggtgatcctcccatctcggcctcccaaagttctgggattacaggtgtgagccaccgcgcctggcagtcttctattgatttttgtaggagttctttatataactctagatgctagttctcataagctttgcatgtatcttgctatttgtagcttgtcttaccacttttttcgtattttctgatttacatgttcttaattttagtagtcagatttactgatccttaatttctgtcttggtctgttctggctgctataacaaaaataccgttaactaggtggcttgtaaaaacaaacatttataaacagtgaacattctagagaactgtgaggattaagtccaatatcaaggtgtcagcagattcagtgtctggtaagggcccatttctcataaagcccttcatgttgcaacaaagttccttcaagcattttcccaaacaacatttcctccatattgccctgccaacacaccccactgctacaatatagatgaaggctgttctgggaatttatgtaagtgggatcctacagaaagctattacttgtggttgactactcttgctcaccatgttgttgagattcatccacattgcatgttattgataattcttttattgctaagtagatttccagtgtatggatattccacaatttcttcatcatttgcttattaatgcacatattgtttttactttggcttttatgaataaaactgttatgaacatttttgtggagtatgcattgagttttcttggattatacctaggaatggtggactttctgggttatagattaggaatatgttttaactttattagaaactgccaaatattgttattttccaacataacccggttggttttaccactttaaattgcagtcagcaataagtcttccagttactccacacatcttgccagtacttggtgtttaatttttttttttaatctggcctttctttttgggtgtgtaatagtatcttactgtggttttaatttgtatttttctgatgatagtgatggttgagtatcttttcatatgtatgtggaccatttggatattttgttttgtgatactatcctttcaaatcttttacccatatttttaataggattgtttgtcttatcaagttgtagggatttttttaatgtattctgaatacaaacccttttcagaaataagtattttttcctagtctatgccttgcgtttttattttaatgctgtcttttggttagtgagcagaactgttcaattttaatgaagtcccatttgttatttttatctttgtggttactgtgttttgtgtcttgtttaataaatcttttcttaatccagggtcataaagacattttcctttgatcactcctagaagtattatagtttgaagtgattttttttttttttttggagatggagttttgctcatgtcacccaggctggtgcacaatggcgcaatctcagctcattgcaacctctgcctcctaggttcaagcgattctcctgcctcagcctcccaagtagctgagattacaggcatgcaccaccacgcccagctaatttttgtatttttagtagagatggggtttcaccatgttggccaagctggtctcgaactcctgactcaggtgatccacccacctcggcatcccaaagtcctgggattacaggtgtgagccaccgcacccagccaaattaatttttgtgtctggtggaaggtgtaggagttaaggttcattttttttcctcataataatatctaggccaggcacagtggctcacacctataatcctagcactttgggaggctgaggcgggcagatcacttgaggtcaggagtttgagaccagcctggccaaactctactaaaaaatacaaaaataactaggtgtgttggcgcactcctgtaatcccagctactcagaaggctgaggcaggagaatcacttgaacctggaaggcagagtttgtggtgagctaagatcacgccactgcactccagcctgggcgacagagactctgtctcaatttaaaaaaaaaaaaaaaaaaaaaaagaatatctaattgtgctaactccattcttttctctgtttaactgctttgacattttggttgaaaatcacttgatcaaatacgtgtaggtatatttctgttcctttgatttatttgtctattcttattccaatatctctttgtcttaattactgtagctttgtagtaagccttgcaatctgatagtgttctaatttttttttcttcttcaagattgtcttggctatgctatctccattttatatctgtggaaattttagaagtagcttgtcaatttctacaacatggcctgcttccatttttgattgaggttttattgaatttatagatcactttgggaagaattgataacaacattaagactttcaatccacaaacatggtttatttctgtttaagttttctttaatttctctcagcagtgctttattttcagtgaagcactgttgtatatcattatttctaatagacagccaatgttctgatattattgtaaatgtttttccggctcattttctaattgtttggtgctacatatgcagtcgtgttacctgaaaataaaggcagatttgacttcttcctttctgacttttctacctttaaacattatatttaaaagaatggtagagactggagtaaatactctcttctcccagggtggttaagcccaatcctctgtgagggaacaagaatgagaagctgatttttctggctgggcatggtggctcacgcctgtaatcctagcactctggaaggccaaggcgggcagatcacctgaggtcaggagtttgagaccagctggtcaacatagtgaaaccctgtctctactaaaaatacaaaaattagccatgcatggtggggctctcctgtagtcccagctactcgggaggctgaagcaggagaatcacttgaacctgggaggcagaggttgcagtgagccgagatcatgccagtgcactccagcctgggtaacagagcgagaccacgtctcaaaaaagaaaaaagagagagaagctgatttttctgatccaattaggaattgaggtggatagggttgagttttagctttagttagtttcatataacctctggtcacaaatgactcagggcaaaatctgtactttgtatggtacaggccccttgctgtagtagggaccctgggatctaagtcccagagatctctctctgctttctaacccagctgtcagcctccagcactgacacacagtaaagtaagttccattaggagtgaatcagtggacacagagccaactctaggtttgagactcctacagattctagtctattataccagcccacagattttactttagcaaaatctgcctgtcggagccttcatctttgcctagccttgtagagattcagcgtatgccctcagggaggaaaaactgtttaaaggctgttggttttttttactttggaatttagttatttgtgttctttgtgtccacaactctccagtgtctttaataaaatggttttctaagttttatctgttttgttttcttgccattatggctttaacaatggtttctcatgttgttctacatcttaggcagaagctactagttcagcatgagtttttgttgtttttctttttcttttttttttttttttgagacagggtcttgctgggttgcccaggctagagtgcagtggctcaagcatggctcatcacaacctgtgcctcctgggctcaagcagtcctcccatctcagcctccccagtagctgggactacaggcacatgccaccacgcacctggttaatttctgtgttttttttatagagacaaggttttgccatgttgcccaggctgttcatgaactcctgggctcaagcagttcacctgcctcagccgccggaagtgctgggattacaagtgtgagtcaccatggctggcctctgtttattcttactatgaagtagttatttgggctgcaaacctccataagacccctcccctcttcccttagcactaaggttcacagcaggcattgttgtctggcagtctcttgatggtgggtaaggattacttctatcctgcccttacgctcaggcaatgagtccttcagtgtctctgctttatgcaatgagagtctcttattggaacccccaccatagattaggccctgggcaatgtgtcccatgaagcttggaaagctaaccagattttcaaatgtcctccaagggattgccagctttggtgttcagcttacatctctggattctccttagttttagggccctaagtattccttactttattgctagctttacagtgaattttcataagatgtgtttcatatcttacccaatatttttaattattttcactggaagagtaggtcaaggtgtctaatttaccagacttctggtatgtagtccttactaaattttgaatccattccccctcttcaactccactgacactaatgtatcagatccttctcatcatctctcactgtagtctctgaactgattcccttcctgtatgccaccttctgctccctgatctttccaaaatgtagtacacatccataatatcttacccaaagcatttggggccagatatatttaggaatacacttttttccccagattttagaaaggtggtatagttcatataccatctgtggtatgctcatcacaatcacctccacctcctgcttatgtaataccttgaaatcaaacacacttaatatttttggagcaaaacatgtaattattcaccttaagtgagatcaatgaagtctgtcattagcctcacatcaggttagattttcccacctagtgaacctgagaccacactaccaaataaacaaaactttgacttttcaggtttgagatctcagaattgcagataaagggttgtgaaccgatgcctggcattcagttatatcattctcaaatttaaaaattctccaaatcctccactggagttcttactgcttatgagagcaaatctagcctttaaagaggcttcacatgtaaaaatggccctttctggtttcatcttctggtactctgatacttctcatattcagcttccagacaccttcatgcctttgtgctttttgtaaattgtattccctctttctcatagcccctcactctcaagtgtcatttctggaaatctgaatctctcagacaaagttaggggctgattattctgtagaaccctatatatacttttatttatataaccctatatatacttttattctagaaatatgcaaattggatttgtatttgttttcatgtctcactagactgaagcttcttgataggtctttttcatttttgtatatgcagtctaatatggtgcctagtataataaatgcttaaaatacattcattgaatggttttccagttagattatataaccttggatgagggtttatattatgttttgtgttattaatttattttgtttttatttgttttcttcgggctttcaattaaatgctgtatccacagcattttctagacctggggcttacctggctgtaggattaggacagttgtaaaatgactgatttttagacaggacttgcaggatataagcatcaggcagtatttaaaaatctgggaaattagcaataaatgttatgcagatctcatgggaaagtgctggaaactagtgttaggtaggagttttatgcatacagactgtaaaatcaatgtctcagcacgaatgagggaaaaaggatctggggatttgggtaggaggaagcagaaaattgagagggactgtactgtgaaaggcaggtttctcccttgccctggaataatgggagtactggatgggaaaccaaatcagaatcctggatgttgaccctttattgaaacttgaaacataaagcagaggcttagtaatagttcagtataagggagactgtttactagaaaccagctttcatgatcataccatgtaaacttgataatgagacataaccttggttttcttaatatattactcaactagaggtagatttattcccagagtttggggacaatgccagggtagaacatgtaagttctgttgtgcaccaaaataacttagtgtaaacacagggtactctaaagacagttctcagtaatgaaggtaatatatgctggaacactaccagttgccaagattgtacttgttagtctaaattttcttgtattcatgttgttctttttcatccctctcccccattttttttcaaatcttcagaaactgtatgagctgaataaccttcatgcacttatggcagtggtttctggcctacagagtgccccaattttcaggttgactaaaacatgggcggtgagtaatattctttagttaatgaaaggttagacttcctgtggaaaggaaagatatattcatttcctttgtaattcttattaaagttaatataatgataatcaataaggatttttaaattgctttgtactctattctttgatacctacattttttctccttaagcagtgcactgggtataaggtaatttttgggtacagcttggtgcttagtttttgctccttagagaatcatttttgttgaaacactttcaatatctttgacaacgtaatgtttaatattcaactgatggaaggtatgaatacaaaaaaattgcatttaatcgtaaagattatgcttttggaaagtttgaggcatatctgaatcataggtttcaaaaaaattttactgatttcaatttccattattttttagtgagtaaatcttaagttttttccttaggaataatggaaaactagatgattaacatggaattatttgctgttgctgcacatgctgatattatgttaatcatatttggttctattacttatatgagatcagagtatgaattttgacctctgcaaatttgtgtattttcatatttgagtaacatgatattgtactcaatcttttcaggtagttttcatttatagtttatataagtaaaattttatattcaattaaatttatttatattcaatactattctttaatgttaaagagcaactattttgtttagaatcgattacattttgtacaaaggatcaatgtgtttttaaggttctgggctaaaatcatgactgactttttaaaactttattactaaaatataactttttaattaacaaagtgctgcttttgctttttatagtatctgaagagacagatgtttcccatgaaaaccagtgtagatttctatattggaaaaacattagtatggaaaagcttgtgatcctttttatgtttctcttttctattttatagaaaaaccttggtgtgaagggttttctttaaaaattctttttaataattatggccttattgtcttttcttaaaatttgaatttcatggaggaatggaaatgattataaatatacagttatgaattatatctttaaagttttagggaaaagaattatacgctgtgaaaaaaaaattctatttttattttttgcatccaggctggagtgtagcacgatcatagcttactgcagcccccaactcctgggctcagaggatcctccagcctcagcctcccaagtaactggactacaggcacatgccaccatgcccaactaattttttaaaaagtttttatagtgatggggtctcactgtgttgtccaggctgttttcgaacgcctgatctcaagtgatcctcccgccttagcctctcaaagtgctgggattacaggcatgagccattacgcccagtcctatacttttatttatgatttggtttagtaatgaggtagattttgctgaagttaatttttattttccttgaagatattttcattgcctcccttatgtatttttgtggaaaataataatttttatttggtaacagcttcattatttatctgaataaaacttttgatggtttgtattttaaaatatttcatactgtgctatgcactctgtaattgcttgacatttaatagtgaatgatctagacaaagttccattttcatacagctaacattctgctggggaagaataaattacaaataaataaatgacataaatagcaataaatgctctgaagaaaagtagaaaggaaggcaggacagtactgtgttatgtaacatggtaagagaattgttgataaatgacagttcagtagagacctggaggaattgagggaaccatttatttggatatctgggagaagagaattccaagtagaggtaataacaagtaaaaaggcccagatacattcaaatggcagagtggttagtgttgacagtagaataagctaggaaggtacccggtggtaggagatgatttcaaagaggtggcatgaatcagataatggaggtgctgtttacttatattcagagaggtatagagaaggaccattgtgggctggggttctattttacacatactgtgtttgagttggctagtaaacatccatgtgaaatgtaaggtcagacttagatgtacaagtttaagggagtggttggggctagagagagattgttataatcatcaatgtaaactatttgaagctagatgggattacctaaggagggagcatagatgaaaagccctgggaacctccaggattcccaagtagagattggaaaaatgaggagaaatcaacaaaggaaattacgggtaggacacatttttcacagtcaggtaaagaaaatgtttcaataaaaattgatcacctttgtcaaatgctactaataatttgaataaggtgcaaagtttgagatgacctgacaattggaaaggattggtgacctcgggaagagtgatttcagtagagaatggggtgaaaaactgactggagttgagagaatggtgatgaagaagtgggacagcaagtatagagaatgcttttgaggaattttactgtaaagggctgcagtgtggtttgcagagaaatatggtacctggaagggaatgtgggaccaaagatttgttgtattttgttttgtttttggaaatggcatcaatggcaatatgttttatgttggtggcaataatctagtagaactaaaaaaatgacaagagaatgaggaattataccagtgatatgcttgatgagatgaaagagaattagatttagtaccctagtgtatcagtaagagtttatccattttacgccgggtgcagtggtggctcatgcctgtaactccagcactttgggaggccaagtcgggcggatcacaaggtcaggagatccagaccatcctggctaaaacggtgaaaccccgtctctactaaaaatacaaaaaaattagtcagacgtggtgatgggcgcctgtagtcccagctactctggaggctgaggcaggagaatggcgtgaacccaggaggcggagcttgcagtgagccgagatcgcgctactgcactccagcctgtgcgacagagcaagactctgtctcaaaaaaaaagaaaaaaaaagaaaagatagtttatccattttaacagcagggaagggaacacatttagttacagatgcaggtaagttggtagatttcgtggtgggattcttagaagttctgattgttttgtttcctcagacataaaaaagcaaggtctttagttaaggtggtatgggagaggtgttggagatttgaagaaagaagagaggatataaaagtcatctggagagtgtgagagtgtgttaactaagaaaacgtaataggtttgatagaccttatgtaggatccatctacttaagacttttttttaatcatgaatttaaagtaaaaccagtcagcagagttatgtattctccagccaggttcagatattcagcataagctttcaatagtgccaagagttgtatttaaccagagatgggatttttcgaggcttttgtaccagaagggttaagggtagcacaagaggtgaaagacggaaaatatgagagttgttttattgacagatgaggaaactaagccaagtaaaaggaggaagatgatgaacagtgaaaaggtaggctggtcagtggtttggaagccacagtggagtcaaataatcactggattcagaatgagaaagggagtgcaagctgagggtggtagaagataagatcattggagcagaagtccagaaactaagaaaccagagtattgggagtattctctccatgaaatggcaatcaccaagatttatgataataattttggttcatggattttttttctccaactacaaaaatcttcaagatatagggggaaaatgacttgtagatctataaatgacagtaacataagtgttgtaatctagggttctcttgtttaatatggtagccattagctacatgtggctattacatttaaatcattaaaataaaataaaataaaaaatttagctccttgatcatactagccacattgcaagtgctcagtagtcacatgtggctagtggctatcatattggacagcacaggcatagattttcaccatcacataaaattctgttggacagcacttatcctagtgccttcaatttaatagaagctggaggattttagggagcagggtgagagataatgagctggaagaaattgtgaagagtaaggagcaaagattacacctaacctacctccaggcatatgttacaaggtttataagaaaagaaagggaatgcttagagaaaatgttaaggatagggattttgcagaggatggaccatgaattcaggaggatacagttggaaaggtttgggatggttttgttttgttttgttttaaccgataaagggaatgtaccaaaaagacaacaacattctatgtagggaaaatattaagagcatcaaggaaaaggatgcacaatttcactgttgtattcaacatataattgctattgtatatgttttaatgttcataacaacattattcacatagtcaaaaggtagaaacaacccaaacatctaacagtggatgaatgaatagacaaaatatagtttatacatacagtggaatattcatctctctttaaaagcaatgaaatcttgatacatgctgcaccatgaataaaccttcagacattatgctaagtgaaataaaccagatacaaaagaacaaatactgtataattcctataattccacttatatgaggtacctagagtaatcaaattcatacagacagaatctagattgatggttgccagggatggggagaaatgggatttgggagttattatttaatggatatggagtttcattttgagaagatgaaaaacttttggatatggatgttggtgatatccttgaaatgtccccctgaaaatggttaattgtatgttacgtatatattttaccacagtttttaaaaaataggtttacttaaagtggttgaatatatgagcaatacaaaattggttatatttgaaacaagtattatttaaaaggacatcgtttacaatatcaacaaaagaaacaaaatatcaaacaataagtggaataaaatgtgtaagacctatatgcagaaagttataaaactttacaggaagtcattaacaaagaactaaatagagggagcaatagcccatgttcatggatagaactattagagttctaacaggtttttgaaactgtaaaataaactgaatgttactaaataaatgaatttagtaacattccaagatacaaaattatcttacaaaaatcagttgcatttctgtacattaataacgaactatctgaaaaattaagtttaaccaaggaggtgaaaaatctatacacagaaaactataaaacattaatgaaagaaattgaataagatacaaatgaatggaaggatatcctgtgtttgtgcattggaagaattcatattgttaaaatatccatacagcccaaagcaatctacagattcagtgcagtcactatcaaaatttcaatgacatttatcacagaaatagaaaaaacaattctaaaattcacatggaatcacaaacatctcagaatagccaaagcaatcttgagcaacaacaaagctagagacatcatactctctgattttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttttagtagagacggggtttcaccattttagccgggatggtctcgatctcctgacctcgtgatccgcccgcctcggcctcccaaagtgctgggattacaggcgtgagccaccgcgcccggcccatactctctgattttaaaatacactgtgaagctatagtaatcaaaatattgtggttagcataaaatagacatgtagaccaatggaccaaaataaagggcccagaaataaatacacacatttacagtcaattgatcctcaacaaagataacaagaacacacaatggggaaatggtagtttcttcaataaattgtgtcagaaaaactggatgtccgcatgcaaaagaatgaaactggacccttatctcataccatctgcaaaaatgaactcaaaatatacttagtacttaaacatgagacctgaaactgtaaaactactagaagaaaacacacgggaaaagcttcttgacagtggatctggacaataattttttggctatgaccccaaaagtacaagcaacgaaagcaaaaatatacaaaatgggattgcatcaaactaaaaagcttttgtacagcaaaggagacagtctatggaatgggagaagatatttgcaaataatacatctgataaggggttaatatccaaaatacagtcatgcatggcttaacaatgaggatactttcggagaaatgtgttgtttggtgattttgttgttcagacatcatagagtgtaatcacacaaacctagatggcatagcctacaatacacataggctatatggtacagcctattgcttctagactacaaacctatacaccatgttactgtactgagtaggcagttataacacggtggtatttgtatatttaaacatggaaacagcacagtaaaaaatacagtattataatcttatgggaccactgttgtatatgcagtttgttcttgactgacatgtcgttttgcagcacatgactgtataaggaactcagacaatgtgataacaagaaaacaacccaattaaaaaatgggcaaaggatctgaatagacatttctcaaaagaaaacatacacaagtcccacaggtatatcaaaaggtgctcaacatcgctaatcatcagggcagtgcaaatcaaaaccacataatatatcatctcacacctgttagaatagctgttatcaaaaagccaaaagataactaacgagttttggtaaagatgtggagaaaagggaactgttgtacagtgttggtgggaatgtaaattggtacagtcatggaaaacagtatggagattcccccaaaaataataatagaacaattatgtgatccagcaatcccatttctgagtatgtgtccagagaaattgaaattgatatgtcaaagagatatctgcactcctatgttcgttgcagcattattcacaatagccaggatatggaaccaacctaaatgtccatcagcagatgaatggataaagaaaatgtggtttatatacacaatggaatactattcagccttacatttacaacagcatggatgaatttggagatcattatcctcagtgaaataagctagatacagaaagacaaatgctactgcacaatttcacttatctgtgaaatcttaccaggctgaactcatagaagcaaaaagtagaaggatggttgctgaggggcaggggaaatgttgggtcagtaggtacaaagtttcagttatgtagaacaggggtccccaaaccccgggctgctgaccagtgctggtccatggcctgttaggaaccaggccacagcaggaggtgggcagcaggcaagtgagcattacggcatgaggtccatctcctgtcaaatcagtggcagcattagattctcataggtacatgaaccctattgtgaactccgcatgtgaaggatctaggttgtgtgctccttatgagaatctaatgcctgatgatctgaggtggaacagtttcatcccaaaacctttccccattcatgttcatggaaaaattgtcgctggtgccaaaaaggttagggaccactaatggagagagaataagttctggagatctaatgtacagcatgaggactatagttgactatagttaataagactatgttgtatacttgaacttttctgagagagtggatctttttaaattttatttattatttatttatttttattttttttgagatggagtctcgctctatcacccaggctgtagcgcagtggcacaatcttggctcactgcaatctccacttcccaggctcaagtgattctcctgcctcagcctcctgagtagctgggattacaggcgcccaccattttgcccagctaatttttatatttttagtagagatggcgttttgccttgttggccaggctggtctcgaactcctgacctcaagtgatctgcctgccttggcctcccaaagtgctaggattacaagcttgagccaccgtgtccagcctaaaagagtgaatcttaaatgttcttaccatacaaatacataagaagtaactaactttgtgagatgatggatatgttaattagcttgatagcttgataataatttcattatatatgtgtattaaaacatgtacacctcaagtatatgcaatttaaatttgtcagttataccccagtactgctggtggaagattgattgtaaaatttatatggaaatttaaaggttcaggaatagctaaagaagacaatgggaattggggagataagcacttggcctaacagatgtcaggatatactagattcttggacagtgtatgattcctgcagttttagacatatctaccaatgaaacagaatgaagaacccagaaatacctccttgtttttacaggattctgatacgtgtatgacagaggtggcattgtaagttggtaaagaaatgaggggctgtttattaattggagctgcaaaattggtcaccagtttgggggaaaaaatgaaatcaggccccttgcgccattcacaaaaatccttgtgagatgactcaagggcttaaatgtgaaatgaaaaacttcagttttttagaaggaaaaatatatgtgaatatctctctggtttggcatgaatagatttctggctttggataagtaaggattttttagataagatacagaaagctccaacaatgaaaaaaataataataaattttgtcatgttagagtaagaatttctgttcatcaaaagataccttaaaatggaaaagaggatgcagtgggcggaagatatgtgcaacagttagttgtccaactagaatgtgtccaacacaagaatttgcatccagaactcttaacaacgaaaaaagaaaaaaaatagaaaaattaacattataaatgtattttgtagaggagaggatacacatagaagcagtgaaaatgaatgaactatagcttcccacaacttcatggatgaagctttaatatcacaatgttatatgaacaaagtaattgccaaagactaaaaatgaaataaaagttaaaatggaataaaatttgccaaaaatgaaataaaatttgaggggaatgataaacagaacattcagagtagtggttactggttacctcttaaaggcagtcaaggcaattggatggaagatgagtcatgtgtgttcgttataaagtttaaatccatttaacaaagccataccaggctctaatgataattgagtgtcacaaacaaaagattataattaatctgcaccccgggtctaagataaagtattcatttatgcagttgcacacattcatacatattgtgtgaagatacaaaccaaggtgatgaggaataatctgggagtttgtgtttcctggggtgactgacatgagcgggcattcatctaggttttcccccaaaacagattgtggtggtaaggtggtgttagatatctggtcaggaacatctagaattctgtgggtctcctctttcattaatatcaatgaaagtgtgaagaggcttgcccccatttgtcatgctcttggtgccaaggacatgtagaagtagaacactgtgaagtattttgtccgccccgccccccccacccccagcggtttttggaggggaaaatacagtaaagagactttttaaatataacattataaatatcaaaagaagatttgaaaagaagaaagaaaaggcttctcagttaatagagcttctgagctatcattcaggaaatacctatattaacatctaattagttctttatattcatattcttcctctagtcttctggaaacaagtctctcctaccacaactcagattgaattctatttatctgattattgatttattatgaaaattacaaaatcatgttatagtttgttataacagttctgtgtttcagctgtggcaagattagttacgagttctaagtaatttgtttctcctggtattgtaccaaagtttttgaatgattgacttaggggaaaataaagagcaggtttatcattatccctatgtcacataactatattttgcatatccagatacttccttaagtggtaaagagttagatatacaggcagcaagcaaacatttgcacctaatcttgagattactaatcaagtatcttgaaagtggagtaagagaaaattgtaaaaccgctgttttagaccatggaatatccatctaaaacattaaagcaaaggaccccttgacgttgtattttaaagagggagcgatactgttgagacatttttctaatagagattttctgaagatagtctgcatctttgagcctctgaacaatagatcccaactgtactacttataatactagaaagagtagtggattaggtgtcagaatattcttatctccagaaccagactataagatcctgaaaaacaaggacatacatctttgtgagtgagtgggtaacagagagtattatattctgctgcttgctaaccttgtgatctcagtctcttcatctctaaattaatactcatacttttttgttaatctcataggaaaattaggtgagacttacataggtggaaatgttttgcatgctgtaaaacaacaccaatattttaatatgaaataaagtgaaatctaatgtagtaatgaaatagaaacttcatgtctaaataaaaaaaaaaattttccagtctttggaatgatttgaaaaactatttcctgaaccttttagtgaacaccattgtgggtgactgactttgcttttttttttttcaactccccttgattatttacattgatctcaaaggcacttactgcaaatctgcctctcaagtgtcttacaacagtatcttttagttatgttgtatgtgatatagcactgatcaaagagaagaaaatatcagaaatccaaaaatgtaaggaattaaaggattttacagttattaggactagccatgactagatttatcaagaaaaagtgttaatcgcaaaatttggtgtttatttcttaacattatgcaagaatgatgtttatctttgaggtggcaagggacagttcattaaaatacttggacatttgagctaaatatgaatgcataattttctaaaattaggaaggtgattaataaaaattgattaatttaaaatagtaaacacgaaaatgttataatttattacttagttaattttatgaacatacaaaggatatcttataaataatgaatttggattattaatagacaaatctgattttgtcttatttatatactaccaagatataattaaagaagatataactttgaaattaaaatccatattcacagtaaatacaacttcagttcaggtctttgctacaataaaatgagatttgtaaataacttaggtttttctgtttgttttttagttattaagtcgaaaagacaaaactacctttgaaaaattagaatatgtaatgagtaaagaagataactacaaaagactcagagactatataagtagcttaaagatgacaccttgcattccctatttaggtgagttatgtcactgtgtgttttttgtttctagttgttactcttccttactcagtaatttatgtgaaattcaaggtattttttaaatgtttgtatcttttaaataaattacttcaagattggtaagctgaaaaaaatgactaaagatagttgttaccctgttacctggaatgtattttcatattagattagccttttgccctcaaggtttttcttagactattatgttttcttagagtaggaccatatagtaaaacaatatttttagctgttttagtaatgcttttaaagaatataatagttcgtaatgatgtttaatacattaaggaaattgatcaaagtccttatatagtgaggagatattttagtgtgaattctgaagtagtctcagtgcatattggtattgttgtttacctgaatgaaatgagttgattcactgtggcaatttagcttcgtgctgagacagttctgtatttcgcatctcatctaattaagaatttatctctttattatatatcttgtagtgcttataaattcaagaagtatttaaccagtaatattataagattatttttaacaaaatatgaataatgctttgttaggtgtttgaatgaaaagaagacccaaataagttgttcttttaaataggtatgtaaatcaaacataaggaaaatacatgatacatacctagcatacattaaaatgaattgatttgatcctatgtagagagtaatcaaatgatgaagatttggtgctttctggtcctccccaccccccagattttgtgtttgatgaaattactcacactaaatttcaagatagctatttctgagagtgattacagtgtcaccttgaagtgtttacagtcccagtgactagaagacaaagaagggacaaaggcagttgatacatgcccatttagctactatagaacatcaaccttagtttcccagagaagagtttaactctttagaatattgtgggacaccctaggattgcagagaatggggacctattgtgtaccttgtgttgaaggcagaatacccctaagcacagtagagttagtggccactgcatcccagaatattttgtcctgtttctttgataaacagcttaggatcatagtaagcatgactcttatcagagaggctctaagctggatattaggagaaagacattctgtatgtgctttacatttttaggttgttgctgtcattgtttgttttgttttgttttgtttgttttttgagacagcctcgctctgtttcctaggctggagctcagaagtgcgatcgctgcttgctgcagcctctgccttccaagttcaagtgattctcctgcttcagcctcccaagtagctgggattacaggcaagcaccaccacgcccagctaatttttgtatttttagtagagacagggtttcgccatgttggccaggctggtcttgaactcctggcctcaagtgatccgcccatctcagtctcccaaagtgctgggattgtaggcatgagccatcacacccagcgtggtgctctgtgttttaccatagccttggctgtgcccatacttgcaaatataatttgaggagagaaggaatagggaatttttcaaaaataataccttcacaattcagaagaatgtgtactttttatagtatgaagaacattagactgagaattggcaatcctcaattccacaatgactctacagtccttatttttcaagtcattgaattttcttctttgagccttgttctctttacctagaaatagcatgcataggactagaatcatgttctccttaaggctggatgggagcattgtgatatcttctttcttttcttttttttttttttttttgcgacagagtctcgctctgttgtccaggctagagtgcagtggcacagtctcagctcactgcaacctccgcctcctgggttcaagtgattctcctgcctcagcctcccaggtagctgggattacaggcatgcaccaccatgcccagctaatttttgtatttttagtcgagatggggtttcaccatattggccaggctagtcttgaattcctgacctcaagttgtccgcccacctcagcctcccaaattgctgggattataggcatgagtgatggcacccagctgtagtgatgtcttctaattaacttattttactatcgagaaaaccaagatccagaaaggtagaagacctggctcatagtcctaagacctagttactgacaggtctgcattctgaagtcttaacctagagagctccaattatacctgctgaactctcattttaaaatttaccaattttacgattgctttctttttctcattgaaatatgtttttctcaaactaaatttcataatttgtatcttctagaaaagaaaattaagattattttccattcaaaatgagaaaataagataataggaatccttatgctgtgatttctagttggggaccttcttgtactcttggaccttcttgacatttttccacagtggagacatcagtacaggattgaagctgtgtacgtctgtatatgtgctcaggtacattcatgcactctcatgcacacacagagagaaagttggggaagaaagcactagccaagttggagtttagtagaatcaggaaaggttttctagtggagaatatacctcttctgtctcagcccccgacctgaaacaaagagtaatcatacctacgggttaaagcaaatgcggaaaatgttgaggtacagatgttaattttgagaaaatattacaagcattgtttttctcgtatcttccatttttcccatcatctccaatgactccttctttttttcagttccctttcattttatatgttctcatgatgtaggatcttacgtttcactctcaccgtgtagttctgcttcactttatacttaagccaatttaaaagtatctcattcttgttgtcacctttttctccatcttcactctctagaaattttcctaataaggtcaccagtgacttcctggttgaaacattttatagatgtttctcaagccccatcttaattgtgtgagggttggtgtcaattatttctcctccttgaaattctccacaagtagcaccagtctttcttggtttcccttctacatttctggcttttattagctgctcttactctacctttgtctcttaaatgtattcttgagaggtctcagtccacttcttttctttctttcttttttttatttttatttttcagagacagggtctcactctgtcatccaggctggtgtgcagtggcatgatcagctcactgcagcttcaaacttctggactcaagcgatcctcccaccttagcctctgcagtagctgagactacaggtgtgcaccaccaagcacagctaattttaaaattttttttgtagagacaggatctcgccatgttgcccaggctgatctcaaactcctggcctcaagcagtcttcctgcttcagcctcccaaagtgctgggattacaggtgtgagccactgggctcagccagtccacttcttttcttactctatataatcggagtggtctcattcaggttttttctgtatattgcctgatcttccaaatctagactgaatctgtctaactttgtatatcactgtatattttatatctatctgtatatcttagctatctacttaatccctggggccgtctaacatttttaggtactaaaatactgattcattaagtgagaaaaatctacaggtatctcccattcaacatgtgcagaagtgaattcatcatgtcttcttcttcctccaaacttgatccccatctgatctcctagctttctctaccagtgaccagtcagtgtagtagtattgacactgcggtaccacactacagcctggtgttttaatgcatttctgtttcctcctcctctgcttctcatattctctagtaaaatgtatgtgtctgagggttacccaagaattagaaaacaaaaggcagcggggagggttccaagatggccgaacaggaacaactccagtctacagctcccagcatgagcaacacagaagacaggtgattgatgcatttccaactgaggtaccgggttcatctcactggggcttgtcggacagtgggtgcaggacagtgggtgcagcccaccgagcatgagccaaagcagggcgaggcatcacctcacccgggaagtgcaaggggtcagggcattccctttcctaaccaagggaaggtgtgacagaaggcacctggaaaatcgggtcactcccaccctaatactgcactttttccagaggtcttagcaaatggcacaccaggagattagatcccgtgcctggctcagagggtgccacgcccacagagccttgttcattgctagcacagccatctgagatcgaattgcaaggcggcagcgaggctggggaaggggcatccgccattgctgaggcttgagtaggtaaacaaagcggcctggaagctcaaactgggtggagcccaccgcagctcaaggaggcctacctgcctctgtagaatccacctctgcagggcatagctgaacaaaaggcagcagaaacctctgcagacttaaatgtccctgtctgacagctttgaagagagtaatggttctcgcagcacagagtttgagatctgagaacagacaggctgcctcctcaagtgggtccctgacccccaagtagcctaactgggagacaccccccagtaggggcagactgacacctcacacatctgggtagccctctgagacgaagcttctagaggaacaatcaggcagcaacatttgctgttcagcaatattcactgttctgcagcctccgctgctgatatccccacaaacagggtctggagtggacctccagcaaactccaacagacctgcagctgcgggtcctgactgttagaagcaaaactaacagaaaggacatccacaccaaaaccccatctatatgtcaccatcatcaaagaccaaaggtagataaaaccacaaagatggggaaaaaacagaacagaaaagctgaaaattctaaaaatcagagcacctctccccctccaaaggaatgcttgccagcaacagaacaaagctggatggataatgactttgacgagttgagagaagaaggcttcagattatcagacttctccgagctaaaggaggaagttcgaatccgtcgcaaagaagctaaaaaccttgagaaaagatcagacgaatggctaactagaataaccagtgtagagaagtccttaaatgacctgatggagctgaaaaccatggcacaagaactacgtgacacatgcacaagcttcagtagcctattcgatcaactggaagaaagggtatcagtgattgaagatcaaatgaatgaaatgaagcgagaagagaagtttagagaaaaaagtaaaaagaaacgaacaaagcctccaagaaaaatgggactatgtgaaaagaccaaacctgcgtctgattggtatacccgaaagtgacagggagaatggaaccaagttggaaaacactctgcaggatattatccaggagaacttcaccaacctagcaaggcaggccaacattcaaattcaggaaatacagagaatgccacaaagatactcctcgagaagagcaactccaagacacataattgccagattcaccaaagttgaaatgaaggaaaaaatgttaaggacagccagagagaaaggtcaggttaccctcaaagggaagcccatcaaactaacagcagatctctctgcagaaactctacaaggcagaagagagtgagggccaatattcagcattcttaaagaaaagaattttcaacccagaatttcatatccagccaaactaagcttcataagtgaaggagaaataaaatcctttacagacaagcaaatgctgagatattttgtcaccaccaggcctgccttacaagagctcctgaaggaagcactaaacatggaaaggaacaactggtaccagccactgcaaaaacatgccaaattgtagagaccattgatgctaggaagaaactgcatcaactaatgagcaaaataaccagcgaacatcataatgacaggatcaaattcacacataacaatattaactaaatgtaaatgggctaaatgctccaattaaaagacacagactggcaaattggataaagagtgaagacccatcagtgtgctgtattcaggagacccatctcatgtgcagggacacacataggctcaaaataaagggatggaggaagatctgccaagcaaatggaaaacaaaaaaaggggttgcgatcctagtctctgataaaacactttaaaccaacaaagatcaaaagagacaaagccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacattagacagatcaacaagacagaaggttaacaaggatatccaggaattgaactcagctctgcaccaagcagacctaatagacatctacagaactctccaccccaaatcaacagaatatacattcttctcagcaccatgttgcacttattccaaaattgaccacatagttggaagtaaagcactcctcagcaaatgtaaaagaacataaattacaacaaactgcctctcagaccacagtgcaatcaaactagaactcaggattaagaaactcactcaaaatcgctcaactacatggaaactgaacaacctgctcctgaatgactactgggtacataacaaaatgaaggcagaaataaagctgttctttgaaaccaatgagaacaaagacacaacataccagaatctctgggacacatttaaagcagtgtgtagagggaaatttatagcactaaatgcccacaagagaaagcaggaaagatctaaaattgacaccctaacatcacaattgaactagagaagcaagagcaaacaccttcaaaagctagcagaaggcaagaaataactaagatcagagcagaactgaaggagatagagacacaaaaaacccttcaagaaaatccatgaatccaggagctggtgtttttttaaaagatcaacaaaatagaccactagcaagactatatatataataaagaaaagggaggaatcaaacagacacaataaaaaatgataaaggggatatcactaccgatcccacagaaatacaaactaccatcagagaatactgtaaacacctctctgcacataaactagaaaatctagaagaaatggataaattcctggacacatacaccctcccaagactaaaccaggaagaagttgaatccctgaatagaccaataacaggctctgaaattgaggcaataattaatagcctaccaaccaaagaaagtccaggaccagatggattcacagccaaattctaccagaggtacaaggagttgctggtaccattccttctgaaactattccaatcaatagaaaaagagggaatcctccctaactcattttatgaggccagcatcatcctgataccaaagcctggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatcgctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactcccaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattagacaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaagcacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggaatcacactacctgacttcaaactatactacaaggctacagtaaccaaaacagcatggtactggtaccaaaacagagatatagatcaatggaacagaacagagccctcagaaataacgccgcatacctacagctatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcatcaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacagtgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccactatgagataccatctcacaccagttagaatggcaatcattaaaaagtcaggaaacgacaggtgctggagaggatgtggagaaataggaacagttttacactgttggtgggactgtaaactagttcaaccattgtggaagtcagtgtggcgattcctcagggatctagaactagaattaccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagatcaaaaaaccaaacaccacatattctcactcataggtgggaactgaacaatgagatcacatggacacaggaaggggaatatcacactctggggactgtggtggggtggggggaggggggagggatagcattgggagatatacctaatgctagatgacgagttagtgggtgcagtgcaccaacatggcgcatgtatacatatgtaacaaacctgcacattgtgtacatgtaccctaaaacttaaagtataattaaaaaaaaaaaaagaaagaaagaaaccaaaaagggaaaaaaaaacagaaggaaattaagaacatacactatagcatctgcataattttagatactggtattcttcatatagttcatccctatctgggtatgtgaagaagcatcttgattgtgagattattgtggactcctgggcataaatatttggtagacatgggaaaggaaaatgaaacatttgtcagatgagtttttatgactcagtttagttcgtttccagtatgaaaatcatccttttaatgtaatgactgctttgccttatagcaaaccgttagattaaatgtatttaatctattaaaacatacatggttttgattcagaatccttttctattcatgtgaagggaggcttagtacagttgacaaaaacttcagcatttataaatgctgtacatttgatagaagttgccctaagaacaattaaaaggtaaaactcattatgcaaattggtagcttcatttaactattcctcttcaagtatacagagtttgcataatgctatgctttattcattatgtctgcagaggttattatggaaagaatatatccatgaaatatctatagtgcatagaaaaaaggtaaccgctaatgatttcttaacatgaggtatatggtccaaactaatagttttttctcccctaaaaatgagaaccaaaacctaccaatttttgtgaagcttgtaaaagggagtagagtcctatatgctggtaaaactcttattttgataccaccaaatttatctgtagttcaatgtggattaaattataagaagtagaaatgttttctcggctctcaactcatcatcccttgaaaaattgtctcttctgttggtttgcattcaaggtaaaaattagtcagcttggacaatatcgtgaaaaattcttagaataaggatataatttgtctagagaggaatagttggcaaatctgaaggaaaaaattgctttataagagaattattgcttttaaatctgaaagtcattaacaacacttatttgttcttgtcattggagaacagtcttaaggggcttgttgaagaatttggcatggtaagttttattttgctgacgagagcaaactagaatattgtgaaaaaaataatttagttatatgaaacatcataaatattctttaatgtgctttttctaagcctcatttctactttatgtactacaaagatgcagtagctcgaccaagaaagcatattttggctaggtgcggtggttcatgcctgtcatcctagcactttgggaggctgaggcaggtggatcacctgaggtcaggagttcgagaccagcctggccaacatggcaaaaccacgtctctactaaaaaatacaaaaaattagctgggtgtggtggcacacgcctgtattcccactccagcttgggtgacagagcaagactccatctcaaaaaaaaaaaaaaaaccatattttttgaactgtggaaatcagtaaattgttgcagtactctgtactgcttcctattaagtagaagcagaatgtaacagaaaagtttttgtaaaatctctagccctctgtagaatgtgagtatactcttttggtggatctagatatgactcctttttcctgttggagagagacttcttccccttccccatttaatttttaatttaatatgtcaggttttcatgatagtacttttttgttagaagagaaatacttttcttataaccctctgtaatatagtgttccttgcctactgctctctgaaaagcaccctgtttatgatattttcattaatctgtctcctcctcaacagaatgtaagcccctatttgtcttggtttaagggtttatccttacagcatctagaacaaaagtagtcatataataaatgtttcttggttcaactaattatccctttctagctcttcccattgtttcagtgattttgatttaatttctgtttaaacaataaatgtatttgtgtggcatatttgcatgggtcaactccttacccacccctgattttttttgttgttgttattttgttttgtttttggtgcctcagctggcacctagtatttacttagcactgtgcttggtgctaaatatatagcaagagattacaatgggctttgtccctgcctttatagaacttaatatctctggaattacaaaggtccaggatatcattaacctcatgaataatctctcctcttttctatatcctggaagagatgcatatcattgccttgtgccttacattgttagtggtgtccttatcatagttaatgacatttttaaagcatacctaaaatgataagaatcttaccgatttggttttcagtcgtttttgcatatattgaattgttaaatattcagtagaatatagttatttagttttagaaatttctaactcatgtaaaaatgttttcaagaataatagttttgtattcatatttctattcagataatttcaacaaagtccaagtctttttgctgatctgtaggaattaaaaggagatttttcctctcgtttgatagaatttttcttcaatatgtaaggctctgacactgatctcagaaatgcctgttggtcaataaatgtcattggcttttaatatttcaagttttattccattttcctttctttagtttgatttgtcaataatatacattatggattaccttaccctattcttttaattatatgttgttatatattgtatactaaaacagcagtaaagcatcttcactgattttcttttggatttgagaataagctctgaccaaatggcagctagccccttttctttagccagaattacatccccattttccattacctcatttatatatttttttaccctcactcttttatatatttaaaattcctctaaattctttgttgatatgttttctgaagtttactttagaccaaagacttctgaaataaaagagctgggggtggggttgtgttaatttcatccccatgttcatagtgttttctttaagtgccttgtctttctaaaaaaataagaacagcagctatacagatctgcatgctaattgtaaacagaatcagattcccctaacaacagttttaccagtggtgtttccaactgtgaatatttcagtgatttgttttgtaatttttttaagcaggctttagcaggaaagtaataatttcagtaacatttattcaacacttaggcctatatagctgacactgtactttatatagattatctaatacataacagcagttttataaggtaaatgatacttgtattttacaggtgaagaaactgagacaaaggagtttaaattgacttgctgtaaagatacgtatttcattcacagctcaaagaaagcattatggattacattaaaatttggggtatctgtgttcaggttaaaattttgagttcattcatcagtctttcctgtaattatgtgtacaattataacttgataacagttaactccactgataaaactaaaaagtggccgggcatggtggctcatgcctgtaatcccagcactttgggaggccaaagcaggcggatcacctgaggtcaggagttcgagactagcctggccaatttggtgaaaccccatctctactgaaaatacaaaaattagctgggtgtggtggtgggcgcctgtaatcccagctactggggaggctgaggcaggagaatcacttgaacccgggaggcagaggttgcagtgagccgagattgtgccattgcacttcagcatgggcaacaagagcaaaactctgtctcaaaaagaaaaaaaaaaactgaaaagtgagctagtttaagataagatggccattttttcagggcgaggtcatagccttgtaagtggaatcattgttttcttacttggttatttttcacagacactagaataaaaagactaaaaacttgttagggtataataatctttaacttactacaaagattaatttaaatatatgtaaaccatattactttagtacagatttataagttatttaaaatgtttttatgattgtggaaggtttattctgctgcttatattaccagcaggagtcctaagaaatataatgctaagagaatagcactctcctgtcatgactcagagttaagtaaacagtagaatgaaaattgatctttattctacgaggcatgaagcccagagatagtgtatttgtaggtgtctactaaatttcaagttgctgtctaattttggcattttccaaaatctcaaatttttaaaatctgcttcaggaggtcaggtgttctaggcaatgatggcctcccatttagtccagaatagagtctatatctgttgtaggataaaattcattaacttattcttgactggacacagtggctcacacctgtaatcccagtgcttagggaggccaaggtgggaggatcacttgaggccaggagtttgagaccaacctgggcaacacagtgagaccccatctctacaaagaaaatacgaaaattagctgggcatggtggcatgcacctgtagtcccagctactcaggaggctaaggtgggaggattgtttgagcccaggagttcaagattacagtgagctaagatcatgccactgcactccagcctgggtgacatagtgggaccctgtctaaaaaaaaacaaaaagaaaaattaagtaaaagaatccttctataaaccagctctaagagaaggttgtagttcagtcttactgaagataaggcaaacccatctttattcctagatgacctgcaaagtaggtagctcttggaccttacctaccacacaaatgagctaacctggtctttcacaagactctctttaggctgaaattcatactatgtctcttcttgccttaagttttctttttatttttggtccagccacttaactgcctactataacagctgtcatggctttgttagatttgcaagtgaagataatggatcaatgtaatttcatacccgaaaacttggatattgttttgttttttgagaaagagtctaactctgtcccccaggctcgagtgcagtggcataatctcggcccactgcaagcaattcttctgcctcagcctcccgagtagctgggtttacaggcatgtgccacatctggctaatttttgtgttttcagtagagatggggtttcaccatgtcggccaggctggtctcaaactcctgagctcaagtgatccacctgcttcggcctcccaaagtcttgggattacagatgtgagccaccacgcctggcccggatattgtttttaaaacacgtttgttgatcacctactctatgcaaggtgctatgatttgtattgcagaaagtacgtagatgagtagtaataatatgatagtttaaatctgagtacttacgaatgtcaagcattattcttaatgttttacctgtattaactcatttatttgatcgtcacaaaaaccacgagctagatattcttattataccccattttatagattcaggctgagataggagtttataaattgctcaaggtaacacagctagcaagtggtagagctgggccacagacccaagcagttctgacttcagaacctacactaactatcatataataccgcttcttattctctcctctcaagaaacttagttgcccaagttattatgctgtctaggaacttcagagtaaaataaatcagctctctgaaggagagcagaatgggcccattggctaaggcagtttagcattcagcctagttttccaaggttgtatgttgactttcaaattctagttttaatgatattcttctgtgaaaattctgtaaggcttgtctttgataaagttttgggtgtttaaatgaaatgatatactgctttcaataactgagaagccttggtaaagttttattcacttaagatttggtgtaacagttagatgcccagttccttccaggaatcttataacagattctttggttctgaaggaagtggagagggactgaaaaaccagtttaagatgaccacaggtaaaacaaagaataataccactatgaggtttggatattttgtttaatttgtttcaccagaagttttattttgagatgtggcagatgaaaaacattggtcatgttgatggatttgagttgtccaaatgattatcttcacattaagctattcccatgcatagtttgcctcacacatttcaattcgaggttttctttttgcttaagcaaaagtttcatgagctatctttaaaattttaacttcacaaatatattaaggcaaggtcacctctaagcagtgaatatgtattcctgaaaggaaattgttccagaaagtcactagtaaagttgttgattgcaaagatgagttaaagacactgtgagactaagcgttacatacactgtaaaatgaaattagcagtttggactaagctatgcccctgtggcttctgctctggagctgttgaattctcagtatcgggaaaacagccaacagttccttgagtttgttttagtcccacctgttctgagcatgcactaatacttgtaaagctgtccaaactttctgatttgaattgcagattggttgggtttttttttctttgtagtagtaagatcagtaaattagaaaaaaagtaataataaattagaactataattcagatctgtagcacactaaatattctgcatttttgtaataccaatattttgctgattttagaactacataaaatgcatttctggagattttggtgttcagcatatcatatgaagataacactgaaaaattcattcatagatttgtctttataaattgaccatttaaattatgcatgcattatttttgggtttttttttatttttaaaaatgatatgtatttaatactatgggtcatgttttgggaaaatcagcataggatatattattaagaattcagatttaatcattacgtgtgaaaggcacaaattcaatttgaaataacttttattcaatggaagaagcattttctattggcaaaactagaggtttctccctaattttctgtctgtatttttataaataaaatgcattatttggctgaaattttaaaaatatttttttcactagacgttagagcaatcttagattttaaataaattgttaagtatcttgaacatgttatttatgatttaaaatatagctaagatttgctttacattgtggcaaatatttacattttagaaaacaaactttgtatttagtcaacataatttttaaaataactaggttgtggatacacataattttctgcagtaattgacgacagatgaaactacatttataggttcccttttatagttacggtaaaattcattttaaaaactttatgtgtagaaataaattgtgccaagtaatatacatgtaacatttacatttttaagagctgaaaagtacaaagttctgtgtcatttaaattggcgagtgtctctcttcagtcaataggcttgatcatcatctgaactgctcttaaggagtatgacccgcctctgtattcggcccagaaaattccatcttggtgcttgcttctgtaatggcctcctctgtaccatactccatttaggttagaatgtgcacaggcattgtaccaccagcctcctttatgaaagtgggcgcagtttcctttgaggaaaaaatacagatataaatgtaaaagtttcttctaggtgtggtactctgcaatcataaaaaacttattctacctttaatttgaacttcccttactaatcccagttacctttatctcagcagttttaaatgccttcacttacttgatggctgttgcatcaactgcttgaaaaatcacttgaattgcctttttttaactctttgcttgcttacaatgtacttttttaaaaagggggatttaattttctagttagcagagtagatgcaagcagtgtttatatgtgaaagagttacagagggagaaattgggaaggaaagatacagaagaagataaaagtctgaggaaaattgaattgtcaaaataaaatagcaaaaaataatacaaagtaaaataaaaccagcagtcaaatgggtttctgtaaataagacatatgttatggtctatctctcctcttttctcgtttaccagtgtaaaattggttaaaatagagacctgtgtgctgtttgccaaaatacagctggagagaaaaaccagtttgggacagggatgggggagaattgttgggtggaggggaggaggggatctctgtatcaggacgagaagaaacctgggttaaaaagtcaaaagcatatgaaaactaaatttgaaattatgtggatggtctagttgtttctttctaatgaaaatattaatttcccctttgaatcaagcttttttgttattcctatgccacatgtcacagtcatcttggttttccccctcaaagaaatgctcttacaccatgtatccaaatggcttgcatccttcatttcttgcgactctttattcaaatgttgctttctcacagcagattttcctggcgaacccatataaaatagctgccatcccaggccttgctgcccaccactttctattttcttactcagttttatttttgagagtacttattcccacctaacaaattgttttgtctctcctccagtgagtaagctccaaagggcgggaactttgttcactgttatatccctagcacctacaacagtgcctggcacgtggtaggtgttcagttagtatttgttatgaattgtaggcacttgcattttatttccagattaatgtgtttctgttttgctttgtgtttttttcccagaactttgtttttcacatagatcacactttgggattgccttatagaagaaatcctaaaagctatttctttcagtaggttggttgtatttcctgccacagtgaccaaaactgacctttttgaaaagactttagtagcatatatattagtagattctatttaatgcatagaaggtgatgattctacaaagaatgaaagtttttcatacttacctgcatacatatctttatctctgtccagtgtggtgaattgtttaccattatgccacatcatagaatcccctgcatttccctggtaagttcccaggcgcagtctatagaattcactttcaggttccagacgaaagctgctgtattctgcatagacttttttatcactccagtcttctaattcaatcaataacttgtaattatcttgattgctaagcatatagatattttccagtccaagccagtattctccgtcaatgtttccaaaccctttctgttaataagtgaagaaacatgagtgcataaataagtatagagatagtaaacatttttacagagcagtgttaaacattcgatagcataaagatactggccatttaagtggtaatgtgagcttccattttagttggtcacttgcgttttataagccacacattgtcattctctttttgtttgtttgttttttgcttctgatatgtcagtattcatttgcatagctagcttcaaatcctacaaataagacaatgcaaatgagaataaaatttatccatagctactaaaaatattagctagtatactacccagatccttaaaaagggttcctggtctctctcatattcatctaaagagcccaacatttttttcctaatagtaatctttgtaaagtagtaagtataagtcatccagactgaaagggatcatttaaaagtatatcttctgtttcctttttgcaatttaattttgactttaaaaccagagatgagaatcatttttttgacagatgtagataatgaaaaaacatatggatagttatttttaactgtgtgtcttatttattgcatagcatcttgtttcttgcattattgcaagaatggatttgttttacttcccttaggtctgcatcactgatttaccttataattttcccaatttctgaagaagttgacagagccgtctgttcttttctgaataacagtccaacccccagggtccaaactgttttcacaccataactgcattggtccattgctgttttcaggtttaatcatataaatcccactgaccgaatgcccagcttcttttgcttgctgacagtctttgaatggtcctataatttaaatatcatttattatcagcaaacttaatatgagaagagacatgttaaaagtttttaatcaagatttttacctttgtgtctttgtttacagttaccattgtttatcatatatacaatattataaaatataactaaataaaagggtgactccagttctatctggaacattaatttgtttcgttttcatctgttcttttcttttccatatatgtattttttatattgttataatcctaatacatgtagaaaattggattctgtcttaacattttcatgcagctatagtctccattctagctgcataataatccttgacattgatatatttttatccttctatcattggacattgaggttttatggatttttgctattataaaaacactgcacaaagtgtcttcattcttattgaattcattttttaatattataaaaatgctgagggatcgatctactggatcagaggatatcagtttattcatagtcctacataatacccaagttacagttttggaaatttgatttcagtggaacatactagtaccttgagatactcattgcaaatggggtcagtcaaataagttttagaaatgcaaaatattatgtttcccttttggaaattctcaatgtacattcacatattaaagactgaaaagccctgaaataaaccagatgcccaaactcatagaatcttaaatttcccccaacaacacttactaacagcccatgagaatacatttcaggaatgttagcataaatgagtatctaaagagttgtatcaatctgtatgactaatagtaattttctcatttaacctacagttacctggtgatagttgatagatgttctagagatagaacgattaactaaggtcatgtatcacagaagatggtaaaccctagatagacataaatccttgtctaatcccagagtccctgctctgaactgctgtgttgcatgcatttgccctcatgttatttcataattttaggtattctccatttttaatccactaataatttcttcaaattttacaagtgacaacacattttgtgaaattacttttagggtgtctgactcttgaacttgagatttccacatttttggatcaggtgaatatcatccttctccagtgtttcgagccttttttataaacatgcaaaatatattaatggatttagaaaaaagaattaccctaaagatctcttagaacaaaaaatgtataaaaattctgattgtcaaattttatattttactagaaatatgtgagagtttagtcaagtaaagttcttaacaagaatttctgtactataaggataataggattgttgaaattttgagaaatgtgttatctatactttgccagatatgtacagtattccttttgggtcttactgggatagaattaatctcattaggtagttacacaactataacaatagaagggattcttagagactatgatctcttccttgtagattgttccgtgaggacagagactttttttttttttttttacttcatatcatcagtgtttaaacccttaggaaactgtctataattttttgttgattaaatttctcattttaaatacaaggaaattgaaaagtacacgcaaaaatcaagaggacatcagtttctctagtccaaatgtttattatagttcattgatatttttctcttaaatttttaaaaattataatgcaatatccataagtagtacagactagtaaaaatttgagaaactggaaagccttatttatggtgtctttcctgcgttatatttattttaggtattgtattttttagttctagagttgcaatttgattttttatagtttttatttctcttttgagatgccctatctttgcattcgttataaacatattttcctttaagacattgaaaatagctacaaccactactttaaaattattgtcctttcagttccaagtttgctgagagtttttatcatgaatggattttggattttttcaaaggcttttaaaatcttttcttttttaatttcttttctaactagacacatcacaggaatcaaaggctttttatctgcctattgagatgatgatagggtttttctttttgttgtttgttaatacacgaattacattgaatatatatacattttatatataatatctaatataagaacaaaaaagtaatatatataagaacaaaatatatatattagaacaaagaatgtataaaaattctgattgtcaaattttatattttactagaaatatgtgagagtttagtcaagtaaaagttctgtacgataaggataatagttttatccttataagaatttctgtactataaggagaataggattgttgaaattttgagaactgtgttacctgtacttttccagagagagagagatatatatatatatatatatatatatatatatggttttgggttttgttttttttggagcctgtttcccaggctggagtgcagtggtgtagtcatagctcaccacagcctcgaacttctgggctcaagtgatcctcccacctcagcctcccaagtagctaggactacaggcaagtgccaccctgcctggctaattttttttttttttttttttttttttttttttgagagatgaggtcttggtacattgcccagggtggtcttgaactccaggtctcaagtgaactccaggtctcaagtcggacttcagactcccaaagtgttgggattgcaggcatgagccactccacccagcctttacattgattgtattttgaatgttaaaccaactttgtgcttctgggatagactcaacttagtgaacgtattcagagcccttaacactatacccaacaaagtagtcatcatcggtaattgttagttatttcgtttctcctttattcctcatcttaacacataattgtagcttatttaataaagtagcttatttaatgtctgcttatttaataaatttaatatagctcatcaaagatgaatgtacagtcatttctactgcagataaatattactgaaaaacctcatgttctgcaaattcatgcgttaaaaatagtagccaattttagctcttaacataatttgtattcagctgcagttacctgtggcacaaaacattaatgtgcttggaaaaaatcccatgtaaaccagtataacctctctgttttgctaccactattctccttttcactagtcacatatgggctacttcacattatagaaacatgcattgtagtcaagtaggaaggaagggtaaagagcctatatttcagaaaagatgaaatttacagaattttaatttcttatgtgggagtgagatggaaggaaaagtaaattatgactcccaggttcatacttagattattgcgtgtaatgcaggtagtatatttgtatacttacagtattcataggcaaggactttatctttcagtatgtatccacagtttgagcccacttaggaattcagatatgtagatatgaaactatgtgattcctagtaggcatggttcccagaattcccttagttctgcattattctttcaagaaatgtcttttctgcatctactacaggctaaggactgttttaggctcaagggataaagaaacaaccttagagtcaagtggggggtgggagaagtcacaagaaagagagaattccactataatatgacaagtactttgatggagttatgtagcgcacatggtagcaaagtctaagaactagctgagatatctgaggagcattgctcttactttaaaacctattagtattatagttaatgcacacatgaaagtagttttgttacaacatatatatatttatctcattttataaatttgcatattctgtaaatgttatgcttattgcttattctatgaatatcattttcgtaaatgtttactctgcattcatttgagtatagttttgacagtttacatttaagtatatattcaaaggttggacttttattaggttatttgctttgctgcagaatatttagaaacatcagtgttctgaatgttgacagaatatttgtcaagtatcatttgttccatagagctatactcattttttgctatttaatagacactcagatgtttaaagcaaaatggagagttctggttttctgaatccagctttgatttcataagacttcaattatgcaaatttaagattatcttcagctttaattttcaacccatgttttgcagcgggctttgtgtttacagttggatatctgttagacttagggaaatgtagttgaagttcttttccagaacatatggataaaatttagcagtgcctaaagctatttttttctcctcagtaaagatattagatatcagaattcaatatttatttgtatttatttttataaacataccattaacctgtcttagtccagtgtatattgttgatcctagcagaaatattttctcattattacttgaaaatcgtatttactttctgccctaaaattagattctctattgtccctatcttaaatgttttcactgctttttctgtaccataaagaacattgcttgaaagaaattaatgacaaatagaaaattttaagctttattcttgagaagccagatttaattcacaggtttgcatattttcagaaataaattgattgatctgtgaatcaggaatttgttcatgatgattcaaaaggtataaactggaattacctttcttttaaactaagcatagtatcaactattttttgcaagagtcttctcaaagcaggcaactggaattctgtacattgaatttgaagaaccagtctctctgttcctcaatttatgtgaggattaaagtttacatagggctaatgaaaccatattaatacctctgatttatagaaagaaaaatgttgaccagtcatgccacattatttcccaaggtgtatttattaagaacccatattttgaatagaacagtgagttaaaaaagaaaaaaggatttcacactttgaatagcagctttactgggagccatctgtaacatatgtgttctttttctgtaaaaagagcttttacaaagagaattacagattacaaagagaatcctttttatgacaggagaaacagtaaaccaattcagagctttcaaattattggttaccaagtaggatcttttgagaggtaaacttttcagttgggttgtgcattaactttcagttaaatatattcaacatttctggagtgggaagtttgagacaaatactttctgaagtgacagtagggtctttctgtaataatatgaattacttagtttattaatctgtatgtttaaactgtatttagcaacccaaacttttaattattaaagaatttatcaattacgttctcataactggctaatacagtcattttccaacagcaccttggcttaactagtttttttgttttgtattaaatgttagtataagtattccattgaaaccaattatacctaaaaagtatattaagaagcattataaataatttgaaaaatgtaaatatttggtgatttaaaataagcctaccactaaaaagcatatttttagtttctaatgactactttccaagtttaactttttttttttttttttttttgagacggagtctcgctctgtcgccaggctggagtgcagtgtcacgatctcggctcactgcaacctccgcctcccgagttcaagcaattttcctgcctcagcctcccaagtagctgggattacaggcgcccgccactacgaagttttaactttttaagcttaccatttatgtcctcatatacctaatatgacaaggaaagacacataaagggaagtgtacaaaatatgcaatgattaatggtggtcaaaccatgccacatcatacacgaagcactttttttttttttttttttttgagacggagtctcgctctgtcgccaggctggagtgcagtgtcgcgatctcggctcactgcaagctctgcctcccgggttcatgccattctcctgcctctgcccgcccccccccccccaaccgcccaagtagctgggactacaggcgcccgccaccacgcctggctaatttttttgtatttttggtagagacggggtttcgccatgttagccaggatggtctcgatctcctgacctcgtgatccacccgtctcggctacacaaagcacttctacctgtaccccctcatttaatcatcacaacaatttattttacaaaagaggcaactggaccccagaaagctttgccagaatccaagtttactgatactcagatctatgcttttacacatggtgaaggaactttctccactcagctctcctacaaggaataaacttgtttttataaatacgctatttgtaaaagagtaattttttttaataaaagactaacccaaaatgcaggcaccaaataacattaatagttaagaatttcattgattgcagcttgtcaggtgtattattacattctcaaacattttgtttttaaggtagagaagaaggtaatgtgtttgaaaaatgttttttatctaaatactattttttataacttcatgggttttttgaggtagatttttcttataaccatttttaaagaaaataaaagattgtcataacatcttttataaaatgtgatatgcataattactgtcttcaccatttttaaatgtacagtttattggcattaagaacatttatattgtacagccatcaccaccatccttctccagaactcttcatcttgcaaaactgtaactattaaataaccattaaacaactccccattcaccctccgcctaacatctggcagccacaattctactttctgtctatgaatttgaccactctaaatacttcatataagtagagtctcatacagtgtttatcttttgtaactggctaaacacctcttaaaatatacattgttgtatattttcaccttatgcatgtggagactttagaatgaccatgtacctccatgtaaagtacagtaataggaatttcttggtgccagagcatacataagtacaccagtagccatccatctttaccctttttgtgcaagcacctaaacagcctgagacatttttttccagacagatgtaaaaataacataagtgaataattgagcacattgtgtaaggaaaatagccagcctatttgttgttgcttgtagtaatttaatttagtaagcatcacagaatattagaatttgaaaaggatattagaataatccagtccagcactctcattatacaaatgagaaaacacaaactggcagtgacttacccaaggtcacataacaaaggtagtggtagaaccaggtgttcttaattccatgctctttcccttatatgttcattaatgtactaattagtatagtaattcttatggtctagcagattatccctttgaatttaagagatccacatttatagaataaaataagtaaaaagttaatgtttacataaaacaaataatgaataacagaaaaagttatctgcccttaatttttgtgttaaagaaagtttcactggggataggtacaccatgttttcattaaaacaaaatgtgtttaagaggacttttgacatactaaatccctaatatgaggtttaattctgtagcattcgtgggtttttttttttgtactaatgctaagtgtataataaaacatagaattggtatgtttcattttgtataaacattttcttagaaaagtttgtcagtgtttaaaaatgtgaatagtgatttctgctagaattggttataccatccactcaagcttcagggatcacatagaatactccatggcagttgtcttcatacttacataattgtatacctcatcagttaaaaaaattcacacagctcaattatgtttatttataacttacgtatacaaactactgataaattatataaaagcttacataaaacaaaatttttaaaggatatcaaaagcaattttttttctgttttttatttctatacccagtgggtcactttatacactgcattttcctttggaaatcaaagggattgaggtttgtttgttgttgttgtagttgttgttgttgtttgagtctcactctgttgcccaggctggagtgcagtggtgcgatctcggctcactgcaacctccgccccccaggttcaagtgattctcctgcctcagcctcctgaatagctaggattacaggcacgcaccaccatgcccaatacttttttgtatttttagtagagacggggtttcaccatgttggccaggctggtctcaaactcctgacctcaagtgatccgtctgcctcggcctccgaaagtgttgagattacaggcatgagccaccatgcccggcgaggatattaataatgataatcatttacttaatttaatgatactctggcctattgctactgtaacttagaacagtataaaatgaacaaatccaatatgatataacgtattaaattactttcatgagggtctttggaatgacaattttaagaagctctataaaaatgtcaccaaatcaactaacacatatttagcaactgcaggtaagacactgtaaccatctaccaggaaggagcttataatatagttggaaagcctcttagttagatgtattctgagtgtatgtaaagataattgataatttaagagggactatacaaaatgtcttatgtatgttacagagagtagaggtattcatggagaggaacgatcacttcaaacctgtaggcgtcaacaagggcctcaaggaggagttgcattttttttatttatttatttatttatttatttatttatttatttggttggttggttggttggtttggcttgagccttattctttgagtaggcagaaagcatgaaaatatttaggggaaaatgagtgaatttgttttattggaacagatggtttttgtgaaggaaactagtggaaggtccgctaggaaagtaggcttcattctttaggaggacattattcttagccagactaagcaaattggactttttctgtttgcagaagcagatatgtgagtagtttaagaagatgaatctgctggcaatgtaaatatattttgatggagagagaaaacagagttacaccagttggcaagctattacacagttcatagtaagaactaacatttgagtgccaggcactgttctaagcactcttcaattgttaaatcttatgcagtaaatactgttattcccatttcacaggtaaggaaactgaggcacagataattttctttcccctaagatcacacagctggtagcctatggagtctctgtcttctagctgctgctgtggatcatttgaatctaaacaagagttctggctctgaatagaaatgagggacatgcacacaagagaccaaaaaggggacatgagtagaattcagtggactgtgtatggggcagctggggaagtatcaaagatgagccaagcttatttggaaatggatgacaacattaatcaaaacagagatgttgagatcaaatggtgaaaagacagttaactgtcttccagaagcattcagaccagcaaggagacagacatataaataaataacttcagtgtaatatcatatagaaaacatgtttaagaaatagtcagtgatttggggaaaaagccacctaggtgtgtttgtttgaatctaggaagtcataacatcagaggtattatttgagttaagccttgagatctgctaaattgacgacagataagctgaaagaaggtgtttcagtaaagaaagcagtagcatgtgaggtaatggtgaaatatccaaatgcaaacgtctagctttggttaaatcaggagggagagctacattcaggaatcatctgagcagtggtgatacttgaagccaaaatactctaaagtagaatatcttgaagaaagactttaaggcatagaaggaagaagatgccagtgaaggacctaaagaaataggaagtgaaggaagaatattaaaatgtagaaggccaggaaagcagggctgtgaatagcgaagtggtattcactgacagagagatgaaaccacttcatgatatatttctttctagtctttagtctgtgtttttattgttattgtttaaaattatttcatagtatatgttttatgtcctgccttttcaataagtgaatgagctgcaatttatttactcgttgctttggggcatttgggttttcccttccactctaaggaagcaaatcagcttgtaaaggattctggggaatgagttgtgagaaaatggatgcaagtgtaaaataaacataaaatactgaattcagaaagttagcagtgggtttagtaaactgaaacaaagatgaattattcatctttgctttctggacacctagatcagtgactgacattgaatgcatgaagagagaaagaaatgaaatttaaaagtagagtttggaatcatgcatgatcaatgcaatagtttttttttataataatgaacatttatatttcttaggatacacagtactaattgtttagccttggaaaataggagggataccttttcttgaggctgacggcaagaaggcatggcttttgtacagatgctttcaagataagaaagaacaaaacccaggacctgattagacttactcagtatagtagtagttgagtcatctgctgagagtggagataatgaggtgtaattacagcttgaagagagtgaaagcaaaattttacatgtttcttttgaagaagatgatgtacaagcagcaggaagtaaataaaagaattgtcgggtagcagcgacgacctagctagaagctgataggatggttatggtgcacaggagtggttcggagtggagcatgtacttattcctgtctcaagaatagtagcccctcgatcataagaatttggatggaagactggtttttttcacagaatacattaagtttttataaactcctggaacttcagagctggaagaggagatgtatttaagttcaattcttgatattaataaaaaacaatagaaattttaatgtacatatataacatcgcaaaatgaataagcatttattatgagcattgtttcataaggcataaaaatataaacctcatactcccactttttacagtaagaggtaactcaccttcattgatgaaagttaccggtggtatcttgaaagggcttttggtgggagaagttgccagatcaggtggtggcattaaatctctgggataacctggatccctctgaatctcgttacctcccagcagaccaggagtatactgttggctgttaggaatatgttgtggcaccacctggacaagtgggggagacacatgggtgtcttgtcgggaaaatatcctcaagcactgttcttccaacaaagtgatcatcacagattggttattgacaagatcagtcaaggaagcgtatttcacctctagttccctgtatcttgttgccatcttcaacatttctgtggtgacattgaggattttgttttccagttgggaaagttcaagtgaattatccctcttacggataatctcatgtaataattgcatatagagttgagtaacacgagagttcatgttacggctttcctttctcagcagctttacctcattcacaatgtttccatctacatccaccaccagttgcagaacatctatctcccgcttctgcctggagagcacatccttcaggttttcaaggtccatcctggtgatcatgtctttaatggtacttgcatcttgccccttggtgttgacacagattggccctgttattctttgttcaggtaccaggaatgtgtatgcacatttctttgcttcctctttaccatctgtggcacgagggtatcttctctggtttatttttttaattttgaattgtccacctctgcaatgtccagtgtccactagtaggaagaatagcacacctagggtccaggtaaaagtcttcattttgaaatgaggttgtaaaatgatgtcttttgaaaaacaaatcagtgaaggagaaaaagcaaaaagaattcatattaatctatgttaaagtcagtaatcttaaaaactatctgagggaaaaactgaatatttattggtgttaatagattaggctagaattaactttattaatttcttaaatttaatattaagttgtaatactttggcatttgtttaaagattaggtttcagagaataactcttccagctaccaccttattgtaatcctttttgttccccagtttattgagcagattttggtcagtgtctactctgtgcaaagatacgctgctagtgctgttgaggcttttgagaccctgataagatagctttcttacctttaaaaagctcactgccttaagactatgaaaatggtacacagtgtttgtaaggcattaattaaaacattcttgcctaactagtattaaaattaccaggtgactttactagccaatgttttagattcataccatgcaattccaattaaattgatcctctgtaataaattatgtcatcttcattaaaatgttcaataaagttaaagattttagggaaatctaaacccagatagttttagcatcacatgctttttatttttatagcatctccttttgggattagtgacaggttttagaatgatagaatgctcacagtcattgtgggtaattatatttcctgaactgtaattatatgtactctgagcttatagataattcagcaggtttgttcttctaacagaagtcctactgaactgtattttagtaaaatgttagtaattttctacaaccattaccaaggaaagaaacttgtctgtaattgaatatgaatgtcagagttggaaatgccttagagaccctgtcattcaagaacctctttgtactctgtgcatgttgaaggctaaggccacacaaggattagaaccaggtctagatcggattctctgacccatagtcagtatttatagaagcagcacctatactaaaatatgtgcttagaatgtttcgtttttgctgtagcagatgagaaatacttctttatagtacaaattcttctgaggaaacagtttcaagagccaagactttttcctttctctctagttacctcccacaagagtagcagaagtagaatgggtaaggtatgttcactctgtcagatctactaacgagctggtctattacaggccaccttttcactcttgcgaacttcatacctatctgccatttttgaaggatggcagtggataccctaagacagagcttttctgtccaaatttccacataagtacctgtttcttgatttaagaaaccagctcctaagttgtttatgcctgttgttaataacaacacaataacagtaattaatatttattgagtgcttgttcagtgttaggcactgttttaagccattttcatgttttacttatcaccacaaccctatgaagtagattattatgatccccactttcagatggaaaacttggcatccaaaagttaagtaccttattatcaagagtcacacaggttcatagtgatggagcgagaatttgaatccaggctgaagacttcagagttcatgttttcaatcccctgtatttatgtagcttaacacatgttaactatttgcatttataacactgaagtaatgctgtatcattttataaaggaggaaaatccttgagaagctaaatcactcaaatgggattcaaaccttctactcctaacttttctagacctatgatttttaccctagtcatgtcataaccacagaggagtcttaagtttatgtttcttgtttttcgctgccttttcctggtttatgtcccttttcattgaccggttacttaattatgcaaaagtatttatggataatttttggtagaatttgtgtccacgttctgccagatcatttttttacatctcagactcttctgcggcaatttctttccttctgtatgtattctgtcagctgatagttatatatctaacctatgattatggacccctcccgaaaacaaaggtcatgtcaatgaaatataactcttatgctgtcgtcatgaagactactgctactttcactttctaaaaccatgttccttttttggtatttttcaattgaatagtgtcttcaaaatgggtagataatgaaaataaggcaaatatagatggagtatggagaattattattattttactaacaagagagggaatgaaaacaaaagatagggaggacataacaatctgtatttctatcgaggccttcttttgctgactgatagccaaagcacacatgggtattttttttagctttttatgttttcataccttgctttctgacatatatagaaaatttagaaacagtcatctattttatttttaaaaatagacttttactatgtaggagttacctataccaaaaaccaataaaacatttattatatctccagattcgtggaatttagatatgggttattttaaaaactagggacaagaaataaaagccatcatcctcctgggcacatgcatatcatttttcctatatatttaatttaacttaccactgctaaagtccattcattttaatactagaatggaaactctgagatcataaaattattttacttaaataatatttactatgaaataaactaccaaaacaaggaaaatgcaggaagtaatataaaactctaaaacaaatagaattttatgagcaatattctgattgaacagcttgtattaataccagacacagatttttataaaacagctaaaagcgcatcatccaagactgctgttaggactttgcatcagtgttgtcattgaagaacaaaaaacaccaaaatgctaatctaaattaaaacaaaaacagcttccttgtgtgtattctgccttggctcattgtggttcctataagattaaatcataagataaatcactgtttaccataagagaaagtggtctaaattagcatttaaaggaggcaactaaaagtttagtttttaaataaatataatttttttttaataaatacaaaagtattggcttcactgtcacttaaagcagggcaaggagccacatttcttaagtagtagactagctacgtcaggagtaaagaactggttttaaaaatacatttactgttatgttttctgaaaacattctcttatttaatattttctcacatatgttcagttttgaagcaaaagatccataaatctatgttacctcataaaactttctgtatatgttaaaattttcctaggccccaagagaatgttataaattagttatagaatacttacgtttaaatttaagtctttacttagttgtttttagaagagaaaaaaaagtcttctatgcgttgggttaattttattagtagcttttctcttcatagttgctatattgccagctagtagagagaagaaacgaaagtcaggatttgcctcctttcagatggtaaactcacagaggcatttaactggctgtgtcatgcactgaaaacagcatgaggcaatgaagttaaatttatgaagcattcaggatatgttagataaagaatttctagattgtgaaatatgttctgggaagagacttgagaacaatctaatcccctggatatatttaagaaaaggataaatagttatctgtgtaatttggggttcagattaaatgcctgccttaagacagcgtcagtaagaactgaggcttaatgaagtcctgcacttcccatagcatgcaacaacaaaaaagagagatgacagtatttcagatccactgttgcttggaaattttgttagaatttcttgtaaaatatgtgtttaacagaaatcctgccagcatttacagttttaaatctttaaggaaaggacacaaaagcaaagttggaaaaaattttagctttaccattatttgcttgttcaagattcttaaccattaatatctttaatttttacaaggctaaaggagccccaaatctaacaaacttaagtgtctttggtttaaggcatactattggtaacgagtaattttatctttaatagtttttataatgcatgtaaaaaaagctcccagatagaatattgaaggaaacctcttatgtgtgcttaacaaaattatttctacctaaaatattacatatttttggccttttagtcatgaatttaattacatcttctgggttcttattttctattgttaataccacttacataatgcttttgtgtgtatatcaataacttagcttttccaagtgattccatttgtagcaagtttaatttctgtcatccaaattaaattactattacatgtaagcctggaaagctatttaaaattttgagttggaacaagaaatgccatagattaatcttaaatctgtacaagaatttctgcttaatatttggttatactgtaattgagattttgttgcaaagactttcaactatttttgtatcttagctttgttttatgactacactgagaaatccaacagtttatgtatatcttcagcacacacactgtggctgcaggaagagaaactaattgtgttcacgactatttagtttgtattcctttgtttttaatcattgtgctgtaagccttatacatttaatctgttacttgttaaaatttctttctactgtcactaaagcacttgttttcagaaacccagcatggcatgcatgtatcagtctgtaatcatatacactaaacatcattaaattgaacctcaaataatgcattaaccattgcacagtacttaatgtttttatgtcaagttgcaagataaaacctttttcagatgagataaactgtagtatattccaaaggtctttgtttagtaaaagattctgaaatttctactacaaatataaaatagttatgcatttgctatacataatatttttaaataaaagaaatattaaatacctttttgtgtctgttgattcagtgaatccagaaacttgctgcccttattcttgattttaaaaatcagtgtagaagtttgttcatctgtgactttaatggcagctgcatttttgttttggaccgttgaatccaagctgtaagaaggaacttctttttccttttacaatactaatcaattgaatttgacaagccacctatgtaattttaagtagtatagtggaagttctggtctgtgggccgtctttaatccagcagagaaagcgttgtggctttgctctgtctgccacatggagaaatgcagtaaccagctgcagctgacccagattgtatatacagtacccctgaatagtgattccctctttctcagtagactcaagttcagcccacatattacatcaccaaaaattgctggagactgggggcgggaatctccttaggatttcctctttgtagccttaaataggggggtgggatcagcaggaggttgaatagttttgaacaaggagagattgtgtgcaggttgaaggaagggcaccatctggaaacaaactatcatagttcagcgggcaattataaaacaaacattttagtctgctggccagagatcttttaagttgaataccgaaaaaaaaaatagtgctccacttcacttagaagtagttgcaggctgatgagtttggtttttgttaacaaagaacaagagctagactttgtcaggaggcagccacctaaataatgtaataaatactctttatagcctagaagaatttgtaaacattttactaagttgctaatgaaggttttaaacttacaagaaacttgatgttgttgtagtatgttatgtcttactgtgtaatgtgtcttaagataaaacagcctttatatataattaccaaacataagtgaaattctttcagatgcttaagacttttaaatattacattctggtgttacataatgtcatatcctcctattctacaaaatgacctctcctctctgtaaaaggtcattcttgttattaattgatgtggtgtggtttaaaaacaaacataaccctgaactgagtaaaaaacaaggaagctctgactctatgccagctatgtgaacttagacaaatcactttacctgcctctggcaaggttcttctgctatgaaataaggtggtggaagaaatgaataagtgttgagtacaactatactattgtatttcattaattgaagaaatgttaaataactcagtagctgaagaaacacaaacttaggcttaagtaacttagcttagcacttaagtactaagtagtggaactgggatttgaatctaatgccaaagcattatgccacactctctgtcattgattacctagttgctgtaagctgcttctagataaaacttttgggctttctctacatacctgtgctttcccttccttattgctgtagcttgtgctgtgtttctctttctgttaggccacactgttgatccacatcctttatttaaagtctgagcttattttctacctctttcacagaatcatttatttgaattcctatgccatatataggtataccagaggttgcaaacacaagggcctagaaaggcaaatgctcacaagaagaatggagcaggtaatataaatcagtgaagtaaatcagtagtaagatactggagggaaatgaagtttatggcaagttggcatccttttggttaatttaaagggatctgcctgcaccttctcagctgtgcttgtggccatgaaggattatgagacagtgttgccagatcttcccattattcaggaaaaaagagccatttagatttttcctgtaatacttcctgattttaaaaaacattgggacagatgtgctgccagcttctggcctctgatttgtattatgtatcgtttcttgagcattcagtaattatgttgtagtcactaatggcttaaatctgggaaaaataagagataataaattctttctgagcttttaaactttcagcagtttggagctttctaacttgagcacttagtaatatcactagccagggtaggaaattggaatgacaggtatttagggacagattatggttagatatgttaaattgaaaatgaaagtcaggagctcagttatatggagagatttgaaagtcaccagcaattaggtagtagctaaagctatggaactaagatactagagaaagtacatgtagaatgtaaaggaaggttaatgacagaccatgataccaatttccaggaaaccagcttacaagaaacatgaggaaaaagaagaatggtgggggcttagggggaagatacgaaagttcaaggtagggaaaacctgagaactagacgagaatggttacaatactgcagagacattacatagggaggggagaccaagagagatgttttaagacttagaatgagaaagttattaatgccattgccaaaataagtgatacatacagatttcagattatttagtgtgttgaagggtgactagataaaatttaactgacaaattagtgtccacaatacattaagaaattagaaatccataagaaaaagacaacccaaaagaaaaaatgaacagaaacatttattacatagaaatatatacgtttaaccttattactaatcaaggaaataaaaattaagacacagagagataccattttatactcagaagattggcaaaattgagatggataataccaattgttagcacaaatgtggatcaacagaagcttatataccgtgagtgggagtatgaattgatacagctttgaaaaataatgtgacaccatcttgtaaagttgaatattaatatactttagcacttggcagttttgctcctaggcatgtttgtatatcctgaagaaattttgtacatgtgtactgggagatgtgtataagaatgtctatagcaacatggttgggggtgggatgggagtaactcaaaagtctatcaaataaaatggatgagttacaattgtcacacattagcttgttctcattataaggaattacagcagcatttaacagcgtggacaagtcttagaaacaaaatagacgaagcaaccacagaagaccatatttttaaattttatttaataaatgcttataaatcacttggtatgtactagacactttttttttgagacggagtcttgctctgtcacccaagcgggagtgcagtggtacgatctcggctcactacaagctccgcctcctgggttctcgccattctcctgcctcagcctcccatactagacacttttctaacattacaaatactattatttaatccacacatacaataaaatatgatttttaaagctcaaaaataggcaaaagtaggaatacagacaaatgtcggggaaaaaataagggaatgatcttaaagttcaaggtaatggttacttctggacaggaagcaaggagatgaagtagagaaggaacatacagatagatgcaacagtattgatgatgtcgtagttcttttttaaagtagtttaccccaacatattaaaatattaacatgtaaccaataaaaaagttaatagatattttacattaatttttcatgttaactcttcaaaatcttgtctattttatattcaaatacacctcaattcagaatagacccacgaaacagtagtcacatgtggcaagtggttatattggacagcacagtatagcgagtgactacaggcgagttgtcatctgagtttaataagatggaagaatggcaagaactggcacattagtaccccgctcaaatcccacttcttccttgaagctttctctgatcccatcagcaaggaatgacatttttttgcacagaattcttatgaaactcctgtttaaacttttctgtgctacttttttatatcttctattgctgttattgatgtacatatgccaacatccccgtgccatttccttgaggaatcttttagctctccttagggatgttgtagtcataagttgactggtctttcacaaatgtttattatgttgtttgataacaacaagtgtcacatgtgttgataattttttcttagggcaggagtctcaccatgttgcccagactggtctcaaactcctaagcagtctgcccgcctcagcctcccgaagtgctgagattacaggcatgagccaccgttcccggcaataatttttgtgaaatcacgattctcacacaaatatgaaatgaatatgtgtcagaattttcatttaaattattaaatttataagggaatcaaaaatgtgtcaagggagaattcaaagtaacacacatatatgcaatcaggaacgctgaagtaaatttacaaatagttgcaaaattggtcatcactgattagatcccactggacataattctttggcatgtttatggacaataatttgtattaccagttttcaacagctgtgcagagttgtaaaatagctcagaaggaccaaatgggtgcactggagacaggatacccagtaatcttttttcccatctcaaagtttttcacaattttcctgacacatgtgtatcaaatattacattaaaaatagaacgaagaataaaagaagtgtactattgtatgtttctcttccaaggtgtttgttgaagggaggacaaggatgttatcttgaggcgtgggatcagatttgaaggaagagttgcttagattttgttttataagtaggggagatttaaacatgtatattgggccaggtgcagtggctcatgcctgtaatcctagcactttgggaggctgaggcgggtggatcacttgagaccaggagttcgagaccagcctggccaacatggtgaaaccccatctctactaaaaatgcaagaactacccaggcgtggttgcgcatgcctgtcatctcagctattcgggtggctgaggcacaagaatcacttgaacccagaaggcagaggtggcagtgagccgagatcgcaccactgcattccagcctgtgacagagcaagactctttcttgaaaaaaaaaatggtttaaaaaaaaatatgtatactggctctggggaaggagccagtaggggtgaatgatagtagaggcaacagtggttgtctggaaggaggcagcaacgattgcattcaaaattacagttgagatttcggaagaagagagagatgattcttcctccaagattggggaaagtgggaagaacctcagcttcatttggaacctcaagattcatttggagtcatagggaaataaagttgaggttatctaaagaaaaaaaagtatgataggtgacttaaagaatactgtaaagatttactgagtggaaaatgaatgatactaggatgagtaaaaagattgccatgccaaccttttatgttaagcacctattgtcaaaacattgcacaagattttctttctcttggagtgcaagatagagcaactgccttaaatgagtttgcagtcttgaatagataagatataaatgtaaaaaaaataagtaatgagattttgaagtcataaaagtcattaagtgaatagtaagcacacataatgtatgattttttaatagaatataagtaatttttttttaaattgggctataagtgaaacgtctgagatccagctgtcactaacaggttgcatggcattagacaggtccctttactatctatgtatttcaggttcttcatctataaaaggagaggattagactagacagtgtctgaattcctttcttggaatctgtgagaaaactagagaatattgacaccgaattagataagcaaaatataagatttggataggcagagataagtccagaaaacattttaggtataagaaaaagctgagtaaaaacagggtttatttagaaggcagtgggtatgtcattttggttgcatttaccctgagagtacatgaacatgaagtaatggggtaaaagtaggaaggtatgtttttcttttctctccagctatagttgtctaatacatttcacatgtgcattgtgaactctccagaaataaacttaaataagtgacctttcatgttaaggactagtacaaccaaattttagaggatgtgttatttttgttggtacaaaaagcatggagggtaagaaatagttaacttcaatttgtagtcacatgaaccatttcagaaatttatttgttgatctttaaaatgtaaaacatttctaccagattgagataattttcaaagtagttaagactcaaatgatagctatcaactcaaggcaagagagtaaaaacaaatattaaataatttccctatgtcagtcagtggctgggctgctggctaaattaatatcttcaagttgtaacacaccttggaaaatggatacttgcataggttttaagtctgaggttctcagtttaaaataactctccattatgaaactagtcagaggcagagccaattgaagaactcagctcctttccattaattcccatatgtgctggagtttctaactctagcctcaaactatacttgaaaatgaaatcacaagaagacatttacaaaatagcatattattacaaaaaattggtatatgtctgaccccaactgtatggaaagctaggccccagtaaccatatgttacccaggcttcagtgtattaatagcaatatattttaaatgtagcgtacagtggaatatatctataaacaaccccttccccccttttctttgtcatagtctcccaacctacaactaagaaaacgttcatttatctaattgtatttcaggtatctatttgtcagatttaacatacatcgattcagcatacccatcaactggcagcattctagaaaatgagcaaagatcaaatttaatgaataatatccttcgaataatttctgatttacagcagtcttgtgaatatggtaagtttctaggggataatgccaagccattaagattgctgtaatccagtgatttatttacacacactgatgatcacttttcacacagcaggggacatcaatttcttatttccattctaatgtaaaggaaaataatgcttgttttattttgccatttactatgtagcatcctgtttaagatcttgcttttaaggaatttaagtatttaatatttaaaatttttatttttatattttgcttttctgctattttgcagcaactttctcacagcacaaaggcactaagtatttaatattactacctcacagctatttggccctttatagcacagctatttggccctttatagtttacaaagtcattttctagtcattttctattatctcatttgatctccctgatctattatgtaaatcgttcttacagttttcaattagggaagtatagctgagacccttgagcctcgtgacaattgaccaactttcttgagtcagactatcgagtaaatagccagtttttgtccaacatgtattttatggaatgacaaatatagaaacagctacataagcccaaatgatgagaaaaggcattttttttaatgtttaaatacttccagtttgataggaaataaagttaggctgttaatacataatttttatgggttaaaaaactgagttttacattatatgattacttcaagtgaatttatcttaaagctaacttttgcttcatgcatctatactttttagaaaacctcaaaaacttcctaaaactatcagtgtggagatagaatcttactgaaagttaaatcaaataattccttattttgtccttttctcagtattttaaacatagcatcaagttgtgatgttaaattaatcttgcttgaaacttacaaggggaggagataaaccacatttataaatgggaaccaggtttctttaaaagaaaagtaactgccttcatgtcttctgtttagtttagaatagttcttgatctttttctgtgaaatttctcaaatatatgggactttataattggagctattaaaaaaatacaacaatctatacaaacaatatacaactgtaattttctaaattaccttcagattcacattaaagtttatctcagtaatgtccttctagagttaatttaaattttgctgccatgtggccttaatttacctttaagttattttcagcttaatttttaaagttctggttaagatgtactttatcagataattatttatcaccttttgcctagatattcccatgttgcctcatgtccaaaaatatctcaactctgttcagtatatagaagaactacaaaaatttgtggaagacgataattacaagtaggttggatcttcaaaagtggtttgtataactttgtcctgtcctccacctttctatccctatgtatttaaacatctaaatcctacatggtatcatacaaaggactaatccagtggtttacagcagtaaaggtactaacatgtattacttcttaatcacttgttatgattgagccaatatacaaatacctcatctgttctttttaatattttatctctgtttgtagagagctaacgtttgatagttctaatttaaatttcttcctttcccccatattcaatcattgaatccttatagaatttgtcttttaatagacagaaaaattaatgaaactttttaaaatagaaaaattactcttctttaatgctaagtattgacacatcgttgtttgtttttcattgtttttgcggattgagagacttggtccatcttgtctcaggagaagaaacctttctccaatgtagcagaattatcctcttccctgtattatagcaagttctttattaaagatttttgaggccgggcacagtgactcacgcctgtaaccccagcactttgggaggccgaggcgggtggatcacttgaggtcaggagttcaagaccagcctgaccaatatagtgaaacactgtctgtactaaaaatacagaattagccgggcatggtgcatgcctgtaatcccagctgcttgggaggctgaggcaggagaatcacttgaacacaggaggcagaggttgcagtgagccgagagtgcaccattgcactccagcctgggcaaaaagagcaaaactccgtctaaaaaaaaaaaaaaaaaaaaaagattgtttgaaatcatttttaaaatagctgatatccatttttatctccttatatccacagtatttcccaaagatgggagaggaaatttttaaattattaaccctttcatctttcgttgatacagtttacatcaaaactgctgggtttttttttaaggtaggaggataaagagcttatttctcttgaagcttcactcttttcttttagcttcatttgttactttttttaaaaagtttatttagctttattatcccatttgttcgcaagctttcaaattgaattttgcactttcacaaatattttttccaataaaaggtcgtgtttcaaaaatttatcgaagtgaaagactagattatttttcagtgttaatgcattacatagaaatattttttatcttcctttggtaatgattattaacttcctttttccagattttgacagtttttaaaaaattttgtagaacagaattagtcccagtaaatggctatagaaattctggaaaacatctaggaataatttttctaaatgcatctaaaattttactgatgtttgaaaatgcctttattgccatcttctctctcacaccataatagcaacactgtatttctgtaccaattttcagtctacaaaaagtttctacatggttacttacttgaaaatgtatgaagtcaatgaagaagctttttaagactggagttgtttcacaaatctgttgccctaggttgtttttcaagtttgatggtctgtgtcttatacttaccactatttttcccttctctctaattactgacatagaactcctacctaataaatacttaagttttgtccagtgagatgtagaacagatatcttaaaattcaaaatgtgagtaagtagctattagtcatttatctggctcaagaaacttactgaatttaaaagaatttaaagtttattagattgaaatgtaatctaagaaaattttgcacagtttatagaggatggcaaattttttgtgactactgtaaaattataatacaatatttattaaagctagtttttactttgctaaaagggtagacttagccagtgaagccatgaggtagttctgacattctgtaaattgacatatcatataatgccttcatttttgtaggaaagctaatgctattatactggtttttgttttcatgaggagctagaaccagagcagcccttccattacattgacatatatttactaaggttttgttataggccagttactgtgctagttgctgggattataaaaataagatactgttcttgccctcaagaagctcagtctaatgtcagatacatccacaaaacagatgattataaaacatttcaaacagaaccataataaagatatgccaaggatgctatggaaacatagataaggggggacctaacctagctttacctaggaaaactaaaaggaaatatgaacagcttcaggagacagcgtcatctgaggctgaatcttaacaggtgagtgggagttagtctcacgtgaagggtaaggaaaagtatgctggggatggaatgatcaaaggaatgggataagaaacagtgtctttgcatggcgaacgatgagtcatttggtgttattgggacatcatacggcactagagaagacattgtttttctttttcttggagacggaatctcactctgtttcccagtttggagggcaatggcacaatctcagctcactgcaacctccgccgcctggggttcaagcaattcttctgcctcagcctcccgagtagctgggattacaggtgcccgccatcatgcccggctaatttttgtatttttagtagagatggggtttcaccatattggccaggctgatcttgaactcctgacctcagatgattcaccagctttggcctcccaaagtgctaggattacaggcgtgagccaccgcactcactgacagattgtttttctaaaaatgcagtgtgttgcctgagcctaataatttagtgtgtttgaaaaatagagcattttaagatgtcattaaaattattagaaaaaattagaagaaaacattttttagaaaaaatgccttttatgatgaaaaatttgtaaatagaaatggcatgtcacttacaaaaggcctgttttgggcaacttcatctacataggcagccagtatagatattacaaattacatgtcttttgatcagggtgaaaattcttctgggtgattttattttaatactgaacatatctgttcttaatgaatcagcatctctattataatgtggtgctttgacgatgttgtaagcagctggcactcagactagccttcactgctttttaaagatgcctctgctttttatattgctgtcagtttctaggtgctaccaatagcaatgtgattcacccaataagctccctttctgttcctttctattttggtgccattgggaaatggtagttatttcatttactacttttctttcatccactagactgtaagcttcagaaggacaggaataccgtgtctgccgtaatctctattatattccagttctgagcacagtgcccaacacaagtgttcagtaaatatttgtcacatgaatgaatgcagtatagtttgtagcctaaataattaaacatcttcataaaaagaaaaagtctggttaatcatttatctattcaatatatgcattttatattatcaaataactggaatataattaataacctacagtagatttatcattataaatgcctcttgtattattcaattatttttaaaattttagtcagtagaatactaaacagtttttattaaatttcagacagactccgcaatattaagcttcgtgtattacaccaaagcattttctacaactactttagtgtcctgttttctgaaatagcttccactgatagaaatcataatctctttcactgtgaaactcagaactggatatattatcctaaatgaaacttaagtaccatataataaactctgacttaggacagggacttactaggaattttgcaaacaacatttttatttgtatagatctttctgctgaagagttctgtcagctggtttgttagatggttagttttaaataaggtgtttttagaaataatttgcataatatatttaataatacatatgaaagtttctgaatttaaatgtaaagtatcagtgtaagctctaagttgaatcatcatttagtcattcatcaaatatctttaaatgtgttccatggtttggcaactttggggtaattggggagatttttgtgtttttaaatacaactttttaatgtattttcccttcctaatatttcctaaaataaccataagatcagctttgtatgaaagagataagagacttaacatcttaattaaaaattgcccttggccaggcttggtggctcatgcctgtaatcccagcactttgggaggccaagatggaaggatcgcttgagcccaggagtttgaggcttaagtgagattccctgtctcttaaaaagaagaagattgctcttgaagaaaagtatataggtcagattatttcataaaaatgtttttagtttttttgtgagaaaatacacaactttaatcttattttgtcaaatgttaattaatcattgtatgtattttgtctttttaaaattcaggctttcattaaagatagaaccagggacaagcaccccacgttctgctgcttccagagaagatttagtaggtcagtacgtagttttctcttgttaccaaatctaaatcagataacctaataaggaagaatatactccaaagtaaataaaaacttagtacatcttatactgcatgtaaaatttattttgatattaaaatctgtcctttctgggttttttggtttttaatttaaaagttgctggccgggcagggtggctcacgcctgtaatcccagcactttgggaggccgaggcgggcggatcacagggtcaggagatcaagaccatcctggctaacacagtgaaaccccgtctctgctaaaaaaataacaaaaaaattagccgggtgtggtggcgggcacctatagtcccagctactcaggaggctgaggcagcagaatggcgtgaacccgggaggcagagcttgcaatgagccgagatcgtgccactgcactccagcctgtgtgacacagcaagactccatctcaaaaaaaaaaaatgttgctatagtttgtcagtagtgtacaaacaagtatgctacctaatcaaggaaaatagatagatgcaacagatggaaaataatagataagtagttatgaatattcatttttgattaagaatgcactgtcctaggcaatgaaggttgattacactagaaatttctgtggtctaatgggaaagtctactaatttgaataattatagaagtcaattttagtgacgtaattttttcaaatgttcactttaatactagaccaagtattaaaaatgtaaaaatcatagttccttactttacctgttacattgtaatggggatattatgcatataccacaaataattttttaaaaaacataaaattatcattatttaagaaatccctgataagtaccttttttaaaattcccaatataggccttcgcactaagtttcatgtatattctaaaaatatttgatggctaatctgataagatgtgaagaagtggagaaacaaaccatgacaatgtctatggggaagaatattccaagcagaaaaaacattgcagtttaaatttcttaaatttgcttttctttttattcttaaagtgctgttttgcacttttataatattcttttatttattcccataagcctgaacagtgtcagtgtagatttaatttctgatttgagtgtttgacctaccctacacattctttatctaagaggaagttgaaactaggagtaaagaagtaatgtataaaattaaaagagcactgaacctaggactcagaagacctgtgtgtttagtccagattttgtctgtgatgtgaaagctagtctcttctaattctacttcttcctatgtaaatggagaaaatatttacactgcctctacttagtataagtaagataaaaattaatggattttgtatggtttgggattttgtgttttaggacttagatatatttctcatcttcaagccaattaaatagaactaacatcagtactatctcaaaatttgaaccacatttaatattttctttcaagggattgaaaaataaagtaatcatttgaaaatctctttaaatttaacccttaggtcctgaagtaggagcgtctccacagagtggacgaaaaagtgtggcagctgaaggagccttgctcccacagacaccgccatcccctcggaatctgattccacatggacataggaagtgccatagtttgggttataagtcagcatttttaattttatctttcaaatttttaagtcttttgtaattggatttattgtcgatttattagttcagtagaaaatggtatccttgaatagttttcttttttcttaatagctgttttctgattcagtaaaatgccttgtttgcctaaaagcttttatttcttactttacctgaatttggaaatgggattttgtcaacaatgcatttatatttggggacgataaatgaacattacagagggccatcataaataaaatcaggatagcaatatacctttttaaaagagttacaacctttatatcaagacagtcattgtttgtcttaaccaaaataagtcaaaaataacagctataaaaattattttctttattcctaaatataaagaaaactgactttttgtttaacttcattagttttgcagtattgttttttcaaaatggggacacatgttcacttttgccatgatttctctggaaatgtaataactgttctccaaaagtgaatgtggaaacaattttttaaacggacacgaggcttaaaatgaaattattttaaagtatgctctaattatatagatagatagggccaggtttcctaaaacattttccctaaactgttcatttgaggcttttatggtaagatctgagtatgacagttaggtaaatcttttatgtcctaaatctttatataaagagcagtttttaaattagtaacaataataaaagatatgaacttttttttctgtttctagtttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtgagaaatacttctctgagagggttgcaatttaactttaaataaaaatgttaataaaacttggctggaaaaaaaccccacccacacacagagaaaatttggttaaaaaaacaaagtagcagttaaatatgggatgaagttaataatttgtgatggttttaaaagtgcttgctgtttttaactccagaaggggaagcatttgaagaaggtggaaaaagaacatatgggctggttgaattagttaactgcatgtgatttggatatggggaggaggaagagtgtggagtcaagaatgacttccggttatttgggttaaacaagtataatagttagatgatgatgctattaccaaggtagagaagacagagtaataatctgtgggcagtgaagcgtttgtgaatttggggaatcaggtgtgttttggacatgtttagtccctatggagatgtcaggtaggttgttgaatatgtgaatctggagctcggggataaggtcagatctgaagatatacgagaggtagcatatttataagccatgattggttgagggtacctaaagagagagtgtacataaataaaaaaacattctcacatttagaagtctgattattttttaaaagaaggatgagtcatcaaaggaaactaaaaaggagagatcagtgaagtaaggggaaaaaaacaaaagcccagtagatgaagtatctcaaggaggaggaaagtactgaatgtgtgaatatcaaatgcagaacaagagagctaagatgagaatggggaattgactgggggatttggcaagataaaagtcattggtgaccttgataagagttgcttcatggaagtgtcagggcatggcctggattggagtagatttgaaaatgagaggtgaggaaacagagatagctactgtgaaggagagcagaaaatagagaccatattagaaagggatgtgagattaagagagggatttgtttgtttttacttcctaaacttttaatttttgagtcttctagatgagcattatttcttgttacaattagaaattattcatatagcctgggcagtgtggctcacacctgtaatcccagcactttgggaggcccagatgggcagatctcttgaggtcaggagttcaaaatgagcctggccaacatggcaaaaccccatctctactaaaaatacaaaaagtagcagggcgtggtggtgcatgcctgtaatcccagctacttaggaggctgaggcataggaatcatttgaacccaggaaacagaggttgcagcgagccatgttcgcagcactgcactaccctgcctggatcacagagcgagattctgtctcaaaaaaagaaagaaattgttcatataatagctacttttatttttaaaaagaaataaaggaggaatatgtcttcatctatgattaactaccagattgttcaaggactaagcctattgttactaatatcttaatattggtaaacagccagtagaaggagatgcaaaaggagattgattttctggaacatactgactttcttagcccttgagagttaaaattaaattatttcagagctctccattaccattcagtagttgtttattctgatagtcccctttttatataaaaatacaagtgattaaatgataaaatgttttaaaaagaaggcaagtttgtcacctgaaatacctcttatcaatgttctaagttgcctatatgcaaatactaatctcagtatgaagaataattttgcaaaggaaagaactttttttcagtcaaaaattttctacacgtccatggaatttggcatgccacttaaagcaaaaagtttttaaaattacagctctcaagtatataatattttactctttctcataagtgttataatgagaattattctgtagtttatagcttttacttttcatggatgtccttttggctaccaaaagattattgtttagttattttattgagttacagttagtgtctcagtgtggagacttttctcttttagagcagatttttgcatttgtgtttattttttaattattctaaggctaagtaagtaaacagtaaaagatcattgcatcctagtttgtaaactaagaacattacacataggcatttaccttcgaggatttttgttttaaagctttaacaatatgaaaaaaagaataagtctattaccataagatgataggtgttaatatacacacacgagtttttccctcagctttaacttttacatgcaatattaatctacagtgaaggctttgaaaatactgtgggaaaattaaccagtgcttagaacaatggccttaaacattttctaatgtggtatctatcctagataatcttgagtagtctcacctagctaactaagagaagcatattcactctgagcttcatgcttacattttctacaaataagttatcctaattatgcttaaattttcagtctttaccacatagtgccacaaatcaaaggataatgtagataatgtacaagaccccaccaccaccacgggttacctctggttcttctgaaccatacaatacagaaaattatttcagtgattgttatctcagtttatccaaggatggtacataactagtgccattgcaaacccgtagaagggtattaatccatcgtctctaagagagacgagtctaatggataccttacagcatccattacaggtgtctgatggataccttacagcattagaatttgagtctctcagaaccctgcccgtaaaaaagagtttgagtctctcttcttagaaccctgtctgatagacaatttaacttgacctattaatcatcctaatttttttgagagccagaattacctttaaagtaacatttaagtaaactaagctgttttggactctctaaattcattccccatagtttttttgttggttttttttccccctagctaattgtaaacgttctgtttgaagaccattttattttaactgatcttttggccaaagagaaaattgttgcatttttatagcaccggtttttggttttttaaatttagagattccatcttctttgtctctagagacaaataagtggatttcattaggctttttatacttagggtagtaatggactttaatacaaagagaaaggagtatgccatgaatcgtcaaggattttataattatattggtcctaaattatgacaaacctaataagaaattttgtgttattttatgttctctaatggtaggaaaaattgtttattgacataatgaatttcagctacaaataggcaagcaaaaatgttttatgctattttgttattttaggttgtcgtgtcaactgtattccaatatattgcaaaataaacctaacagcagtaatattagaataaagaattaatatgtggatatgttcatctacaatgcgattgtcattttatgagcatagttaattaatttatttttacattgtgaaatgcaaactagagaggtaattctgatgtttaaaaaataggataacttttcattttaggtagcagcgatggttctgaactaagtgaagagacctcatggcctgcttttgaaaggtaagataaattgtccatttgaactacttggagtttattttgtctgggttaaataatataatacaaattttcagagataatatttact

SEQ ID NO: 551 - DNA, 1419 bp, Homo sapiens
gagctttcaagttgtggatggaataaaaaagaaaaatatagttctgcaccaaatgcagttgccttcacaagaagattcaatcatgtaagcttttgggttgttagagagattcttcatgctcaaacattaaaaattagagcagaagttttgagccactatattaaaactgctaagaaactgtatgagctgaataaccttcatgcacttatggcagtggtttctggcctacagagtgccccaattttcaggttgactaaaacatgggcgttattaagtcgaaaagacaaaactacctttgaaaaattagaatatgtaatgagtaaagaagataactacaaaagactcagagactatataagtagcttaaagatgacaccttgcattccctatttaggtatctatttgtcagatttaacatacatcgattcagcatacccatcaactggcagcattctagaaaatgagcaaagatcaaatttaatgaataatatccttcgaataatttctgatttacagcagtcttgtgaatatgatattcccatgttgcctcatgtccaaaaatatctcaactctgttcagtatatagaagaactacaaaaatttgtggaagacgataattacaagtaggttggatcttcaaaagtggtttgtataactttgtcctgtcctccacctttctatccctatgtatttaaacatctaaatcctacatggtatcatacaaaggactaatccagtggtttacagcagtaaaggtactaacatgtattacttcttaatcacttgttatgattgagccaatatacaaatacctcatctgttctttttaatattttatctctgtttgtagagagctaacgtttgatagttctaatttaaatttcttcctttcccccatattcaatcattgaatccttatagaatttgtcttttaatagacagaaaaattaatgaaactttttaaaatagaaaaattactcttctttaatgctaagtattgacacatcgttgtttgtttttcattgtttttgcggattgagagacttggtccatcttgtctcaggagaagaaacctttctccaatgtagcagaattatcctcttccctgtattatagcaagttctttattaaagatttttgaggccgggcacagtgactcacgcctgtaaccccagcactttgggaggccgaggcgggtggatcacttgaggtcaggagttcaagaccagcctgaccaatatagtgaaacactgtctgtactaaaaatacagaattagccgggcatggtgcatgcctgtaatcccagctgcttgggaggctgaggcaggagaatcacttgaacacaggaggcagaggttgcagtgagccgagagtgcaccattgcactccagcctgggcaaaaagagcaaaactccgtct

SEQ ID NO: 552 - protein, 208 aa, Homo sapiens
ELSSCGWNKKEKYSSAPNAVAFTRRFNHVSFWVVREILHAQTLKIRAEVLSHYIKTAKKLYELNNLHALMAVVSGLQSAPIFRLTKTWALLSRKDKTTFEKLEYVMSKEDNYKRLRDYISSLKMTPCIPYLGIYLSDLTYIDSAYPSTGSILENEQRSNLMNNILRIISDLQQSCEYDIPMLPHVQKYLNSVQYIEELQKFVEDDNYK

SEQ ID NO: 553 - DNA, 52679 bp, Mus musculus
  misc_feature (1)...(52679): n = A,T,C or G
agagaagaagctgttgtgtgatatctgcaggcagtggtgatggcaatcagtacgcttactcaaagccatgttgcatagatttctctttcttttaatgtctttttttttttaatccacagccctagcttaatggacagtactgcccatattcagggttggtctttcaactcagcttctatgctagtgttcctaggaaatagatccacccataggttactctcatagttatttctcaatccaattaaacagacaaataaaccaactcaatggtaagaaacaattggtgttcatggacatatactgtgaaaaatggctgtatgtataaaggtagcataagtataggagagtttgttaaaaaaacaaaacaaaacaaaacaaaacaaaacaaaacatcatttatagtttattgtagtcctaaactgaaaacttcaaattttatcaactctatagaagactgtgaattgtatactaatttctgcaaacataaacacactacacactcgataacataggcaagtcttttaaatataatatgaacataaaatataagtcatctaaggatgcagtgtgatttcagttacatttagcttaaaataaaaaataaaaccatagtgtttagttgtatgcacataagtaatgtgcctataaaaaaaagaaagcagacatactggttcacccacaaggataagacagaaagatcaatacaggttttaggatagcctgggctacagtgagattagcttcatgaaaacaaaaagaaactaaaacaaaaagaattaataaaaataagaaaagaaatattcactacattacagttagagtgggtaagctggagaggtatctcagcctaaaaagtattttctatacaagcatgagtacccaagtttgtatccccagcacctacatttaaaaaataaaaattaaaacaaaatttgggcctggtgccatgcatctgtaattcaaatgctgggtcaggaagaccctgggtcttgttgaccaattagtatatgccttaaccagcaagttccaagttcaatatgaggttctgcctcaaaagacaaaataaaatctagcaaaacaatctattttcaataaaagaaaaatgagggattgataaacaagtggaactacaatcaaggaaaatgttggcatctgacctatatacatgcgaatgtgcacaggtgactgagggtgaagagataagggacctcggtaatgggaaagaactagctgactcttaggattttggcaggagcaatagggaaaaagggaaaacaggccattccaggtccacttgaggatttttttgtgctaagaatggtaaaaagctatggtcaattttaagctgaagactgtcagggtttcatttcaaagtgttaagagtggatataagaatataactaaaaatagtttacaatagcttcagatgagattcaagttgcatattaaataggcttcaaaagtgcaatcaggaactaaggagatggctcagggaataagatttgctgtgcaaaaatgaggaccagtgtccaaggcttgagcacacaggcaaaaagtcatttctggtgctcatccattacctaagcactggggaggcaacggcaattacatcctggaggccttgctggccagccagtcttaacagtgagttctggggtcagagagaattgctgccttaaagagagggagatgggggctggggggaagatattcactactggcctctggcctctacatttgtacttatgggtgcacatatgtataacacacacacatacaatcacacctccaccaataatggcaaaataaaattatgtacaaaatgtgatgtgattctcagagataggtgattatttctgggaatttcaagagttggccataggaaggaaaagaggaaaggaattccagatagataaaaagcaccacagctaaaagtatcttatatatctacatgatatccacaggtacaataaatacagtgagtttaaaacttaaaaggaaggaggtcagaccagaggggaaaagttcacagtcacaggggagcttacagactctgtcatggggtcaggattggttccatagactaacaagtgttgggattatgtttgtatattagatgacctatattaggtgtgaagtggatggtgaacacagcagacatggttagcaaagaagcaggcaactaagcagaaggtagtaatagagaaacaaaacacacacaaaaaaaatttgcacttgacaaatatttaggatgactctttaatgcacttgtctggaaggcactatatatatgactagttccgaaacttatcccagctttaaatgcggttaatgtacatgggatgtagatggaaaacttacatttcattcctgacgcagtaggacgacctatcctagcttcagtagcaccatattccgaatgtatataagttagcccatcacagtggtcaggcaggcaggatttatttgtactcttagaagctttcaagacaggtaacccagacatggcgtattttataaaagaaacagagtaagagaaataacagatacagaggtattctgaattggttagtggtttatttcaattaccaattcttaaagactcttcacaatgctgattcctctgagatactccaaattactgtggattaccactttcctcccaaataatggcgtcgttacattccaggtctagtgttagggacagatgaggaagaacagtgacagttccttccatttctttacatccgtctagtcacatagtggagggccacagaacttgaagggaattagctgtcaatcttagctttatatgaggtgataagtgaagagaatgggttaaagtcttccaaaggcgcctcttctctgtgtgattctttagtgaagatgacagcagaactgagtgaggcttctggaaattctcacataggcattaggtgtaatcagtacataaagagttccagaaaggtccctctagagcaagaggatgaggtcaagaaaaagtcatcctccaaagataatacaagaaattactttgccttaagaaccaaacaaataaaacttatatgttagctgtgtgtatacttttaaatctaatcagatcactgtgtagaaatgctcatatatgttaatatagacattgttcatattactgcagtgtaattcttgctttatatctctttccttctgcgctgctgtgaattctttttcagagaaacagtatttcagtgattctatcttatgaatgtagaggtctgggacagattaagaactaaaaatgcattgacaaaatgaaatagaaatataaccaaaggaggcagatgtactgaaatacaaccaatggccattcctggcttcccacagtaccaagcttgagctgcttcataacccctcagtcctgaagctttcatgttatccacactggagccatgtggacaatccttacatgatgttcatctgccagcagaagatgcagcgtgttcttctaacactgaggaaatgctcccaggagatttaacctcagtgagctggtctcttagtcatagctgatttttcatattgagccaacatcaatttcaccactaaaacaaagttttcacttcaggagttctggtctcttgttattaacagccaattcttcatctccaaatgactagaaatcacagattcttattttaaagtatcacatgcatgccctgatagagtctttgaacgattctcaaacattcatcattccgaattcatctcaacattgtcttccaagttcctacaataactcaataagctctggacacacagaacttttcatcccaactttccaaaatcctttactatcctccaatatcaacatggtcaggtttatcgcagcaataggccattctctggtgccaatgtttgtcttagttggcttgctgttactgtgatgaacagcatgaccaaagcaacttcaggagcacaaagctcattttatctttacaggtaacagtttaccatgttggtattggaggataacaaaggatatgagatagggggcatctatctctaagatgtgccaaagacttaggatgggggaggtgctcaagaatctatgggtatgaccttagctgtgactcactacattggggatgtggaatctggagaggccacctcctgtagccagacaggaaccccaatggagcaatagagacaccaacccacccacaaaacttttgactcaaaatttatcctgttcacaagaaagacagggacagggcatggagcagagactaagggattagttaaacaataactggcccaagttgagacccatctcctgggcaagcaccaatccatgacactattaatgatactctgatgtgcttgcagacaggaacctagcataactatcctctgagaggcttcacccagcagctcactgaaacagatgcaaagacccacagccaaacattgtaccaactcaggaagtcttttggaagaggtgtgggaggaattgagggccccggaggggatgggagctccacagaaagaacaacggaatcaactaacctgggcccttgagggctctcagagactaaaccaccaaccaaagtgcaaacacaggttggacctaggacccctgcatatgtgtaacagatgtgcagtgaatcttcatatggctcaccaataactgaagtggggctgtccctaaagctgttgttgtgaattcttttcccctaacttggatgccttgtctggcctcagtgagagagtattatctccaaatacagtcacatgctgatgtactaggttctagaatatcagcctttctacctggagagcacataagtcagctcatgaacaggattgcacctggttcaagtctttgggctggtctcatttgtgttactatatcagagtataataaactagataatttgtactaaaccaaaatcctggttctaatggctgggaatacaagatcattatgttgtattggcccatgtagaaagacaaaatcttaaaagtgagctaaaaagagttaaacctgtctattttataaaggatacattcttgtgactggtacattaattatcccattcctcctgtcttagggtttgtattcctgtgcaaagcatcatgaccaaaaagcaagatggggaggaaagggtttattcaacttacaactccacaatgctatttatcaccaaaggaagccaggacaagatctcacacagggcaggaacttatgcagaggcttggaggggtgctgcttactggattgctttccctcttgcttgctcagcttgctttctaatagaacccaggactaccagctcagggatggcatcacccacaatgggctggacccacctcccttatcactaattgagaaaatgccttacagctggatctcatggaggcatttcctcaagggaagctcttttctctgtgataactcaaacttgtatcaagttgacacacaaaaccaggcagtacaatggcctattaatcacattaggtttcatctctgaacaatgtcatattagggttaatctctgaaatgtccatatcagggaacaagtatgcaatacgtgaatttggcaaccattaagacattgttgcagataggcccaggtaagaagcacatttggatgaacattacagtggtcaatgtaaatatgatcagactctcatagtagacaaaagggggcatggcaaaaaaaaaaaaaacaaaaaaacaaaaacaaaaacaaaaaaccgatgtaatgagaatcaacagaaaaatcaatgttaggaatcactctcttggctcatcatactgaaagtgtacagtccaatggatagaatccatctaccacctcagcacataagctctaaaatttgaatccaccccacacttcaccacaaaaccccacatcaaaaaaatctacagtttggggatgtagttctgtggtaaaggacatgtgctaccatgtgctagggcgtgagttctatcctcaaaagtacatcaaataaataattattctgcagcatagaacttaattcagcaacatagtccatggccttaaggacaacttagccataatgccctgatagagattcatgtcttaccagtagatatctgatgcatgttcctcctgccattaataatttctcaaagtcgagagacattcttggttcctagattccaccgagactagtctgcacaggtggagaagagtggactacagaagctaacagcttctgtgacaggcagaagnnnnnnnnnnnnnnnnnnnntatgaaattcctaggcaaatggatggacctggagggcaccatcttgagtgaggtaacccaatcttaaaagaactcacacagtatgtactcactgataagttgatattagcccagaaacttagaacatccaagatattagatacaatttgcaaaacaaatgaaacttaagaagaaggaagaccaaagtgtggacactttgccccttctcagaattgggaagaaaacacccatgggaaggagttacagagacaaagtttggagctgattcgaaagcatggaccatctagagactgccatatctggggatccatcccataatcagcttccaaatgctgacaccattgcatacactagcaagattttgctgaaaggacccagatatagctgtctcttgtgagactatgcaggggcctagcaaacacagaagtggatgctcactgtcagctattggatggatcacagggcccccaatggaggagctagagaaagtacccaaggagctggggggatctgcaaccctataggtggaacaacaatatgaactacccagtaccccccagagctcccgtctctagctgcatatgtatcagaagttggcctagttggccatcagttgaaagagaggcccattggtcgtgcaaactttatatgcctcagtacagggggacaccaaggccaagtagtgggcgtgggtgggtgggggagcatgtgggggacttttgggatagcattggaaatgtaaatgaaataaatacctaataaaaaaaaaagaatttctcaaagtcttccatactctgctactacttaaatttgaacatcccaacatctatatgttcagataaatgctgtcaaatgttaactttcccaggaagctcttactttctcaggcagtgagttatttccctctgtcaagccccaggaacactatgcaaagagtatcctctcatgatgttatgatggcttattctttgcataatgcactcctttgaaactattcctcgtgggctagaattaatttttttcctttgtccctcaagagctcaatatggtgatcattcaatattcatcaatgattcatcaaacattcgttaaatattcattaaacatctggtgagtttgtaagaagcaaactttacacctgacactaccagagtgagccaggtgaggctcttcttgtgttttctctgtaatatctcttttctgacaacactggaaagaaactatatcaataaaattagcttttcaatatttagaaattaacctctatatgtgtgtgtgtgtgtgtgtgtgtgtgtgcatttgactaaccaacaacaaaaattccagaagaaaagtaacagagtttctaatttgtcacaacttttatcaatcttataagtcaaacccaatttaattttaagggacaaagaaaaatcactgtcttcatgtctttttcttaaaaatttactaagtggctatcactgcctatctgatcaaatcaaggtttcccagtccagctttgaaggcctttatagactctccacatatcactcatcgaacccactagctgtcatcgaaccacacaactgtcagaattaatcttcctgaaatataggactattttctttcatactcaaaaatgctttaaggctcctcaggacttaagataaatttctaagtgttcacaaatatatttgtctcttgtccttttttatttttcctgggaccgcagcctctcctatagacactggtgttcagctaagtttccaagttcgtttcctcaggttactcattcattttcctgtctatgagtctctctggtatgcaagtggttcctggaccaccttcagtgctctcttctctgtctattttaagatgtatcatacccagtcagccaagcattctctatctgcagtattccattggtagtctattgggcatcagcctgactgatactctctgttctgctcatatttcaatcggctgctcacaatactctaatcttcccttagttgtttagatcagtattacacctagtactaccagcatacaaaccccattcttttcacactgcctgcatcctatatctactagaagatctactagaatatctttcttgtaaatatcttcaaagcatgtttatatatgttgctgtgatctttctccttttgccttttatgttcactatgagtagattttttcatccacaactaattgaaagagtccatgtaaaggtcatcaataggataggatgtgccaggaagaaatgaccagagtcaaatattaacaggagaaaattgttgtggataatttaagtaaatgtaaataaataaatggctgtgacacaatttaaatacaaatgtaggctttatttattgccatgagctatcagagctgttttacttaactaaatgcttcttggatcctctggtgcttccctcctttatccaggttatattagttagggttttctagagagagactggttgaatgcgtgttatggtttgtatacgctcagcccagggagtagcactattagaatctgtggccctgttggagtaggtatgtcagtgttagtgtgagctttaagaccctcatcttagctgacaagaagccagtattctgctagcagtcttcagatgaagaggtagaactttcagatcctcctgaaccaaacctgcctgggtgctgccatgttcctgccttgatgataatagactgaaactcagaacctgtaagccaaccccaattcaatgtccttaataagagctgccttggtcatggtgtctgtttacaacagtaaaaccctaagatgtgtgtgtgtgtgtgtgtgtgtgtgtaaattggatttatttgaatggattacaggttatagtctattccaaaaatgtctgtctcccaatgaaaagtctaagaatatagtagctgttcaattaaggctggatgtcccaggtgatcttcagtataagctggaatccaggagaactaggttttaatgtcagcgaaagaatgaacttgccagggagaacaagggcaagctagcaaagggcttaatcttctttttctatacttagcctgcctaaaggtccagattaaaggtggatcttctcatcttagtgatatggatttaagataggtcttatcttaaatagcttaattaagaaaaatctctcacagatgtacctaactgcttgtgattttgttagattccaaatgtagtcaagttgaccaccataaatagccatcacatatatttcagtgatctagtttctaggcttgatcttacttgcccccatttgtgtaaggtgaattacctagatttaacctccctcacctctctttcaaacactctttcagcttaattttatgcatggttttcagttccattagtaagttacccagagttaatagtgtattgctttagtactgatctttgagacctagttgtagtttcaaatatgtactctttccacgtagatgtcaggcaggctatacttcgtctacttatgtgtaaaactaaactcttgggttctttcctccttaaaactagcttttctttattggtacaagaagcgacagaacttccaaacaagagaaattatgtgcaaagtttgagccccacccagaaggcgtggggagggagggagaggccaccacgcgcaactgctgccgttgtcatcagcacgcttgggcggggccactactgcacatgcgcagtgcggggcctgtccgcctctcggagctgtcaataaagttttagcgaacaagcgctcctttcccccggcaagatggcggagtacgacctgactactcgcatcgcgcattttctggatcggcacctggtctttccgcttcttgagtttctctctgtgaaagaggtgaggaagctttgagaaggaggacggcgtagggacgagagaggcgcctggagacgcggggaggcggcggcagggcctacacacgtgcgagccggaagccggcttgggccgccctgacagacacgggctgggccctgggacagcagcttcccgcgtacggtagcgctgtcggggtgctcggggcggtgggactcggctgtgcgtccggaggggtgaggtgacagcgcggggttctggcgacgccggggtctttgcttcctggcccgaggctcaggatcctgcgggcggccatgtctgtttttgcctgaagctgcgttggctgagcgagtgctttgggctcgccacggatgctattggaaatttcagttttctttttagaaattgagtctatggccttggatttgggttgtgttcagaatcccattacaagattctcttacatttcaggcattctaatttccttgaagttgtggatactttgctgtgaatttcctggtcatcgatagatatttatttcataggaatgtagcgtacgttgtcagatgagagtgaggaccaagaataacccacaagctgcaatgtaaactttgtttttagtgttgatgttcagacttaacgaagtatgattcagtcataaatgttcaatgagatgtcctaagtatgtagtttggggacttaatacgtttcagtcctgaatttaggagtttgtttgggggtactgagaagaagtattggattagaactattatggctaactatatattggctttatggagaaattgatgcattttactaattacagtaagtaaagtgtaaggctagaattttgtctagcagagttagtaagttgtgctttctggacacagattataacagggaactgcagattcaggggcaggtattttgtgttcactggcagttttctaaaaagtctagtaaaactgttttgatgacatatatacgcttccagatagctacggtttatatgacaggtatagtatttatattcataggaagttttctaaacaagtgtattgtcagcagggaacagcaaaattaattttcaataaatgctgaagaatgtcttgacaggtgggtcatgagcttgatggatatattctttttgcattgaattttgtagtctgcacactagagagaaaaagttctgactgtcttttgtttcattttctgagtatatgatatatatatatatagatagacagatacagatatagatatatacatattgaagtctctcaccttgctagtgtagcagagatattttagatctgcctgaacttaatatttttgtgttttttaatgcatttatgtttttaagggaagaatgtgtaagtgtagattgtttattcataggcaaggctataactgagactcgggaaacatctaaaagaatgttattaccggggtagtacggtggctttaatacttcaagaggaagaccgttcctaaatattgagacataaactatgaaaaatccaagctaaatctccagcatctcaccattgaaaaatgtaacctttttatagattgatgtgtctgtaaggtaaaaatgatacatatcaggcaagtattgactaaatactgttaaaattcaagaatttctgttaaccattagtgggcaaaaaaagtactttgaaagggggaattgagtcttggaagctaggtaattaggacagaggcagtggtcatgatgtttgccattactgatacatttgtatattggagtataaaagttccaggagagaaaaactggtttctaatctaggttctccacatggcctcagcacttgaaatagttctgcataaaggcttttaataatcattgaatagttaaatgaattatgaatttgcatgtcacagtttattgtgtgaagtgtcaggttagagggtgagtgccaagataagaagagtgggttttgaatttgggcatgggttaggatcgtcctctgtctcgattcctctgcacttcagaggtttgttttgttttgtttctggttttgttcttttgttttttctattttaaccagcttctcagtcattctacctctcagtgtaagctctgttcacctgatttgtctgactgttgtggaggggttgttttccctttgagataagatcttgcttgctaggtaacccaggagggctttgaactccttacctgactgtaattttcccaagggctgactttacaaaagtatatcaccacccccaactttctttttcttcatataaatgaaattcaccaacaggattttatacttgtttaatgttttgaactccaatcccttgatgtgacaagcaggctgtctaccactgtgatctatattccaagctgtttttagaaacagagtttccctgtgtagtcctagctggtctagaactccctactccagaggtcgtcctgagtattaacaaatgtataccagcacccctggcttcacgaactaattcctgagtcatctttccatctgtgaaagtcactggccctgtgacggcagttatgaatactgaccatcagtgctgatggttaatttgttgtagtctaccagtttgttcatccattctagtactaaacgactgtgtactgtaaagatttttgggaattatactttaaatagatgtactcttgttttaatatcttacaaagttggtgagtcaaagcatgtatgatgtcaggaaataaaaacctttttttcttttttgggggggagggtgggtttcaagacagggtttctctgtatagccctggctgtcctggaactcactttgtagaccaggctggcctcgaactcagaaattcgcctgcctcagcctctgcctcccgagtgctgggattaaaggcgtgaaccaccacgcccggcttaaaaaccttttttcttaaatgactgtgttcttgctagtaggatttgaatgttctgtttagtcttcattcacactaagactgatactctcaggttttttgttttgtttttttatcatagtttttatatatacttccttttgattaatgagagcttatgttgttttgttcatttgattatcttgatttgttagtgactattaagatgttttacccatttcagttggattgtcatttgttactgttttgttggagttttatatctaatctggaacattcacatttgagtctgtgttacatggttgtgaattcttactagatctttctttcctttgcaagattaaactcaggacatgagtcttatttggctaagtatctctcaggttcctaacatatcctaagtagccttcatgtttgtgagtctatatgtataatttatttcctgtgagttaatatgtgtttccagaaccctttgcaaagcaaaaacttgtcatgaggttgttgacttacaaaattggttctagtttaattttagaggtacagatggagaagcatttaaatggttgcaactcttaaatgagacaaatataaaggtaaaggagtggccacatcaaggagtggtgggtagtcatcatggggatgcaaaggatagtaaggaggtaaaatatttaagagcctattcctaattacctgggtgtggagaagaagaggtgtggatacttttgtgtattgcatatctttcctagaacaagtaaaagattgcttgataaaacaataattgagatcagaagtaaatgggaatgacattgattttcaaatatttgtgtagacaggatattttgtgtaaattgagtgcttcctatattggtttcttttcttttacagtgtgtgtgtgtgtgtgtgtgtatctgtgtctgtgtctgtatatggacaaactcacgcaggtgatcctgggtggtgaatcaatgcctttatatacactacaccagtgttcttctactgacctgtatatctagccctatgacgctttctttaagtaaaaatggtgggtgggggggccctagggtgcattggttagcacagcacatgcgtggaggtcagagaacaaaggagcactttgtgaggtcatttctcttcatttttgtgtggcattcagggattgaaacctgttctcctgacttcccaacacatacacagacacatactttttcaaaatagtttcgtgaagtatggtttttaaataaactgaagaatttaaatattcattaagtttttttttcttgcagatttataatgaaaaagaattattacaaggaaaattagatcttcttagtgataccaatatggtggactttgctatggatgtttacaaaaacctttattctgatgatatccctcatggtaagtttgtttttcattttttattggttattttatttattgatattttaaatgtcatctcccttccccagtttcccctcccataaacccccatcccctccccctgcctctatgagggtgctccccaacctgtccacccactctgcctcggcacccctgcattcccctaccctagggcatcaagcctccacaggaccaagggcgctcccctctcattgttgccagataaagcagtcctctactacatatccagctggagccatgggttacacataccacctgccatgtgtactctttggttagtggtttagtctgtgggagctttggagtgggtctcgttggttgatactgttgttcttcctatggggttgcaaaccccttcagtccttgccctaacttctccattggggtccctgtgctaagtcagatgatttgctgcgtgcatcctcatctgtattggtcaggctctggcagagcctctctctcagggacagctataccagggtcctgtcaacaagtgcttcttggcaacagcagtggtgtctgggtatggtgtctgctgatgggatgaatccctaagtggggcactcttctggatggcccctttctttcagtctgtgttccactctttgtccctgcacttccttttgacaggagaaattctggattaatatttttgaggtgggtgggtggtcccatcacctcatggtaagttttattgttagaactaaaacttgacagtagctgaaaatttatgttttatgatacgtggaagaactgtagccaaagacatttagtgcttgtgttcttaaagtcattggatgaaaaggcataggaaggttacaaggatgctaaggggtgttttcttcctgtgaaagatctgaatggactttaaacatgttgatcagatagatatcttcagatcatagtgtgtgccatcaaagtggtactctatgtaaaagttgtattaaattctgtcaaagttgtattctataggctgtcggcttaggattttctgacgctgctgcaattttttggtctcaatgagacttctcaaggtgtggtcactaaaactagcatcatgaattagcttggaagaattccttagaaacacagattttacacatagtccagaagtgtttgattaggaatggctgaggccctgaagtaaagttggggaactattaggagagtggtttccaaactagtttcgtacaggagataattgttgacaatgaaaagaacagaaaactggtccctgaagtattacaagctgggtgtggtggtacccacctctaatcccaataccctggaggcataggcaggtgatttttctgagattaaagatagcctgatctacttatcaagttccaaacctgccacagttatgtagtgccttgcctcaaaaaatactatagcttccacctcacccccgccgcacctccccctgtgcatggaacaaattctggctacagcagagtgttctttgtttaaaattgctatttttcagtatttgataacaggttcctcccatccagcaaccccccttttttggatatgagcttggaaggttttctggggttttttgattattaacatatgtcttaagcacagaggtttatagagaaatgtgtagggaaagaaaagggcagcctatgttatgccagaggtggctcatagagtaaagcgttggctgcggacgccttataacctggatttgctccctggagcctccagtagaagagagaaccaacaccagtgctcaaagatactccccatcagtcacccagagagtagctacatttaacattcagtttggaataaaagcagtgaccatgtgtggagaaagaagcactgctctaggttaagagggctatgtaatgcagacattgttgaagtcaattagcctttttaaatttgtacgcagcaactatttaacgttattttgtgatgcaagtaaagggttttttttttcctggatttttgtatttttttaattatgtgtatgaatgttggcctgcctgtatgtttgtacaccgtgtgtgtgcctggagccttaaaaggctagaagagggctgaaagggtttgcagccccataggaggaacaatatgaactaaccagaccccccagagctcccagggactaaaccaccaaccaaagagtacacatggtggactcatggctccagctgcctatgtagcagaggatggcctagtcagtcatcaatgggtggaaaagctcttggtcctgggacggctctgtgccccagtgtaggggaatgccaggaccaagaagcaggagtgggtgggttggtgagcaaggggaggggctggagattttcagaggggaaaccaggaaaggggataacatttgaaatgtaaataaagaaaataatctaagaaaaacagaaaaaaatctgaggtattgtgctaatagatattgtgtagattttatctttattttgatggtggtatagtaaataggatctatggaatttagtttgtgaaattagtttgtttatagtaaaaaaaggtcttgactagattaaaattataggctacatagtaataatataaaaaccccttagtgtagtgactgcacaaaaattctagggtagtagtagttgaataggaacaaataggagacttgaaatgaaagtcagatcacaagggacatttcctgcctattttcagcaccacccacccctgctcttcatagtaggtgttgttttcctctcctcagtaggtggatgcgtcccttttcctttatgtgcctttgtggctctagcaaaaggaaattgtgaatttgaagaagttgttgagttggtggttcctggcatgtgaattgaaagtatgaggaataaataagtgtgtatatttgaattaatgaaaacttctctagacagtctcatggaatcgtgtggtttaactttctagtactcatgtttttcattagctttgagagaaaaaagaaccacagttgttgcgcagctgaaacagctccaggcagaaacagaaccaattgtgaagatgtttgaagatccagaaactacaaggcagatgcagtcaaccaggtaacctgctaatttgaagtcttgttctctttgttggcctaatgtaacagttaaactcatagtctagagtaacattcatgacagtaagtgatggtttcactctttatcttttgaggggtggaattccctaacaatgaatgttaagacttacttttgtatgtgagtgtttttgtttatgtgcacgtatacaagtctattgtacttgaagctcagaagacggggtcagatcccttggtactggagttagaagtagttgtgaaccaccaaataggtgctcttagcatctaagccgcctctctagtccgagtattaattcttgaaaagaagctttcaaaccaattattcatacctgccatggcagcaccatattctctgccccttctaatgagacatttggcagtatctggagattttgaatggtgaaatttgagagggaagtatagagtcggtgtagaagaactaaacatcctgtgcacagggcgcctttccctgtttccagtggatgcctaggatgcttggggtgctttctgaaggagaaacttcccataccacattctcttgtatcctctcaatgtctgtagcatcccagctaagattattttatttctaatttcttttcgctagaaacagactttcttgtttggtttcaaaataagatatgttgccttaaccttatttaatgcgtatgagctttaggagttactagaaatatttaaaagtaaagtactaaagtagagtgctgctgttgggatatgacttagctaacctacaggtgcattcacttcagaattggtagttactgtgccatgctgtaagtttctagaatgtgttcaagtcaaaattgtaagacattgtgacttgggaaagcattacctgacatccctagaaaagctgcagacctgtacctacatgctatggtattttgaatagaaatggcccccataaactcttgtgtttgaatgcttggctcagagggtggcactattaggaggtgtggccttgttgaaggaaatgtgtcactggagactggctgtgaggtcttgtatgctcaagctaggcctcctgtggcattcacttttgcctgtggatcaaaatgtagaactctcagctccttcgctagcactgtgtctgatatgtttcctaccatgatgataatgaactaaatttttgaaactaagccagccccaattaaatatttataagcactgtatggttatggtgtctcttcagcaataaaactataagatatgtgccatattatactatatgcatgtgcagaaatacatacagatacacagataaaaagttgtgttctaaggagaaagccatctttctgtttgaatatacatatatctccactagactatttgtttacttatagtgttaaaaagcttagttatagctcttctgccctcgtatcagtatctagaaagtgaaagttgaaataatccagatgttagactagaacagacattttaggacatggtaaggcactaaaagattggaagcggggtctgaagagatgccttggctgctgcagagggctagagtttgatttccaacccaattcaggtgactcgcaactgcccttaagtccagctgtagggccctatgcctctggcctctgtacatacctgcaacaatgtgtatagtactcacacaggcacacagacacataattaaaaataatagaaataaatcataaaagattggagatgatgaaattagggtaagagtagaaggcacgtatggcgtgtttaccatagagtagagcagtgcctttcttaaggtaacaggtgctgcgctgattgtttgtcagcttgacacaaaccagaccagtctggaaaaggggaacctcaggaattgcttccatcagattggcctgtaggcaagtttgtaaggcattttcttgattagtgatttctgtggggcccagcccaagtggtggtaggagtaggggggcagtgtcagccctgggcaggttgtcctgagttgtataagaaagcaaactgagtaaggcattggggagcaagccagtaagtgacatttttcagtggcctttgcatcagcttgggcctccaggttcttgccttgaattcgtgccctgactcccctcggtgatggactgtgactgggaagtgtaagtccagggaacgctttcctccacaagctgctttgtttgagaatgttgagtcacaacactgaaaaaactaaggcagaaactaggttgaaaacaaatgagggggttaagtgttgcaaagtcataatctaccaatctccttacattttagagtatttgaactatttggtagtatttgtatttcatagacattctagaaacagccggaagacagtggaagttggaactttgtgcacatttcgtattcagtaatttaatgtttgggggcccctccgagttaggttgtcagtgaagttatgcttccaaagcatgcctcagggcactgcatattcccacatgaagaagcctaagaaggccctttcccttttgagaacgtgaaaatcagcatcttgccttcccctcagtgttcctgctgtacttgtctcttacgagttcattaggatcttgagttaatgcaaaactaacttaggaaagttaagttgggctatttggtagcttgatagggttagtaattgcgtgcagtgtgtaaaccttgtgacgggcatcttctaaatttggtcttaagtcagagcttaggaaatgtgaaagaaaattcaagtttgtattaaccttatatcaaaatttgacatgtgctatttgttttattctacaagttatatttctgcttaagtattaagagatttaaagtgacttaggatgataacttagaagatagagctgcacattttgtgttctgcagtgaataaagcataataacactcacttttccaatattaagggatggcaggatgttatttgactacctggcagacaaacatggggtaagttgtttttgttgttgttgttgttttttttaaacattaaaaaatggttatgttctgaaaagttcattagagactaatgctgtgcataaatagtttggcataagaatataattcttagattaacttaactaaatacaactggtatggttttaaatgtagtttttttgttttttttttaaacctcagccgtgatatctcataatcctcttttgatagtaaatccccacagtgcttgtcagtttgtgaatcatataacagtagctcatgttagcggcaacagaagaccaaaacctagagaaggtgggggggnnnnnnnnnnnnnnnnnnnntttgagaacaggatattgctttgtagggcaaactgtctccaaatttgtggtgctcctgctgcctgctttctggctttagggttatatgcatgtttctaactcacgatttttttccatgtgggtctacttaaataagtgaaggcgaactagaaattgagttaaattttctctttttacagtagagaacattttggctaccttagggaatgcagtagcccttcacattttcatagctttcattaattttcaaatttataagtaaatgttacttacttttttgtacacatctttgatttctcttttgttagcatagagaatttcacattgtatataatcaaacttaacttttaagtcttagcacccacttaataattatgtagatggcttgctgaccagcacataatactctgtggtttgctacataatatttagtagtttgttgtttgaagtcttaagttttttttagatttcttcagtttgattttatttacatattaattctcaaagttgatataattttgaggctaattttcataaaagagaggtttattgtatgtgttctttgtgtaagaccacaaaaaaccttggaggtgtatgtgtgcgtggtagttgactagattagtcaacttagtagacttagagcagacttcagttacagtccaagcttgtttggtagtcaaattgctatcagcacacttcagaactcttgagatcaaaactaagcattaaattgacagttccacgtgtgtgtatgtgcacatacacagtcatacatatatacaatcaagtgttatggtattattggtgataattgttgggagactttaaaagaattgacttgttcactcatctagaagagttaaatgaacagaattatataacttaactgtagaaggttttttttccctccagtttaggcaagagtacttagatacactctacagatacgcaaaattccagtatgagtgtggaaattactctggagctgcagagtatctttacttctttagagttttggtaagtacctgtttgttgtttatttatttggtttccttttcctcttaccttctacttccagaactttgatttgagtctgtctattaaattttacaacagtcatttgcaaaggagaaaagtaatttaggttaaaaaaaactaggggcagtggctttgcaacaaaagccaaataggataccttgttaagggcctcaaaatgtattgagagggctgtgaagtggaacagagtcacatactcatacagcacaaacctggcaaccagtttgatcctcagaaaccacttcagggtgcagagaaccaactctacaaagttgtcctctgagttccgcacttaggctacggcagcctgcatccatgcacaaaagtgtttttaaatacaacttaaaaacaaatttagaaagactttaatttgaccttgaaatccaaaaataggaagctattaatttataattatatgaattgtagtattagcagaattctgtcttataatggatttttgtggtgccgtaagcagaatgagtgactatagtttagtgcatgttcctagttctgaacaactggaatcctgttttaagatgctatattttaatactgacctaatttatatttacccacattcccattaatagaaagtgaggagaagtgaggtgtggagacactccagccgtgttactaactggcagtgcaggcttttgggtcactgtctggatttggtacttttacggagtggagagaaaggtgtatgaagtctgattgaaactcaggccttcaacttaacaacttttcttgttctgtcttctttctaggtaattacagtagtaggtactttctaaagtaatcaaaaggctcttacctagccttttatctgagaagttataatttattactcactggattgatgaacaagttcgcaaagccagtggtttgtctactttatcctagaagttaaagtctggttaagacagggactttctgtcttccaatcttacatttctttattttctgttgctttttttcctttagttttctatgtcacaaagaaaaccacttggaccatgttgtttttggtgccttcagtgaaattcagcttacctgtttggggtagttcaaagggcggatcgatgttactcatctcctacactaaaattgcacagggaactttttaatactacccaccatccttccttcaaggaaacagatgttttctctttattcctaagctagatttaaaacattatttttcttttcccctcatttgcaatgagtttttcacttatggataagctgtgatttgcttgccagtgcactgaaggtaatcattgatgttaaacttggagtgacttatcagaaaattccatcgcttttaccttgaatgttaccagagatttaggagagcaaaagttgattactttgagaatataaacagcttaagctaggattgtaaagccagaagcctggtatgattacaggtacatgaaaagagccggttattcatatcatttgttactgctgggagtgaattttgagaatgaagatttagtgtcatgttagagtcccagcacagtaaatttattgttgctggtcagtgagtgaacgtgccattttcctaagacatggaaacttaaggtaactgctggaaatccagatattgaaacttctagtatatccacgcttgaaagcaggttgctatgaagagccaactgtaatgacatggagttcagccagggtagtgcacgtgaaccttttgggggttacaaaccttcctaagctttacaaaaagcttttatctgaccacgtattgcatattctagttttatgagtatcgtagttatgtagtatggctttataattagtctaaaaatttctacaataaatgtatcttataattgggagttttaatatttactttgaaaagttacgacatgtattactctgtctttaaaaacattcaattctatgctgtttcactattcctaagatgtcctatattggaattcaaataataaaatttcttaaaatttatgtagtattcattaaaaaattgtctcattttataccataaaagatttgagctatgtagaagctgttttcttttggcatattgttacttagtgcaaagaaaagaagactagatgttaattatattttcttgatttagatacagccattaaaaatctcaggtgtttaaaagtttagtagcaaaaatgaaaatcttggttttgattttgatgaaaatgacatgttttagtttagttatttgtgttttttccatttctagatttttttttttctggcggttggtttctcttttaaatctatggttaaggaaacataagctatgaaagagccattgtaactatgggctgagattagaatttgactctccaaatgacctattgtaggtcagtgtttataaattaaagctgtgtgaccctagatttattttttaaagacttggtggcttttcgaatatgttgaggaatgtccgtttggatgtgagacttctttgcactttgctccaaaagtatgttaattaaaatgaaataaggagaattggtagaaacgtttgaatagcttttgttttaaaagttgtactgaatttttattaaagatctgtcctcactatagaacccttggtttatctctaaaatgtgaccattaaggaactattgaagtaaaagtgatttttaaattaccatttcttactatatttttttaaagtttttttttctcccagttagaattgaagatgtattgactgtcaatggcatattagaacctttaacagcactttccatcatgcacagacaccttgggtaatggtgactttagcatcttggccacagttttggctctgatatgcctattggctgtcagtttaaagggtatctcgtttatattgagtcccaagcatggcttatacttcactgtctctaattgaaatatatattgagtcagttgttttttagttctaggtagacaaagtaagtgtattaaatttgatagcatattagacttaatgaagtttgtgtgtcaggtggggtaggtgtttgcacttaggattggtgcatgtatatgcaaagtaatgatggattccctcgaccactctgtgcattattcctttgagacagtctttagcagtacctggtattactctaacacgtaatccccactcccagcactgtggatgtaggtagttgtgcatatttaagtgtggatcatattgtaggtatacttcatgataaaaattggaacaagtagcttcttgctcatttttcaaaatttaatttatagatattatttctattatttgactgctctgagagcttgctaaatgctttccaaaacatttgtgaaaattactgcaaatgataataataattatgtcaaagtgctgtatcacttcagtaacctcacatttactgagatcttagcacgtgttgggtaatatactttttgtcatgttgaagccatgcggaggcaaacacaggtggctttgccgcctgtggtagcagtggcagaggcgaacacttggctggctttctaatcatactgtacagttagattttaatatataatacacattacagatacattctgttgtataaatgctttggtgaaagtgaattcagaatttcattttggagtcaggaattttcattttcattcctattttcttctcagataccctcccttgcttttgctgctttgacacatggtttttttcagattcattttatgtgttcccattggtgtgctgtaaaggaatgttctttagcagtttttgtcattagtttggtagttacttacaactttgaatggaatttgtcagtaacttcttttataaaccagtaggcctgtattatacattttctttcctgtcatatttttgtattatttcttttcttgagtcaggtctgttaagtggtccaggctgtcctcaagcttgtgatctcatctcagctttcctagtgctgagatagcaatgtgctcctgggccctctttgaagtacttttttttttttttaggtattttcctcatttacatttccaatgctatcccaaaagtcccccataccctctgtaactccttccatgggtgttttgttcccaattctaagaaggggcaaagtgtccacactttggtcttcgttcttcttgagtttcatgcgtttagcaaattgtacctaatatcttgggtatcctaagtacttttagtgtctgttttatctcattttgttgcgaatgagatttaggagctttggtttcttactccttcagttcattaacattagcttcctttgactctaaagtgatgcgtaaagtagtcacgggtatacggaatttgattgcatatgtattatctgaaatagattatgctaaagtgatgctgctgtttgctagctttaaaatcgcctttactttatagtaaagacctgatattaaaagcctaagtatttttaaatacgttattttgagtaatttactattgtgtttcaataaggcctgaaaataatgagtttgtagtagagatataacttggatatgtctttaggtaggctagatggatggcataaaatgtacctttgttcttattgtataatattgaggctattactaattattcatataggtcccagcaacagatagaaatgctttaagttcgctctggggaaaactggcctctgaaatcttaatgcagaattgggatgcagccatggaagaccttactcgattaaaagaaaccatagacaataatgtaagttacatgtttagattgagtctctgaaatttctttgcacttgttatattttctgatatggaacaacactgcacaatataagagggggaaaataaaaatcatattttgaatttttttttttatgtttgtggttctgccctgactgaacactcacttggtggataacttcccctaaccttgaggtggtcacacttggtttgactcttgtagctaccgtggcactgaaaatgatactgccctgtcagtgcctcctactgcagaaagttattgcagaagacgggttttacccagttagtgtcaccctcccacccactaattaaggactgtttgcttctgtccttgcttttaaaacatctttggatgggttcaagcctttatcataaaatatggttagtatcgccttagagtagagccttgtagttagttacacttctgaaattggtgtttgtttgcatgtctgtttttcatatactaatatttcctctgtgtaattttcttaatcctccagtctgtgagttctccactccagtctcttcagcagcgaacatggctcattcattggtctctatttgtttttttcaaccatccaaagggccgtgataacattattgatctcttcctttaccaaccacagtaagttacatcattgtttaattttacttttgatatatgatttttatgtggtacgtgtgtgtgtgcgcgtgtgtgcgcgtgtgcgcgcacatgtgcttgtgtttgttaattggaaagctttatgtgtagctgttactgtaggtccttccgaattgttcttaagaatggtctctgaactaacaatatagatatcatgtagactcagggcttaccgtagaggattaagtcagtttgcattgaattctcagggttctccgttatctagtacaaagccagtcttcatttctatgggttacacatttgtgagagaaaaattccatcattactgaatatgtaaagatattttattcttgtaatcattctataaataatacagtagtaactgcaaacaaatctatatattacatattacaagtaattagagattaagttatacaggagtgtatgcaaacaatatcttactttttataaaggactttgatagccatagattttgacatttggaaccagtcatctgtcaatacagagggatgattgtaaattcaagtgtaaggaataaaggaataaaggcctatgctaaattattggaaaggaaaaaaggagaggtgggtgattatattatgggaaaatcttttttgtattgacttgctgtcttcagcttttggtttgtacttgggttgataagaaatgggcacactgctcagtgaattttgtgaatgacaccattctgttggccagaattaattttattttttatttattttttaaaagttctccctatgttactgaagtttttttatgtacctcagtcttacctaaaatttgatcatctttcttcaaatcatggatataccaccacactcagcaaatctttaatttcaaatctttcagatattaggatatgtgtttgtatatatgtgtgtgtatgtgtgtgtgtatcacatgtgtacatattcatgttacaacaaataaagagatagattgtgactataaggcacaatagaaatgaattgatttaaaatgtgtaacattgaatttgtagtatggctatgctagtaggtatatcttcatcaccagactacaaccactaaatattctcaactggttggagaacaactagaagaaagttaagaaatttaaaacattacatcacatcagagtttgctcacaaagactaatggaagtgatatttcaacagtttccctttagttgttttattaacaaggagaagtcatccatcagccgggattcggttgtgtttttatttcaacagaaaagatacacaaccagaacaagtgaacttgttggatgctaggatgctttgatagctcaggtcagggctctggtgacttgcttaggagaaggtagatgtcttctaagttatggctgtccttaggctactactgtcgtcacatgctgcatgatattaaatttcacttgtgcagtctaatattcagtctgaaatttcaaagtgaaacagtgctttcatgtaaaatttatgtttcagtaaagtcatttagatgacagcatggtatgaatcagaacttgcagctttgtacattttccgttctgtcaaaagttaaaacaagaagcagacgttcctagctgcaggaatttgtgacagatacttttaagtcacattgcagttctaggatgttgcagtcctcactgcacgcacaaaggaaagtcccatgcctctaaattcattcaacccagttccattgaaagtgatgctgtaatgtcgtcacatgcaatctaaagaccatttaactgaattgtgtaagcaataaagtgctcccatatgcttgtcaattgatgacaatatttagttaaaagaatctatgcaagaaaactgagtttaagaaactgattataaagaccttccaacatctatggagcaatgataagtgacttcctaggctcctgacgtgagttttctagctcactcctaattggcaatagtgatggtactgttgttgagtttcttgtcatcggattctgctgattttacaggttgttattctctcgtactacttaaatgtaattcttaaatgcttacactcttaggctaaacgatgttagatgttttctttagttcacactgaactatatacatgaaaaattgtgggaatttagtgaatattaagtaactgttgtatttttaccttaggtatcttaatgcaattcagacaatgtgtccacatattctacgctatttgactactgccgtcataaccaacaaagatgtgcggaaacgccggcaggtgctgaaagatctggtgaaagtgattcaacaggtaaaaataaacttaaagcagtcagacagtaggtgtgatctctaaatgctggggtaggtcttaggggaaaataagtaaggtgagagggaagtctacatgaaactagagagaaattagcaagccctgagcttacttttgcaaaatcataggtgtccttatgaccaatatggtatgagtgattagtgcttggtggagctgcttgttgatgggttgtggagttgctgcctgttccagatggtgaccattatcttaatgtggcaaaagcccctgcagtttggcttatggagcttctcacttgtaaataaaacaaaacaccgaaaaagcccaagaaatcagatgtaatctaagaatgcatttataatttggacatgtgacaaacttaatgtgttatctgaggtaagggttcgattgggtgctttgagaagatgatattggattagctgtgagttggcattatgttaaacagtgcttaacaagatctaactggacatttggattacttttttaggagtcttacacatataaagacccaattacagaatttgttgaatgcctatatgttaactttgattttgacggggctcagaaaaagctgagagaatgtgaatcagtaagtatgaatttttactaagcaatttatattcttaaatttcaagatgtagtaaagtattgaagtaattgaataagaaaaaataaactaaatggtatattattgacagaatgaagacacctagttggtattgtctcctttaggttacagaaattaaaacatcagctatctgaattcatctgattctccttaattctgtttctctaatctggttcatatgtacatgcataccacaaatgtggtccccttatttatagatggaattacttgtagaaaagattaaatttaacatttcatataaactaagcaatttattacagttatgtttttatacctaaattttcctatttagttaaaaataaagttctttcagagcaagtctggaattcgatatgtaaaccaagcagtcagtggatttatggagatacatgcgcctgctctgtctcccaagggctggtgtgagaggcctgtaccatcacgctctgatgctggtttttggttttgtttaatttttaaagaagtttcctgttttttagtggatgtaggcacacatgtggaagtcaggacaactgtgcggaatctttgttgttgttttcctgttacatggcttccagaggtttaattctgtgttaggcttgcatgctgtgtgctttatccactgagccatctccagccatgccacaactatttgtttatttatttgctcatattcccaacatattaggggttaggcgagggtgtgtacacagtttgctgtttatcttaaggtgatcctaggctcacgatcactataccttaggtttctgagtggagagactgaaagtgcaatcccatcctcagatagttttgtcttttaaaatcaagttacaggaacagaattcccagtttagctaagagcttgtttctcttaaagaaaaaaatgtaaattgttttttaattagtcaaaataggaaactaaaatcttccttgatagtttgtgtcattataaccatatgaacattacacattacatatacattccttttaaaataatctcttaattattactgtctttgacataggagctgttcattgcaatgtttcctaaccctgtcttgttatagaaagttcattcccttagttcattctttatttttaagttagctagagcatgttgtaccaaaaaaaatgtatcatggaagttactctgttaacctcaatcatcaataaaacaaggagacattggtaattcctggagtttttatttttttcctgttattctttatttgttttaattatttcggatttggacgtgagcaacattctaaagagtactatgttgtaggatttttttaagatagtgagtaaagcaatgaagtagacaaagtgagtcaagtgtttaagaacagttgtcatttgattgatttttgaatatatgctgtgtatctaggtgctcgtgaatgacttcttcctggtagcgtgtctggaggacttcattgagaatgcccgtctcttcatatttgagacgttttgtcgtatccaccagtgtatcagcattaagtaagagcacacagattgcatgtatattttctacctttagtctctacagattgccatttattataatgttacatgtaatgaaatttcagttaattctatttatttctcttttgaaagaaaataatttgctaataatttatgaaatttttaacatgtttgaatttttagaaatgtttagtccttatttggcagaatatagttttctggaaatgacaagttgaagcctttttcagcttattttcagttaccttttttaagaataaacagtgttgtttcattatgaacggataggtaaaatggttttcaacagggtcaaatgacttagcccttagcaattggaaatgttgttgaaagaccactacatttggtaataattttgttaattaagtttgtttattaaattacatatttaaattcttatatagtaagcttctgtgacatcctaaaatgttgaaacatggaaagcttgtggtgaattttagttgaaagtttctctgttgtgtgagaaaataattagaaaaattgtgaaatgtacgtgagctattagaaactaatttcatgtattaaactttcaaaaattattagtgtcttttggcctcagatgaagtcaaatataaaacataaaaacttggtacttttaatctttgcctctgaggaattgtatgcagaccaaattctgtttcttaagccatttggttttggtaggagatccatccatacttgcctaattttagtgaattgttcttgaagtggttgtccagagttggaagtggagtgtgatcagtgggcttttcttatgggaattaggactttgttgtagtttgcaggcattctttttaaaattgattctcttcttattctttcttgtgcaattgattgtgtgattaaaaaggacaggcagatcgcacattagatggcagtacctggtcttgattgttctttgtttttaaaatttgtgtttgaggcttttctgtgagaaaggagtgttgagtatttggttttctccttttcctcgtgggctatggtcgcctgtgtgcttctggttttctccatttccctcgtgggctatggtcgcctgtgtgtttagggttgaccagaacttttttagttctcccttgtttttgaaagcaaatttaatctttgtaagtgctaatctttgtaagtaaataaatgtatttctgaacaggtcaggtcacatggcttcttttcattttacttactaaggtacctgggttaggagttggtgctaattccagctctttatctttattaatgggtacttgagttcattattatgtttcttaagttttgagtttactgtgtttgtcagtaaaatggactaagtatttatcatgtctactcttgtaaaatgtgtagttggtaaaggtaatagactaggaatacctcagtgaatgttgatgttatatctgtgtttggttggcttgctttttgttactatccaggatccagaccaggctttctcataattagcggtgggcaagcacctaaccactgacctatgtacaaagctctttcctgtttactgtatatatgtttcctttttcttggatctcttccgttttttgctaggctgtctctaaagcgtcttaaactaaatttctagaggggttccaaagccctgggttctcctagttagttcttgaattgtacttacttgaagttgatcagacttttctttgcctgccttagaaaaattaaaaacactttttttcttttaaggactacatagataattttccttttcaaaatagtaaatgagatcaagcacattgaggttgttgtggagctgtgttttcagatgtaagttttgagcttcaaggactcttagaaaaaacttctaatccaatactgtgcatctataggaaattttaagtcttgtcagttgaataagcctaggaaaacgtagagctttctgtggttctgatggacatgctttgtatcttcattgttttacctgggccactagtaacatgacatgcatttcagggtctagaaccacagctttcaaatgttgagtgtgcatgtgtgtgctggcctgcatgtgaacagtttggagaatatcacatgcagtcttacttatagatgaaattttgtatgcatgcaaattgggcctttttcaggctgttcatatacatttttgatgacactagagacttgtagaaatatgactctgtgtactctcctgttacttagctggaaacttaaaggtttgatgtaatcatggattaccagacttaggctgatgatcctctcatacattgtagtgttccgcactaggaagtgttttgttgggaacagtttacatttttagatataatgcttgtataaattgatgagttaaaatatatcggttgagctgaagagtaaacatgaaatctttgtcagctggtaactgtatcacaaaatctctagggttttttggttttgttttgttttgtttttgacacacacagttgtgatctggacacacatagttgtgatgtgtaacagagctgctgtgccgtgcttgagggctgattattccaaagcacagccagaatggaaaaaaatcataccccatcacttaattttttatccatgtaagttatatctctttagagtaatgaagttatagaccagtaacattctatctttagtatgttgaatatagaaagctttttcatgtgttggaaagctgttttactgaatttgaataatagcaactgaaagtaatatgagatatttatagtaagattttacaaatgcagcagatctctaattcagactccaatgatttataatccatttaaatgaacaacagaactaacctttatctttaacagtacacagggagaaaaagcacttattctgtgatctagttttcaaactttgctgtatattcaagtcatcatgagaagttttatatatatagcaacttaaatagaattggtttttctggcttcacccaaaccttttgaatcaaaacagaaccaacaatatagcttttcaaagaagcattgccagtgttagccagtcaggatcaagtactgaatatcctcacaggaactgaagtgtggaagaagaagcagatactaagtgcacaaatacattcaggtttaaaagttttcactaatgtcttagtgttacttttcttatgctgtgatgaggcaccgtggtggagacaattaagaaaccatttaactggggggcttgctagcatacagtttcagagaatggccatcctgatggcgagcgtggcactaggcagcaaggcatagtgcttaagcagtagctaagagcttccagtttaccctcaggcatgaggcagtgagagcactgggcccagtgctatgccctttgaaaccttaaagcccacccacccctagttacacacattctcccacgaggccacacctcctaatccttccagaagagtcaacagtctaggaacctaacattcaagtatatgctgtggtgcccattctcatttaaactactttagtagatacttggagaaatatggagtcataggaaaaattatatgaatatatattgtatattggaaagcccggagaaataattgagatgaaagttttggtcaatcctaaattctttgtacctgacactagactttctgtaaatggttagtgccacattatctttttctttttcttagtccatgctggcctgctttgactttctaattagtgtatgttcatattctttctaatttcttcctttttttcttttgtgggttgggaagatgtgtgcatttctggcttctttttcattcaaatggatgtatttcagttgctgaatacaatacctttataaggctcattgtttattaaataactttatacttgcgattcaaaacattcattcttaatacactgtctaacataaattatgcaacatctgtcaggaaagatagtgtggtgggggtttaatttaatatagcttactatgttgtgagatatatgtgtctgacatttaaaagctgttgtaaaattgttcttggactagttttcaacaggagataaaacaaagaatggaagcagtattttgaatgcataagataaacatgttggattgtacactaataatttctcagggggataatttgtctatttccaactatttttgcgttgttagcattacaactcagtctgcttcgtttattaaataaaattagaccttaacattttccttaaagttattataaccacataagaatttatatttaaaatcacatttattgggaataaagaaatatagttaatagatagtagtttcagaggccattatcctctcatttctgtgttagttttaatataaggttatatgtttcagttgttacattcagcatttagtgtttctgagcttgctgtgtctgccggctctcacagttaacagtagcttctatttagccgattcctttagttagttctcatagcatactcttagagatacacaggccttctctttccatgtattggctgcagtcttcagtgaaaaccagaccacagatttccatatcgtaacacttactcagtaacattggaaataaattatgcttgtcaactaaaatttggaaaaccaagttatgagatagttattaatatcacatgtgaaatcctggatcaaaatctgcagtaagatggacagaataatgacttgggggtttagaggagagagagagagaggcgagtcgtcaagacctggtattgatgacttgatagataatcaatgtggaatcaataaaacacaacttaggtcactagatcaagctttatatctaaggcttataagtggggccacccgtatggatcaattcaaagaaacaaaacaaaacaaaaaatccggtttgtgctggaagcgtgaacaatcttcttacttaaagcaactgaattgagcgtttgtctttgcttcatgttgacgattctttgcttagtgtacttattaatttttgtttctgtataacaggtaaactagtcaacttaaaagatatatgaagcaatttcagagaaaatattaaggtccttttgaaatgattccagacgcagttaagatttctaatactatgtgaatctataatttctttctgtttagattagaactagcctgaatctttgtatcttcagatattctgtgttttgattcattttacagcattttctagggtgacctaagtcgcctttctctttcaagctttgattagtacttttattttgtttgattgatttttttaaatttttaatattttgaatgggtttattaatatagatactcttttaaaataattttacatttattattctcctcaagagtgaacgagagagcacgtgagtttcaccgtgtgtgcatatgaggtgaaaggagccttctgaatcagaactttcctcccactgtgtgggttcacggattgaactctggttgtcaggtcccgcagcaaggccctatacatgctgagccattttgccaatcagtgtttacatttttttagttttgttcttaaagtgattggtagcttggataacccaaggtgccatcaaataatgtgctagtgcacgattagaactgatttcaagttgactttgactccattctattaagtaaaggatcaagaaacagtggagacagtggggttattatagctcagcccacagatgtttatgcaacgccactgtgtgtagtagtcatgttaggatgtgcatttaaagagaagcaggatgttgattctagttagaattaattaacctccaacaagaccatagctcctaatagtgccactccctaggccaaggatattcaaaccaccacaagcacaaattaggcataaagtgtcattttcttttaaaatctgaaattaggtgtttcctcatgtcaactctaggctagcattgttaaccctgttgggtttctcggattttctaatgatggaggaagaagaggatgaggaacagatggtggtagtagttggggattatatgatacctattccctaaatccttgagagttaatctttgccataagcatcaaagccagttcatgtttcattgaaagagtgatagtgaaggaagagggctgatttgctatggatgttaatatggtattcatgatggaggataataggaagctataaacttctgttgtagctaaaatggaggagccataactggataattaagtttgaatgtttttttgctttttgcattataagataaatattttgtaaagatgtgaaaaagagctaggaaataaactgatcataaggttttagggtgaaagaactgtgtagaatagattaaaggctcaagatacagatcatttgggtaataactggaaaatagttatggagcctgaatcagttcctggcttgaatgggaagggatcagacaattaagtattggtttcttcctttgtgatatacatgatactctttctgtatgcataggaaataagccatctgaaaaaggtacatattatttggcttattgcatacagtctcctttggagacatgtagtcagcaaagcaaagtgattaagagagtcagttagttataaaaacacataatcattggaagatttatcagggtccttttctatttgagcaccatgtaagagacaggtcagtatgtgaggaataggggcagcctgtgcaaagaccctagagatgagagtgtttgaagaacatttagtatgacagctgatgaaaagtgactttcatgatgagacttttggtgagaagctgtggtttaaaaagtaactgaagtaatgaagtaattcattagaagtaatgaagtacttcattagaagtaatgaagtaacacagaagactcaaatatcaaataaccttttgaaacctttggttttaaactgttagtttatttacataacttataaacagtttgcattataagttaaaaatttaatggtgccaactacataattgtctgaaaattgggttctctgcttttaaacagcagaatatgaccagatatagtgacacatgcttgtattctcagtgcttgggatgggggtagacagaggcagtaggctcactccaagtttgaggccagcgagagttaaacagcaaaattctgcttccaaatattaagtaaataagcaaaatgataaaaggttttaaacaagttgtttcagttctgctgagtgagatgttttttaaaagcttgcgtcataagtaacagcttcttcagatatttatttagtgcagaggagttgaaataactgtgaagttaccggaaaggttatttgcaggattttccccattttgaaaacaatgccttttaaggggaggtctctggtataggcctctaatcccaatgactccgggggtggggctggaagattgcaaattcagactctccctgacctaaagaccaaggagtggcaatttaattgtttcagaaagtaccaaacagatttagaatatagcactgtcttagggttttactgctgtgagcagatactatgacaaggacatagtataaggacaatatttaattgaggctggcttgcatattcagagcttcagttcattatcatcaaggcaggagaatggcagcatccaggcaggagtgatggaggaggagctaagagttctacatcttcatctgaaggcagctaggagaagactggcttccaggcagctagcatgagggtcttgaagtacacctccacagtgacacatcctccaccaagaccatacctcctaatagtgccactccctgggcaaggatattcaaaccaccacaagcacaaatgtagagtacttatcaaacttatgcaaggcctgttttcaatcctgttgtagactattttattaatagtcttaatttttacattttgcacagatttttctcttcaacaatgaaaaaggggtatggtagagcgtatgctctttcctaaaagatatttttgattaattgaattggtaacacttgggtgaaagccttatcgctacataactgcttgtatagctgctagtgacttaaatacatttaaaggtgggcatactgttagatccagaatttctgtctatagtatcccaagaaactgttttgttgaggagttgatagtgaacattgctgacttccagtcttattgaaaatattcaaattctctagaccaaatcaatgatattaaagaatgaacagtgtataataattcaggtaaagataaagggcatttaataataatatatgtacactaatgcattcaagtatagtgtgttcttattatcgtgtgcatatgtactctttgtcagttggctgattgacaagtagctgctcaagtcctagccctttacaacctggttgtaagttaggaaaataaaggatgcagatccattgtccaagggcattttccatggtgtcagctagtattgtctctccatccctttcattggcattgttggttacatgtataataactgcaagcaggctccccacccccagagctccatcacaatcataaatagcagccttaagcattttgtcagtgtcataaaactcttctttggagcactcaagatcatgttttcaaaaccacaagttttataaatgcagaatacagtaatttttgtcaaggatctttacagtccagctggtattatgaaggtaatataagacaggcataaacaggaatggtatatattgttaagagtcttgtatgtaagaatacttgatccagaagtagttgaagtctatacaaagtatgagtcacattatgtacaaaacactaagcttttatatctctcattagtatgttagcagataaactgaatatgactccagaagaagctgaaagatggattgtgaatttgattagaaatgcgaggttggatgccaagattgattctaaactagtaagtactatattggtatggtacatgctgtataatagttgctgactatttttataattcaggagaaattttaattggaaattttattctatgaagcttgttttttgatagatacatgatctcactgtgagggctggctaccttggagctcactgtactgaaatattctggccgattgcctcttcgctgggtttatgggcacacacagtacttgtctatgagtctttgttaggctgagcctagtggtgcaggcctgtcatctcccctactttactttaggctctgaggcaggaggattgcatgtttaaggacatcctggacaaattaacaaaatactgtgtcaaactgcaaaagtaaaaccaggatgtgactgtagctaaaaagttgtttgttctgtgtcagaacccactccagatactgtatcccccaccaaaaaatatttgatgacagttgtttgaatattggtaaataaatattatcatctcaatacagtgtataagtgtgcaacggttatgtggtattgtgttgtgctcatgattactgaggcacaccaagcactgactttactagaataacttttttcatttcagggtcatgtggtaatgggcaacaatgcagtctcgccctaccagcaagtgattgaaaagaccaaaagcctttcttttagaagccaaatgttggccatgaatatcgaaaagaaacttaatcagaacagtagatcagaggtaagaatcaaacagtttctgttctgtctgggatttagcaataatgtacatactattacatgaactttgggaacataatcagtattgtttagcattcattttatatttctgtttaaacttaaaaacatagtgttcaaaaaattactaaactaaaactaagtttgttttagatatattttactcagtagtcaagaaaacaaaaaaaaattacatttctaattataattgggtttagttcttttattcttttgtgaacttcctcaggactctcatcattttgattcttttagatgataatttacatgtgcttgaaatgtgtgttctctttctaaatctaaagcattagttctataaaaagtactgcttttcctgctgatcatacatcaattttaatttttttatatgatgtccataactgtctaaaaatatgcccttctcttttagtagaggttcctcatttttgatgttcaaagaacttgagtgaccttataacttcaaaattccaagtcttctttaattctccttggacactgactgcatgtaactgagggtagaaagtaattagtaactggagtatttaatgactccattgaattaaggtttgaaaaataggttaaattacaattgtattttccaatgaactctagtagagccgtgtgacagtactgaaatattaggggaggaggagacctgtgattggacagggaaaagggagacagggctaagagctgtagagacagagcatctgagagagacaggaaggccaagatggagagggatgtgaaccagcgtggctttaaccagccacaggaagtaatgataccatgaagttagaataattgggataaagcttttatcattatcaattggttttgaaattattgtattgatatcttgtaaactgaatatttattggtacataagtctggttatggttgactactttaagttttaagagttttgattcttccaggtaaatgggtgttgtaatgactgaccatggggtggacggtttttttaatatttcctgctgcagagcttagccttgaaagtatttcatatgatagtttttttttcttgtttgtgtttttcctatatattcagaatacatttgttgattatctttcccatgtttattggttattgttatgctttatcactcttcaaaagatacttgtaccacttccttttctgttagtgttttcagatttcatttcatcttgattctctctgcatgtgttttaggctcccaactgggcaacccaagactctggcttctattaaaggattataaagaaaagaagaaaaaggaataagtgaaagacacagtagccattgtgtataaaggatgacatacatttttagaagcaattaacatgtttgctacaaattttggagaatttgaataaaattggctatgattaattttttattttgcttgaatttccttttgtgcaagtatattttattaactttattttaaaacaattatatattcccaggaagttgctaaagtagtacagaaagatccatatataaaccccatttccttgatactataaaacagaacaaaccagggttttgacattagtacggtacatataaatgtttctttttaaactggtgtagatttgtgtcaactcgtgcttaaggtacagaactaccattaactcacactcgtcaggtgtgtacataatgtaaccactgatctgctcctcatctctgagaattttatcaaaaatggaatttgaattagcctatctggttgacagtttttatatctgcagttgtaatgaacaaaaatattcagacaaaaataaaaaataaatctgtattgaatttaacatataatgaacacaaagacatataggtgagtagtgtactcctttattactaagcaggattccttttgtttgtttaccacatagcatcatgattttggatgtttccagtttggtactattacaagtaaagcattttaaaattttttattagtctttctagttacagagagtaagtggagtgtaggttgaattttataaattcccagaatgttatacacaaagttatctaagtataatttccccactgggtcacattgacatagaatggattagcatgtttgtcttaatgtgcgtattttacttttgctgttgagctgccacacttggtaggtttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgttgagattctaacatagttatattgcatagcccactttaaaagcatggagaactagcaagagcaggatggcgtttctctagaatgccgtatagcatctttttaggccctggagtccttatgttctgttagaactgttcagctgccatacagaaagaaccacagcttatctttgcttaaatgagtgcttatgattaccttgtaatacaattttattctaaaaaatagccaagtgccagaattgaggtttctgactctggtcttgacactggcatttctaaataggagtgcagatgtgatgaaactagggtaagccaaatgctgagggctgaattttgtttgtcctaggaaaataaaggaatatttgtagcacaaaataacagtttttggagaaagctccagaaaatgaacctttatcaagttatcaatagcaaagcgtggttcattataaaggaggatagcaagcacttcttagatgctttcatcaatagcctcaccaagacacattaatagaaaatattttttcacagttactcagtctagcaattagcttatcagatgtgtcctaagtggaaaggatgtagttactgttaactatctctctgttctgggctcaaaccctcagggaaagaaagctaacatttgaacactttaggcaagcctagaaatgtggaaatgcctgtagtgtttctattggtaacaaagcacagtcagtctagtgtgtgtatgttagggtgtagagcagagaacagttctgtcaggttgtggtccggtatcagtggttctcaacctgtgggccatcacccctttggggttagaaggaccgcttcacaggttgtatatcagatatttatttacatgaaaaatcacaacagtagcaaaattacagttacgatgtagagggtcaccataacgaggaatggccttaaagggtcacagcattaggaagactgggaaccactcccacattctttccatttctgttgactaaaggttcattaggaccctggtcagggacagatgtttcaagtgagcccaaaaagcattctgtgtctggctactaatatacattctgtttttcttgaaacatgccaatattagtatcacttggaaaacctaattaatggccatttttgcacattaatagcatctgttcattattaaaatatattcttggactacaagactataaccttatataaaagttacttggctgtggatataaccttaaacctaaccaaaaggtaaagtcttccagtaagatgccaagtcaaaataaattttaatttcatgtctgtgccctttattatgcatttattatttatttattattatttattatgcattctatgcagttgtagctgtttttgcatacacatccaaaacacattaatagaaaatatcccacagtcataacctggatattttcttgtgtatttacattgttttctacttaaaaacgaaatgagtgtgtgctattttaaagtaagagctatacaaatgtttatgtgatgtatatcgaagtgtgtataggtatatgcacaggtcacctgttaagagaaatcaacatctatctaataaccactttcatctgttttgcttaagatataaaaaccttagtacctaaagggttacatttttttcacccctgaaaagtaagcactgctatgacacataaataagtagtttgtttataactggggttgtatcttgagtatttcagtaataaagtttggttttcagtgcttccagtgttaagttgaaatgacacttgctattctgtagcttgtttcactaagctttagttcatagcttcttactggctgtggtattgtttcctcggagattccatcctgtaggaagctctgatcaggaaggcaaactattcaaaacagcttcagcaaagtttctgaaactgagcagattcactaggcctctgccagcctaagcaatttactgagagtcctcttcaaatggaaggaaactgaactgaactgaactgaactgaactacagagaagtctctgagaccagaccagctgcaggtttagaacaaccaagccacctaaaaggatgctccaacctgttgagttgcctgcaagctgtgcagtatgtttcaggttcccagcttgtgtgctgtcaaacatgctagggtgggctttggtgatacagatgtctttgagttgtttctgctcctgtaggtagccactcacccacatttgtgtaagtaaccataaaaactcattgattcatccagtgaactttggtggtatccgtactttggtttgtcttgggatttctatgtggggtgagggtgtgttgcatctccccaggaaaagttttgtcacacaagtgttgataaacaagcttccaacttcttggttatgtggagtttttttttgaacagtttgaatattgtgcttagaccagtggaagctgtgtgtactgtggttattgctatagaagtgattatcttttaataacatctgctttgggtttttttccttttcttgcatttttattttttctctaccccattattttccttgcaccatttaagcagcccagtgttcttagaatggttatcctagaaagtttgacatgcatgtattaacttgtaacttaaaattatctgcactatccaaatacatggaatgttttattgaatgaaactcccatcttattttgacacacaatactcagatgacattgggatttctctaattgacattttttgggttcactaatgtctgaatatgaaaatttttgaagtgattggaattagctgtgattaccaattggaagataacttttgtactgttctcttgttggaaagatcgtctttggatattcaattcccaaatttctgaagtttgtttcctcaaattatctggtgagggcagggtagtgtcattttggttattttttaaaatgtgtcttctggtcctttataggtcttttcatctcatttgctagtaaatatccattgaatctctcattttggtgacttcccataccccatggtcttatttataaagtcttattttatacagctagatgaaggtagtcattgaaatgctggtcaagtgcttttaatgacctatgtaattaggatgaccattctcaagctagctacctggggtttagagtttaactctcaattgcatttgaatgcatttacccactatagacatgcacataataattaaaactacagaaaagtaaaagtgcagactgtttaaagcttacattttgtgtactgaatatgctctgctaccttccttgtctaagctgtcaccagttacttttgtgaatattataacttggctaacattccattgtatttttctagattaaagtctggattcctaaaaacactgttttatgccagccataaccccgctgctttcaaaccattgatgggtgtagattaagaaagcattttaaatcatcctattctctctgtgtgtaggtatcctatgtacatactggtaattgtgcccctaaacgatttttataacctgctgtttggtactgacctactctgcagaagcgttctctctttctgcattaggtgccattcttctgggaatcaggtttgtccttctccagcctcactaaccatgcaaacacttctagtttacatttgactttttctctggaattcagatttcaaagaacaatttccttccgacaaagctggtaaaggctgccttgtgttatcatacttgcaattgcactatttttgttactagttgtttgttccagaataataccttgattgagtctatatttattaggctttagtaaattgcggaattaaaaatgttgattagaaggtttttagaagatctaaaactgaaaactttacttatcaaaaaattggttttcctgtgtaatcttgtgatatggctattctgtttgcctgaagtaagcaccaacatgagtaaatagttgagcctcaataatcaaaggggatagggatataggcaactgtaaagtcctaactgagcatatgcaaggccccaaaatcaacccccaagcctgcaaactgtatatctatttatagatagaaatataattagagcctgctttctacaccataaacagaaagcatcatttagagttacgaaatattgctgttaggtggttttattttttttttttctggggcaggggcaggaggctattacatggagacttgtctcatgacattgtagtttatgcagagttttaaaacatatctttattttgatctttgctcttgggaatggtagaagtaggagtggaaaggtcttcaaagctcttttccttttatctccccagtgttagtggaatagctagacagtgtacacaatctcttagcttccaaattgatggtatgtggatgtatctggcatttcttagcctcctcctgatctgcaagcatgatcactgttgtgctcctaaagtggtagatgtggaaacagagggcaagggtactgttacccttagatatctcccctgtttgctttgaagagcgagtccactgcatgcttctgtgccactaacacaagagctgttcagagctacatcaagacagtagtaaaggccactagtaaaactgaactgtaaagacgagcaataagaaaatagccaaggtcagggccaacctgtccgaatgaaatgtttgaagcctccagtgaaacttaagtcacttcttaagaaactgctgaagttcaattgtttttgtattttccatgcatgaactctgatgcatttttaaatctgagatcaaggaagttctggaaaaactcctaacttactggagaaggagcacaaacactgttattcccattcttcattttctgtaacaaactgttcaacttagaatctgcacaaaggaatactaatgcatcttctattttggttctaaaactgactcctgtattgccttccacttaatctgatgtggttggtagagtgcaggggtggggattgttgagctctctctctctctctctctctctctctctctctctctctttctctctccccctcggtcttgctctcgctctctccccctccctctttctgtgtgtgtgtgtgtgtgtgtgtgtgtgtgtgtgtgtgtgtgtgtgtgttctaagataatatgaattagtgatagaagagaatcaaagccaaaggtgtgcaaatgagcaaaatgtaataggatcaaacacacacacacaaaactatttcatcaggatttacaatgtggaagttctgcaggaataaaatattgagatgcattattttagtgacatttttaagtattacttctaaatggaactataattcttgtaggtgtttacttgtttaccataaacaggtgttattgagaacattaaagcagtctgatgtaaaaatgtcattctctggttttgtctactgagacattagagtttctcatttttctttcatggcaagtgatccacagaaaagaagcacctccttaactgtgactttgtttagttgtcaggtcaggtcagggctgttggtccatctctgcataagccattcgggcatttttcctctcccacacaggcttgcactttgaatcttttccaactgttcctaagtgcttgctgtaggaggccaaggagacttgaaaagattccaaatagattagctttaaatcactatgtttttaaaaaacagcataaatgacaaaccatttaatggccagtcattatcagtgtattcaaaggtcaacacgttggtatttctttttctgctgtccagatggatgcatgcatggatggtgttaagatgctctggattgaaaccagggcctcaggttagtcataaacttttagtcttgggccacagcctccctagtaactggatggcaagtgcactcatccctgctaattagggcaatatattctctgactgacctcaaaatttgcctttcctctgaaacacatgctattctggaactttgtgtatcaagaccttgaactgtgtaggctaaccttgaactcttggtcatcgttttgtctcagacaccacagtgctgggtcacagatgagtaaccatgcatggcagtattggaattattaatttactctgtgtgtgtgtgtgtgtttgtgtgtgtgtgtacgtgcgtatgtgcacgtgtgcatgcatgagagtggattccttccttactgcatacaattccagggatcaaactcaggttatcacacttggtggttaagtgcctttgacccactggaccatcccagcagcctcagtactggaactttgttactatttgcatataaggaaaacaaatctattctgcaaatccattctgctagtgagtcaattaacaaatcctatagagataaagggtagaaggtgaatggttttgttgaatggaaatctctctgtaggttggtgtaaccaagtgccccctgctttaggggatgacattatcagaaagtgttcatgtctaataccaacgtccttactcgggtttttgctaattctttggtaatttgtaggtctcacagattttactaattcatatcaataattcaatgtttattttcacttatttaacatttacctttaatcatttgtattacttaagatcaactttaaataaccttgtgatgcttattggctgtttcctttggatttacatactggtcattagctctttccttgttgggccactgatgagttaaggaactctggagaaaacagttgactgtgagggggaaaattaagtctctgttacttttttttactgacaagagagaaagcaatgaaattttagattcagtatgatttctcaagataaaagccataaagtaaatagatttctttctagagcagttgaaggaaaatgttaaatcaataactgacacaaatactcttccattaatgaatatttgaacaaacattaagaacggcatttttgttttcagctaagtatcctaagaacagtgcaccaacataggactgccactataataacccttgatggtaatacacgctgtactgggagactgagggtgggaggtgtttgaaatcccactctgataatgattcaggtgtagaaaagtaaggcccatgtgtgtattattttaatatttgtttggttctgtgttttagaagtaagaaaatccctttagtttgttcagaagcatttagtcttgagcatttataaaacaacctaagatacttgttaaaactattcatatttaattacagcatttcttcaaagtaaaagtggcaaaggcataaaggtataaaacagtatgtattgtctaccctgcattacgtatttaaattggtagggcttttaatctttaaggttttttattattattactagatatgttctatatttacatttcaaatgttatcccctttcctcatttctcctccgaaaacccccctatactatcctccctccccctgctcactaacccactcactcccactcccgcttacctgtcctggcattcccctacactgatcaagccttcacaggaccaagggccactcttctcattgatatctctctgtcacatatgtggttggagccttgagtccctccatgtgtactatctggttggtggtttagtccctgggagctctaggtggtactggttggttcatatttttgttactcctatggggctacaaaacccttcagctccttgggacctttctcaggctcctccattggggaccttgtgctcagtccaatgaatggctgtgagcgttcacttctgtatttgtcaggcactgacagagcctctcaggagacagctttatcagggtactgttagcaagcacttgtcggcatccacaatagtgtctggtttggtaactatatataggatggatccccaggtggggcagtctctggatggtctttccttcagtctctgctccacattttgtctctgtatctcctcctgtggggattttgaaccctcttctaagaaggaccgaagtatccatactttggttttctttcttcttgagcttcatgtggcctgtgatttgtgtcttgagtgtactgtacttctaggctaatatccacttatcagtgagtacataccatgtgtgttcttttgcaattgggttgcctcactctggatgacattttctagttctgtccatttgcctaagaatttcatgaatttattgtttttagtagctgagtagtactccattgtgtaaatataccacattctctgtatccattcctctgttgaagggcatctgggttctttccagctcctggctattataaggctgctatgaacatagtggaccatgtgtctttattacatgttggagcctcttctgggtatatgccaaggagtggtatagctgcatcctcagatagtactatgttcaattttctgaggaaccaccaaactgatttccagagtgtgtgtatcagcttgcaatccctccagcaatgaatctgggttgtttccagctcctggctattaaaaataaggttgctatgaaaatagtggaccatgtgtccttattacatgttagaacatcttcttaatgtttatatgatatctgcccagtatcttttggctttcatcatttctggtgagaagtctggtgtaattctgatacacctgtctttatatgttacttgacctttttcccttactgcttttaatattctttctttgttttgcacatttggtgttttggttattatatgatgggaggactttcttttctggtccaatctatttggggttctgtaggcttcttatatgttcatgggcatctctttctttaggctatggaagttttcttctataattttgttgacgatatttactggccttttaagttgggagtcttcactctcttctttgcctattatcctgaggtttggtcttctcatggtgtcctggatttcttggatgttttgggttaagaactttgtacattttgcattttctttgactgttttttcaatgttttctatggtatcttctgcccctgagattctctcttctatttcttatattccattggtaatactcgcatctataactcctgatctcttccctaagttttgtatctccagagttgtctccctgtgtaatttctttattgtttctacttccagttttaaatctggatggttttgttcaattccttcacc

SEQ ID NO: 554 - DNA, 1122 bp, Mus musculus
acaagcgctcctttcccccggcaagatggcggagtacgacctgactactcgcatcgcgcattttctggatcggcacctggtctttccgcttcttgagtttctctctgtgaaagagatttataatgaaaaagaattattacaaggaaaattagatcttcttagtgataccaatatggtggactttgctatggatgtttacaaaaacctttattctgatgatatccctcatgctttgagagaaaaaagaaccacagttgttgcgcagctgaaacagctccaggcagaaacagaaccaattgtgaagatgtttgaagatccagaaactacaaggcagatgcagtcaaccaggtatcttaatgcaattcagacaatgtgtccacatattctacgctatttgactactgccgtcataaccaacaaagatgtgcggaaacgccggcaggtgctgaaagatctggtgaaagtgattcaacaggagtcttacacatataaagacccaattacagaatttgttgaatgcctatatgttaactttgattttgacggggctcagaaaaagctgagagaatgtgaatcagtgctcgtgaatgacttcttcctggtagcgtgtctggaggacttcattgagaatgcccgtctcttcatatttgagacgttttgtcgtatccaccagtgtatcagcattaatatgttagcagataaactgaatatgactccagaagaagctgaaagatggattgtgaatttgattagaaatgcgaggttggatgccaagattgattctaaactaggtcatgtggtaatgggcaacaatgcagtctcgccctaccagcaagtgattgaaaagaccaaaagcctttcttttagaagccaaatgttggccatgaatatcgaaaagaaacttaatcagaacagtagatcagaggctcccaactgggcaacccaagactctggcttctattaaaggattataaagaaaagaagaaaaaggaataagtgaaagacacagtagccattgtgtataaaggatgacatacatttttagaagcaattaacatgtttgctacaaattttggagaatttgaataaaattggctatgattaattttttattttgcttga

SEQ ID NO: 555 - protein, 320 aa, Mus musculus
QALLSPGKMAEYDLTTRIAHFLDRHLVFPLLEFLSVKEIYNEKELLQGKLDLLSDTNMVDFAMDVYKNLYSDDIPHALREKRTTVVAQLKQLQAETEPIVKMFEDPETTRQMQSTRYLNAIQTMCPHILRYLTTAVITNKDVRKRRQVLKDLVKVIQQESYTYKDPITEFVECLYVNFDFDGAQKKLRECESVLVNDFFLVACLEDFIENARLFIFETFCRIHQCISINMLADKLNMTPEEAERWIVNLIRNARLDAKIDSKLGHVVMGNNAVSPYQQVIEKTKSLSFRSQMLAMNIEKKLNQNSRSEAPNWATQDSGFY

SEQ ID NO: 556 - DNA, 66972 bp, Homo sapiens
tatacaggaaaggttatttgattaaaatgttaagactatttagaaatatctgagatatatggaatcagcagatatgaacattctgattgctaaaatatgtgcaccacagtagtggcaggtattcattagactatcccaaaacataagccaatttctttcaagaacacatagttctagatatccaggttttgtgcacattcatttatttctagagcatttacatttattaaatacttttttttttttttttttggagacagagtcttgttctgtcacccaggctggagtgcagtggcacgatctcgggtcctgcaacctccacctcctgggttcaagcgattctcctgcctcagcctcctgagtagctgggactacaggcacatgccaccatgcccagctaatttttgtatttttagtagagacagggtttcaccatgttggccaggctggtctcaaactcctgacctcgtgatttgcccgcttcggcctcccaaagtgctgggattacaggcataagccaccgtgtctggcctactgaataacttttatgtgccaggtactgagatgggaactggaactataataacagatattcatagtcttttgttatgaagatgtttagtaggaggaaacaacaacaacaaaaaaagcaaactaaaatgttataggctttgaggccaggtgccatgggtcacgcctgtaatcctagcactttcagacaccgagtcaggcagatcgcttgagcccaggagtttgagaccagcctgggcaatatggcaaaactccttctctgcaaagaatataaaaattagctgggtatggtggtacgtgcctatagtcccagctactcgggaggctggagtgggaggatcacctgagcccaaggaggcccaggctgcaatgatctgtgattgtgccactgcactccagcctgggcaacagagtgaaactccatctcaaaaaaaaaaaaaagtaataataatgttataggctctgagataaaagtttgttgccagtagagagtggtagaagaagagactgacgactttagataagttttgctaatgggaaatagagaataaaaagatgcttcatccaaatcttaaaatatgacaaggtgatcaacagggtgaggacagaagagcattttagactgaaggagctttattgaagaaacaataaacttggtggcttacttgagcagagcttactgtggaaggggtgtagggttctggagagatgaggtcccgaagaactttatttcatgggctaagaagttttgactttatattacacaaaattggaagtgacagagtatattaaattgctagggccaccataaccaactaccacagactggttgggtttaagaacagaaatttattttatcacaattccggaggctggaagtccaagataaaggtgttgatagggttgtttcttccgaggcctctctttggcttatagatgtccatctctccctgtgttgttacatggtctttactctgtacatatctgtgtcctaatctcctcttcttattaggacatcagttatattggattagagcccaccccaataatctcattttaacttagtcacctctttaaagactctacttccaaatacagctacattctgaggtactggaagttgtgactttgacatatgaacgtggagagaatataattcagcccataaaagggttagatctaatttagataatcaagacagcagtgtggacagaggcaagaccaggacagggagaccctttggaagactattgcagtatttagtttgtatgggtgatgatcccaaggttggtttggttgttgttttatccctgtcatggctgataatctgaatttgaacaagagacacagagggaagcatggcaaaggaagatgtcaaaagggtcaacaggaatatcatgttaaggatcactggcctgcaggatagaattcagactctttggcacagtccacaggcttctgacaatttccctctgatccctcagtgcagcagactcttgtcctgccactcaacacagtgcacgctgtgccctctagccataaaacctcacagtctccaatcacactaggcttttcctcaaggccaagcctgtgtgcctgctctgccctctgcctgaaatattctttctcctcttcttagccagccaaacatctatctattcaagtagaggtagtcaaatgttgccttcttcatgaaactcgaacgttctctggcagcgaggaacttcctcccctagactcccaggagtattctgcctagacactctcatttggtgctatgactagtttacattttacacacttgctactctgactaaattgtaaactccttgtgggctgggactggcttcccttgtttccccatagctcgatattgtgatcaccaaatgggaaagtcttcaataaatatttgataaatgtgtgagaatcaaagtctacacctgttaccacctagacactaccaggtaaagccttgcctgtgctttctctgtgataactctctttaactaaaacactaagaagagattaaagaaagtcagattttccatatttggggctaaatctctcttataaaaagaaacaagatattttacaaaccagcaaggaaaattccaggggaaaagccaggggaatcagcagagtttccaatctgtcaccactttaatccatcttgtaaatcacttccagtttaattttaaaggacaaaacaccactgtcttcatgtctttttctatttaagaatttaacaagtggctccctttgcctatctgatcaaatccaagtttccccatatggttttgaagaccttccatggcctggctctattttactcatcaaatccagtgtctacacaactgtcagaatcacctccctgaaacacagacaggattattcactatcatactcaaaaatacttcaaggctccttatgacctaagataaatctcaaattcctcacattagttttctactctagtaagccctcatttaatgttgtcaataggttcttggaaaccgtgactttaggcaaaactaagtataatgacaccaagttgttgggtttattttcctcatcaatgttataaggaagtgaccttgaatgaaatgacattactagaagacctgctgtactttgtttcgcttaaggctgcagtttccaagaactaccgacaacattaagtggggacttactgtacttggccctggtttttcttgtccaggaattctcccctatagactccaatcatcagctcacttcccgagttgtccttcacagatatttcttacattttcctgtttctgtgcctctacagtgttcaagttgttcctgaaccacctgtactgttgtcttccatatatgtagtacaagttagcagtcttaatacaaaagacttccaatccactaacctttccatctgctctacctccactgataatcaattcctgtttggggttagtcttgaactaacagcaccatctgatatagttaattgctctttgctgcttgggccactctcctttgacttctaggacaccactttctcttcttcctcctcttctttcttccatgaactggccgatccttctttagcttttttatttgatctgagttgtcccaacctctacaggttgaagtatctaagatttaaccctgctaatctcttttctaaacacatgcatactcagatttcatccagttccatggttttcaatttcatcaataggttaaaaagatttaattttctatctccagctctatctcctttcccctgattccagattcatatgttctactgcctaattaatatctctatttggatgtcaaaaaggcatctcaaacatagtatgtccaaaactaaacactttatttccctcttccctaaaacttgcatctgtcatacccttcctcatcttagtaaatggccctcagttcttatagatcttacaatcgtctctgacgcctctctttctcatctaatccattagcaaattttgcattgaaaatacgttcagaattgcactgtgtctacaactctttcactgctaccactttggtccaagccataatcatctcttttttgaagtatttcaatagtatctttactgatctctctgtccctgcacccctaaccctcaaggtggtctttctagagctgattatgtaaactcctctgctcaaaatccttttagtagcttcccatctcatttagaatataaccaaagtcattaccatggcctataaagcattatgacatctggcccaccattgcttctgagtccatctgctaccacagctactcttagtcagctctagcatttctagcctccttgctaattcttggaggactccaagcacacttctgcttcagtatctttatacttaatattccttcaccaggaatgttcttcctctagacagtcacaggctctctcacttccatcaggttacctttcaaattctaccttatatgtccgggtatagtggctcatgcctgtaaccccagcactccggaaggccaaggcaggaggatcatttgaggccaggaatttgagatcagcctgggcaacacaatgagaccctgtctctacaaaattgttttttaaaaaattagccaggcatggtggcacatgcctgtagtcccagctactcaggaggctgaggtgggaggattacttgagtcctggcggttgaggctgcaggtcaagctgataccatgctgctgcattccagcctgagtgacaaagagagaccctgtctcccaaaacaaaacaaaacaaaacaaaaaacaaaaccaaacaaaaaattctaccttataattgaggccttctctaactactttatacaaattagcaacctttccccatcattctctagcctttaccttgagttatttttcttcatatcacttattaccacttaacaaagtatatatttgttaatatgtttttatctatatccttccacttgaatgtaagttttctttagagaatgttgttttctttccttctgtattccctggacctagaatagtgcctagcatgttgtaagcatttagtttaaattgaataaattaataattatcatctataagactgaaagctcctgtggccacggactaacacttattgattatatattcccagtaacacctagcttagtaccttgcatgtggtaaaagttcagaatgtttgtcaaatagaattgcatcttatttctctctgcttctcaaagatgctctctgttcctttttggaaagttttcatactgctacctgcttccttacttcctatgctctacctcacttctgcctcttttcctgtttatattttattacaacttcctgggatttcaggaaacttcaaattacaactgttatttctcaactcttagaggccacacagactatgccccacaatttagcagcttatactaacatgtattctctgcttcatgggcattcatccttgctttcccaacaatactgtaaatggcataatggtagagatcatataatacttccacatcattgaaaacatacaaggtgacatgcattgtaagcaatcgataactatatcaactcatccagaatagtatctccatttgcttactagacatgaccactcagatatttaatagagatctcattttgcctgaaacagaactccttgtttaagtacccatgcatattcctttgccattctaccccatatactggtcaccagaagggactcagtttcttaagcccaaagtgcaggaataaacttcttaattttgaaatagaagattcacatgcagttgtaagatcaacttgtaagcacaggggagatcctatttgctctctacccaattcaccctaatggtaacatcttgcaaaactataatacagtctagcacatcctcaaactattaaacagagatgtaacccagcaattccactcctatacatatacctgagcaaattgaaaacacatgtccacaaaaatacttgtgcacgaatgtttatagtagcattactattattattattattattattattattattttgagacagagtctcgctctgtcacccaggctggagtgcagtggtgcgatctcagctcactgcaacctccacctcccgggttcaagtgattctcctgcctcagcctcccaagtagctgggattataggcgcatgccactacgcctggctaatttttgtatttttagtagagatggggttttgccatgttggccaggctggtcttgaactcctgaattcaagtgatacccccacctcagcctcccaaagtgctgggattactatagtaacattatccttaatagccaaaagatggaaactatataaatttccatttacagatgaatgcgtaaacaataagtggtctataactacaatggagtattatataaatacaatggccataaaaaggaatgaagtactaatacctgctacaacttggatgaatcttgaaatcatcatgtaaagtgaaaaaagtgggacaccaaaggccacatattatacgattccattcatataagcatcttgaatagggaaacctgtaccgataggaagtggttgtttagggctggagtgaggggaatggaaggataggggagttacccttaactaaagggtacaaggcttctttttgaagtgatgaaaatgttctacaattgactgtggtgatgactgcacttatctgtgtatgtctgtggaactgtatactttaaatgggtggactgtttggtatataaattttatctcaataaagctgttgaaaacaaaacataaattacagtacaatagcacaactaggataatgacatagttaagatcctgagcattccattaccacaaaaatccctgctattgccttttatagccacccttacttccctcccacccccacatcctccttaacccttggcagttactaatctagtttccatttccataattttgtcatgtaaaaatattatgtaaataaaataatttaatatgtaacatttgggaactaactttttttttttgaaatggagtcttactttgttgcccaggctggagtacagtggtgagatctcagctcactgcaacctccacctccctggctcaagcaattcccctgcctcagcctcctgagtacctgggattacaggtgcacgccagcatgccctgttaatttttttgtatttttagtacagacggggtttccccatgttggccagactggactcgatctcctgacctcaggcaatccacctgccttagcctcccaaagtgctgggatttcaggcatgagccaccgcgcccggctgggaagtaacttttattcactcagcgtaattccctggaaattcattaaggttgttgtgtgtatagctagtcccctcctttttagctgagtagtatttctagaaattattttgatttttactcttccttatccatcatatccaatccaggagcaagtcttgttggttctaccaccaaagtccatcttagatcttatctcttctctctacttgtatgaatatacttgtctataccaccattagccctcgcccagtctgagaacatcaaactgatcctgctgccttcattcctgccccttcacaattcatttaccacacaatagttagaatacatttcaactaaaaatctttacatcaggccaggtgcagtggctcacacctgtaatcctagcactttgggaggttgaagcgagcggatcatgaggtcaggagatcaagactatcctggccaacatggtgaaaccccgtctgtactaaaaatacaaaaattagctgggcacgtgcctgtagtcccagctactcaggagtctaaggcagaagaatcgcgtgaacccggcaggcagaggttgcagtgacgcgagatcgcaccactgcactccagcctggcaacggagagagattccgtctcaaaataaataaataaataaactttacatcactctccaaaggcctacctccttcttttactcatatacacattcaaaaatatttattgagtgccaactatatactgggcattgtttagactttcgagaagcagttattatatttaaaataatgacaaaatccctgatcttgtggaattaatacaatagtcagggaagaccaaaagtaaataaaataagtaaaatattgtaaaacaaaaaaaataaagcaggaaagcaagatgagaagttcttgtaggcaggttagttacatttttaaatagactggtcagggaaggtctcattgagcagatgacatttgagcaaaatatgaaggagacagggaaagagctatgcagataactgggagaagaacattccgggtagaggtaatagcaaatataacaggacaagatgaaagcaggatgggagtagctgaggaactgaagggaaatctgtgtggttggagtcaagtgagcaagaggggaacatttaggagatgaggtcagagaggtaatgggtccagatgatctactggcttgttaggtcacttataatacctactacatcttttactctaaatgagatagcaagccttggagacctttaagcataatttgacttttaaaacttcactctggctgctttatgaagaataaagcacaggaggaagaggggaagcaaggtgattagtgacgaggtgattcccaaaatcaaagcaggagatagtggtggtgtgcactagagttgaaactttggaggtggtgtgaactgattgggtctgaatatgccgtaaagattagagttaaaaggttttttggtagatttcatgcacagtgtaagagaaaaagtcaatgatgactctaaggttttgagtctggggaactgtacagatggagtggccattcaccgaggtgaagagtgcagctggagcaggtttggtaagctacatggggaaacttggtttgggacaagctcacgttgaaatgctgggtacatttgagtctgggactaatagtcagttttgcggctataatttgggagttgtcaatgtgcagactgcatgcaaaggacgttaccatttagggcattggtctagatggagaagaggtccaagatccctggggctcttcaaaatgaaaaggcctaaaagatgagaagtaactagcaaaggacactgcagagtacttagaaaaaaaccccatattccttaccataatcatgacctgacccttgtcaaactctttaaccttactccccagtacacacaggccattcaatttttgaaacgcacacactaagtcccttcctgtctcatggtcattgtttttgctgtacgttccaacaatcatgtttttaccctggctctagttttaatcacctccttctcttaccacagctctcagctaacttgttactctatcagacttttctctaatttccttaattcctatctgagttttctctaaccatcctaattaaataggtccaacccaaccatctccaccaaattatggctcttactatatctgaaatttgtttcacttattttctgtctaaaaacccaccctcactttaacaatcgcttacaaaatgattagcgtatgccaaatgaaaaagcctagatattcttccctgtatgtaacttcctggaaagcaggggcctcctcatgttgtcctttgccgcatcccaatgcagtcacattgcctcagcaatcaattctgagctttcaatagttattaacggaatagactgcaagccactgactggtaatcgaaggccagcattagaaagaggataccgacaaacctacaaatagagggatctgtttccgtcactcgcgccctaacgcaaagggtgggacaacccgcgcgcatgcgtcgttgtcctctgctctccagggtaaaccccgcccctttctttaggccagttttaccacagcacatgcgcagtacaggatctgtctgttcgtttgtcggcgctaccaataaagttttagtgagcacagactcccttttctttggcaagatggcggagtacgacttgactactcgcatcgcgcactttttggatcggcatctagtctttccgcttcttgaatttctctctgtaaaggaggtgagggggtctttgggcgcaaggaaggcgtgggggcggatgaggtgctgagcaaggccgaaaggtggtgtctgtagtcctaggcctgacacgtgcgaggcggtcgcgagtttggttcctggacggacactaaggatcttctggtagtttagcgtcgtctcagttaagaagcaccgcactattcggcagtgaggaggagggaggttacggagagagaaaagaagtctctttcacttactgaggtgtcagtgcgggagggattttcgcatcatttcttctcggaagttggcgattcgctggtttcgctagagaacgttagagcttcacaggctggcttgtaaaagcaacctggagtgctgttagagcttttgatttttcttttgggaactgtgggaagcctgggcttggctgtgggtttttgcatgtcgagtcttttggagtgattctcttacacttaaaataagtatctagcgctttaatttccatgaagttgtgagttctttgcgttttcttgtcttggttaagtaggactttctagaacagcatatttcgtcagatggggacggcgctcccccgcccccccccccagaaaaaatccctccaatctttaaatgtgttttccagtggatatattgtactgacttcatgtggtttgaattggtcgttaatattcaattatctactcaagatatcatgaataaatgtgtaattctggaacttcattttaaagcatatgtcagtcctaaaagttttattggacttgaaagttttggctaaaagaaaattgacattagttataccgtgagtttattgggaaattgatgcattttaataatgcaaagtaatttgcagtgatgaaggaattcgaattttttcagaaaaataagtgagttctgtttctggaagcagactacaatataagtctacttagggaactctagatttggggagtggattttgtgtagcaaaagacaaaaagcaataaaacaaaaacgtcccaaaaaccagcgtccaggtgttgtggctcgttagacaggtataatcctcatattcatatgcaccttttctaaacatagacaactctaaagttgttgacgttaggtaacggctaagatcattttcagtaaatgtccaagaatgtcttgtcatgtaaaactttctcttgatatatttttgctttgattcttctttttacacctgtattttagaccttgagtaaaacattcgcatctgcattgttttcttttctggaaaagtgaggacaaaagatctagtaaaaatgctatattttgaaagcctttaccagctgcttgtagaagtacttctgaactagctgaactttatatatttttgtgttctttataatttcattttttttatggcacacagaaggaaaggaggaatatgtaaatgtgaattagattttcatagggctagacgaaaactatgaactgcaggcagttgagaatcagtgggaaaaactgcccaatacccacctctttggagaaaatgttggtaagatagctgtaatacaccaagaggaagacagatgctggagtatttaattagcaattgctaagtacatttgactcttggacagtacaggggttaggaacgctgagctctcgcagtcaaaaatccgttataagttttgactcccccaaaacttaatatatcctaatgctgacaggaaggcttactgagaacatggacagtcctgtgttgtatgtgttctatactgtattattacaataaagtaagctagagaaaataaaatggtcttaaattataaggaagagaaaatacatttactttttagtaagtggaagtacatcatcatgaaggtcttcattgtcttcatattgagtaggctgaggaggaggagtaaaaggaggggttggtcttgctgtttcaggggtagcagaggtggaagaagtagaggaagtggatgggaagtcaggaaaggcaggcacacttggtgtaacttttattgaaaaaaagttgtgtatacgtggacctgtgtggttcaaacccttgtcgtccaagggttaattgtatagggccatataactgagaaatccaagataaaacccagacatctcaccactaaacaacttacctatcctttagagttgaatgtttttgatataaggtaaaaataaatgtcgaagaggtaggtactggtagagtgctatcaaaattgagattttgttatcttcagtgagcaaagaggactttgaggaggtgaggctttgagtcttgaaggcaaaatggttagaatagagtcagtgatcctgctatgtgaggatacagcagccccccccccccacacccccttagcagtttcaatttctgcagttccagttactcatggtccaaaaatattaaatggaaaattccagaaattagcaattcgtaagttttaaattgttcgcccttctgggtagtaggatgaaatctgtctcgctctcttgcttaaaactgggacatgaatcatccttttgtccagtgtatccacactgtatatgctaacttaattgttctattttgttattgttcatctcttgttcccagtttataaattaaactttatcataggtatgcatgtataggaaaaaaacagtaaatataggattggggctatctgcagtttcaggcagcagccgctggggggtcttggaacatttagctcatggataaggggagactattacattgcaccaagagaaaaacagtttcatatatttgtagtacattggagaatataagcttcatgagagcagaagcttccttgtgctctcagcacataatatgagtctggcataaaggctttttatgattgtttaataaatgattgaatgaatacatacttgtttctcactcttctttattttcatgtgaagcagaaggccagatagtgaaatatttaggaccctgggctctgaattggacctttcatgactcggtcatttaatacctctgtgcagtcagagcagattcttttaccctcttaaccttttctcatgaataaaatgttaatactaccaccaatctcatcgggttagaaaaattacatgagataatgcatataaaacactacgctcttctgggacagagtgagtactccttaatgttttgtgttttgagacagggtctcgctttgtcacctaagctggagtgcagtggcacaatcttagctcattacagccctgactttctgggctcaagcaattctcccacctcagccccagaagtagctgggactacaggtgtgcgccaccatgtccggctgattttttttgtattttttgtagagatggggtttcaccatgttacccaggctggtctcaaactcctgaactcaagtgatctgccaccttggcctcgcaaagtgctgggattacagacatgagccaccacccttggctctaaatgttttttattttggaagactagcccattctgtattggtatgggatgggaggggggggcagtgagggttttgaggagtaaggtaaggactggaaatggttactaagaaactgatcaaaggaaagtacaaggattggttaagtgtggagggcccaactgagattggaaatcataccttagagctaataatggggtcattctcagggcgaggagcggtagaaggctatgggagtagtatagacatatttaggggtaggcttgtatgtaaatgccatttagagaagcacagatgtgatcgaataacattattccctaattttgaaacattttgtagtcatccttagccagaacctagagaataggtgactttttttccagagttagtgattgacactgaattgtatatagttggagaaattagtttgaaagaatcaatgatagaactgaagagaaaatctttgaaatagctaaaaatgatatccaaactaaggcagaaagtgacatcaaaaagggtattacaaaaattagaaagggcagaaagtctgagatgatgaagattttaatggtaatggtggaaggggttatcagttttaagttggaattcttggagatgaggggttatcagttttaagttggaattcttggagatgagatacatgatgaaaattgtcataatttgaggaataaaggaattttagggctcaagcttttaaagagtcatcagtatggcattatatttgtgttgaatgacagcagaggaagagacagcaaaaaaagattcttaatctgttaaaaagtaatatgttttcaagaggttgatagacgacggatcagcagactatagcctgggaatcagatagcagcctgtttttgtgtggttttggggctaagaatagtttgtaacagaggaacatttgcaaacattagcaattatagaatattaactttataccccaattaagtgaaataatttctcttgaaaaagcattctattcttattaatagacctgtattacaaaaacttttactgttattatttctgtttcaaaatttttaaaaaattgtggaaatttgattctcgtttttcatgtgagtacttatatagtattttcaattgttgcttcttgatacaaagtctgaagtatttgctttctgcttatgaggcagaattgagaggcatatgtagatttgagaacaggacagtaacacctgatggtagaggagcaaggctattgaatctattgtggagagagacgtggcaaattaaaagttactagtggagtggggagaggtagcgtgcttggaaaagaatgtttttatttaagattagtgtttctatagggcaaagtgatgagaagttaaggttttttaggtaaattttttatcagatatgacgttcattcatacaagtacacaaatataaatgtactggtcaatgatacatatttttttcaaaatgaatagcgaatacatttatgtgaccaccactcagattaataaataaaacattacagacatccttttttttttttttttttttttctttttttttgagacagagtcttgctctgtggcccaggctggagtgcagtggcgcaatctcggctcactgcaagttccacctcctgggttcacgtcattctcctgcctcagcctcccgagtagctgggactacaggcgcctaccaccacgcccggctaattttttgtatttttagtagagacagggtttcaccgtgttagccaggatggtctcgatctcctgacctcgtgatccgcctgcctcggcctcccaaagtgctgggattacaggcgtgagccactgcgcctggcgacatccttaaaccttcatcttgacccctgttagtcactactcacaccccctaaaggtaagctgtagtctgatgattcattttgcctgtttttgatttttatataggtggagttaagcatttaccaccatgtactgctttgtatgacatctttcactcagcattgtttgtgagtcatcatgtttttaggatagcagtagtagttcattgatttttcagtgccgaatgttaatctattatgagtatgctgtggtttgttttctcattttaacattgatagacttggctattacaaatagtgctcctgtgtacatttttggaagtgcactttgactatatgcacccatttgttttggatgcctcgaaacaattgctggatcaaaaagtatgtttggctttgggagataaaaatcttacaaagtagttgtattcctgccagaagagaataggttccagttagtctacatccacaccaacactggtattgtcaggattttttaggtttttattgtaatttttagtatgcatttccttatgattaatgacgttgagaaccttttcatgtgtctgttggccatttggttgtcttcttttgcgaagtgcctatcttttagccatttcaattgcaaggtctgtcttgtcttactcatttataggagttctgcatgtaatttggaaggttcgattttgctctcatggctaaataccctttgaccaccttcatctttattttttgcgggcagtgaaatattgtggcattttcttggatttttctttccttgcaaaattaagttcagtacagaaatcttttcttttgctgaagcatttctgtccgtgaatattttgtagaatctttacatattactcagtacacttcatgttgttgtgagtttgtgtatatgtatctatttgctccctgtactataggttaaattatgcttttttggatcctttgcaaagcaaaagcctgatctgacatggttgacttaaaaacttggtgcaggttgtttcagcaatgtggatggagaagcatataggagtttattactgattacctggatgtggagaagtgacagctatatgtgctttacaggaaagatggcgtgggttttatttatacacagccttgcctagaaagggtaagagatggtttgtagggacacataaaaaataaggtcatgtaaatcagaagtaggtgggaatgtctacagtaattctcttcattttaaaatttttaggtaagtaaaatacttttacgtctataggttggttgcttgccatattgcttgccattattacaagaggggaatgttaatagtttatcgtattttataaagtatttcttgaaatatatttccaggtaaattagttttagtattaatcagtttatttggggaacttaaatatattcattagaaagttatcttcttttgcagatatataatgaaaaggaattattacaaggtaaattggaccttcttagtgataccaacatggtagactttgctatggatgtatacaaaaacctttattctgatgatattcctcatggtaagttttgtcattagaactgaagcttgtcttgtgacttgaggatgtgtgtattaaagttttatgatttataagacagctttagccaaaaggcttaattatgatttgaatgttaatgttctttgggtgagaggttatataaaggtttcatatcttccgaaatatattgttttctccctgtgaaagatgtggaactactttaaaatatggtcatcagatgccttcatttcatagtatgtatcatcaaagttgtgcttatgattcacattccttagaattatctgagaatgttgcagttcttgggttgctaactttttcagttagtgcattgtgtgccttagagttttgtgtttttttttttaattttgaggcatctagtgtagacattgttctccaaatatggtccccaggaccagcatcatcagttcacctgggagagcttgttagaaatgcaggtttttggccacacaccagacctacttaatcaaaactgttaagtggtcctcttaagtttgggaaataattctgtgtcatttcttcaatgcacattacatttttaaaggttccaagaattttggcagtagagaaatacagtatactgtgattaaattggcatttctcaaaatttgatcatagatcttctgtgtttcagaaagactgctctagaatatactttctaatatataatacagacattattacattaaacataatccacatgtttgacttgtagttccctgcaataacagtatctcttttttagtttgtcatggataaacaaaaaggaaactatttcttagtttctttcttttttttttgagatggagtctcgctgtgttgcccgggctggagtgcagtggtgcgatctcggctcactgtaagctccgcctcccgggttcacgccattctcctgcctcagcctcccgagtagctgggactacaggtgcccaccaccatgcccagctaatttttgtatttttagtagagacggggtttcaccatattggccaggctggtcttgaactcctgacctcgtgatcagcccgccttggcctcccaagttgctggggttacaggcgtgcgcccttgcccctggcctatttcttagtttcttaatgaaacattaaggtgttaccagagttggttatgtgcaagttttctccaccttttcatagtatagtaaaaggaacgatagaatttggtttgagagattatagagctggatttgtggttaaaagagattatttaatggatttaaattccattcaacctagttgatagcctgtaatagtaatatgtaaatccctctgagtttttcttcaaaaactctgggataatattcacctaagaaaattaaatgagaacaaatataaaaacacttggaaagaagtttctgcaatggagaattaaatgatagataattgggtcctaccctttttttctttcacatccctctgtcaccccaaggctgtgtattctctagtttccctcaagagtaggaagaggattcccttttcctttttgtgcctttgtattagtagaaaaaagaaattagggatcggggacatttctgactgagtagcccatggcatatgaatatattgggggtaaataaatatatgtatagtttaaatacactgaaaaatttccagacattctcatgatgagtagcacaatttaacattccttaacattgtagtgctcttctgcatttttaattagctttgagagagaaaagaaccacagtggttgcacaactgaaacagcttcaggcagaaacagaaccaattgtgaagatgtttgaagatccagaaactacaaggcaaatgcagtcaaccaggtaaactcgtcttaattttgaattctaaaaattctcctttctggattaatacaaatgttaattcaaactttatccagtatcccatagtaaaagttcatggtttaaatgagtgctttattcatttttaatttttgtttatccttattttgtaggggccagtataattaataaatgttaatattaacactaagtttttttcctaaaaaaaacttctttagtacttatctatactgattatactacagaaattccatctcctgtttcccccttcctggggacatttggcaatgtctggaaatactttttggttgtcataactggaggggtgctatagggacctagtgagtagaggccagttatgctgttaaacatcctacagtgcataggacaagcactgctgccgctactccccaacaaagaattatccgactgaaaatgtccattaagaaaccctgttccactgtgtggtggctcacacctgtaatctcagcacttggggaggtggaggcaagtgaatccgttgagcctaggagtttgagaccagcctgggcaacatggcgaaaccctctatcttaccaaaaaattaaaaccaataaaaagttagccaggtgtggtggtgtgcgcttgtagtctcagcttacttgctacttgggaggctgaggtcagaggatggcttgagcccgggaggcggaggttgcaatgagtcagtgtcataataccactgcattccaaagtaggtgacataatgagacaccatctcaggaaaaaataaaaaagaaaccctgtgcttgggcaatacctagaaccttagagcacatgggtatctcgttataagagaaacctgagctcactttatccctggctacattctttcatacccttccaagctccatgcccaaggagggtagttttgagctgataagattattttattcctaacttccctttacctacaaatagacgttactgtttcgtttccaaagaaaacatattgccttagtctgacgtagtacatgtcacgggtggaagtcttttgggttactagaaacatttaaaaataaaatctcttactaaaattgaatattgtcatttgagataaatcctagctaccagtaaattcacttgaggaattgctggatattttgccgtgctatacctttgatttctatgtatttaaaccaaatttttagagattggctcttaagttttcctttgtgatttgtgaaggtgttaccagatatttttagaaaagcaacaaatatacaattactgtgccatactatagcgtactatactatactataccataccatactgtgacatatactacatacaaatgcagttagctctctgttctgcatctgtggattcagccaactgcagattgaaaatattcagggaaagaaactaaaaaataacaatactacaataaaaaatacaaataaaactacagtgtaacaactaacaactatatgatatttacattgcattaagtgtaagtaatctagagatgatttaaagtggatgggaggatgtgtataatttacatgcaaatactgtgctattttacataagggactttagcacctgcagattttggtatttgagggggctcgtgagtagggggtaggcaaggtcttggaactaatgctctggggataccaagggatgactatatgcgggaaaacacacagagatatatacacacatcatgcgcatagacagagctatatattatactaaactacttttatgcttttagaagaagtaattttagatcttcaggtcacatgtaggtgattacaaagggacagcggaaataatccagatgttagactacaacagaaaatttaggatgctgtagtttagtcactcaaagactgggaagtaatgggatcagagcatgaataagatgaatgtacatgtgttcaccagttagaaaaagaggatccttgtagcttaataggtactgagtttgagataaatgaaaggatcatgtgttaaaaacttgtaatcttatacttacagactacctattttcaatgtaaaaacctttttctgacaattcaccctttttaaatttcattgaatatatagtatcgtacttacactttcccggaaataatcagccagaggacagtgattatatacgtgagtggtatgagtagtgcaatacaaagttattcagtgtgatccactgcaaatgttcagtttttgttgaagttcttctatgttggaatttcatgtacatttcataatcagtattgtaatacacctatattaatttttatggggacatatctctgctccattaaatcttcaagcaaaattgtgttcccaaagacacattatagcatatttcttctcatgagaaggataagaaaatgtttttgttttggaaaatgcagtcaggtgcagtagctcatgcctgtaatcccagcactttgggaggccaaggtgggtggatcacttgaggtcaggagtatgagaccagcccggccagcgtggtgaaacctcatctctactaaaaatacaaaaattagctgggcatggtggtgcacgcttgtaatcccagctacttgggaggctgaggcaggaggattgcatgaacccgggaggcggaggtggcagtgagccgagattacaccagtgaactccatccggagtgacagagtgagactccgtctcaaaaaacagtaacaacaaaaatgctcataaggtgggcaactatacacatatatcccctgtcccttgatgtctttctttattattagtttgtcttttactagtctgtcaacatctcaagataatgcaaagctaatttaagaaaaattaaatatggcacttggttatacctaaggattgtgtagggtatgtagcatagctgtcatgtatatcggacatgatttttaaatttttatttattatttttttttgagacagagtctcactctgtcgcccaggctggagtgcagtggtgccatctctgttcactgcaacctccacctcccaggttcaagcgattctcctgcctcagcctcccaagtagctgggattacaggcacccgccaccatgcctggctaatttttgtatttttagtagagactgggtctcaccatgtttgccaggctggtcttgaactcctgacctcaggagatccacctgcctcggcctcccaaagtgctgggattacaggtatcagtcactgcggccggccaggcatgatttattaatcttgtaaatttgtcaaatcgtccttttgaaaaatattaacagattggaggaggggacatttatatataggattagtttcttctagtttgtacatggtacatttatttcagtctctataattagactatattatctattagaaatttgaccacatagagcaaaaaccattctcagtagattaccactaagtagactactgaccttactagaaatagtcagaatcttctggttttattgtctgacaaactgttaaaggccttaccttagttgtggtgaaacacactaattttcagttagggctaaagaaatctgaaagtcaattttaaagtttgtagctctccttgtatacttcttatattcaaaacatgtaatgtcctgcttattttattctggaagtcttttaacatttaagtatttatttaaggtgactttgcgtaggtaataacttagaagttggatatgcttattttgttttctgtggcctttaaaataatgtaatttttgttttttattatttagggatggtaggatgctctttgactacctggcggacaagcatggtgtaagtgttttaaaaatattttaaagttgtcatgttttaataatgctgactaaagactggtttgtacagatgagcttatggcttggcctaagaatataatttccagattaatttattaattataaaatctggttatatttttaaaacttcagtgtttataaattgttgctgacaggaaaatatgtgcttatagctcacctttagatgacagaaattctcaaagcttgtatttattccagagttgtaatagttggcagtaattgttggcattttatattagtgccaatagcaagctaagtattatatattatagggcataggatgccttttcttatggattaacgagtaaggcaaacagaattaaatttgaattagaaatgctttgagcagtagaattaggtagtactttggctgccttgtggaacacaatagcctttgaaattatcaaggtctttataagtccccagattcacaaataaagaaacatcgtaagctttcctaaccgtcactcaatcttatttcccttgtgttaactcaaagcatgaggctttgcatataattaattatttaaggagtccccaactcccaggtcatggaccagtaccggagggccacagagcagatgatcagaaggtgagcaagcattaccatgtgagctttgcctcctgtcagatcagtggaggcattagattttcataggagcacgaaccctattgtgaactgctcatgcaagggatctaggttgcacgctccttatgcgaatccagctagtgccttgatgatctgaggtggaacagttcatcctgaaaccacctccccgaccccagcccccattagtttacttctttaaataactccagaggtcagttctataaaagtctcccaaaagctgccaccaaaaataaataccataatcagagatacatttgactcataaaatatacattagaagttggtgacttaaacattcatagttttgacctcaaagacttatgaattacaatggggttttaaaactctaaattaaagagaacttaatcttttttttttctttttagtttaggcaggaatatttagatacactctacagatatgcaaaattccagtacgaatgtgggaattactcaggagcagcagaatatctttatttttttagagtgctggtaagtataagtacatgttttttttttttttttttttggcttttgaaggattcccttggttcttcaaaacatgtatatagatagatttgggtctgttcattaagttttcaacagtcattggcaaaagagaaaaaagtaaagaaaaccctcccactcaaaaacagaaactagaaaccttgtttcagggcctcaaaatttggagggtgatttaacttgtccttgaaatccaaaagtaggaacaattttatgatttttagcattaacagaatcgtatcatgtaatggatttattattataatattatacagcacagtgagtggcacattgtaggtgcttaattaatattgttgagtaaatccattattcctgatttaatactttatcatatatatatatactccttgaacttggctctaaacaactgtggaatcctaacggtatgtgaaatattttatgccttagtagtaacttttttccagttacctctgccttcagctattggaatataaatatcaatggtttcttcattacgtggggtatagatgagtttaaatggtactattaaccatgaagtatcctattaccgtatatttgacaggcttctagatttagtgcttttgttagagaaggagagttgtgtgaagccaaattaaaaatcaggccttggccaagtgcggtggctcacacctgtaatcacagcactttgggaggctgaggcgggctgatcacctgaggtctggagtttgaaaccagcctggtcaacatgttgaaaccctgtctctactaaaaatacaaaaattagctgggcatggtggcacgcacctgtaatcccagctacttgggaggctgaggcaggagaatcccttgaatctgggaggtggaggttgcagtgagccgagatggtgccactgcactgcagcctgggtgacagaacaagactccatcaataaataaataaatatatatcaggccttcaaattgatgtacttcgttctcactctgtcttctgtttaggaaagtgtattaagtgccttctacagttatcaaaacatccttgtattaactagcctctcatttgagaaattataatttgttaccttggactagtaagtaggtacttaaagtctaagatttctttttttttttttttttttttttttgagacagggtcttgctctcacccaggtaagagtgcagtggtgccatcatagctcactgcagccttgaactcttgcgctcaagagattctcttgcctcctgaatagctaggactacaagtgtgcatcaccactcatggctaatttttaatttttttttttccaagatggagtcttgctatgttgcccaggctgatctcaaactcctggcctgaagtgatcctccctcctcagcctttcaatgctttgggatttacagccatgagcctctgcaccctgcctgtctaagatttctctagttaatcctagaagttggaaaaagaccttaaaacagagactttttgtcttccaaccttggaagagtttgtttctttttgcctttactttctggtgcttttttcttcacttgtagctccacatgttgcaaaataaagtctcatggctgctgtctgtggttattttctaggaaattaaaattttcattttgtggggagggagagattagtattactgattcaggtaatttctacacttaaattgcatagacaacttcactttttgaaactccaccatcctttaaagaaaaagattttctgtttatttccaactttgcttaagaaaaacaactttttttctttcttgcttccatttgtagatgaattcttaatttacagattagctgtggttcacttgcaagtgcattgaaggtaatcagtgatgctaaacttgtagtaacttatcaaaaaattccatcagttttactttgaatattacgagggatttaggagagcaaaagttgattactttggaaatgtaaacagcttaaacccggattgtaaaatcagaagcctggtatgattacaggtacatgaaaagagttggttatttatatcatttgttaatgctgggagtgaattttgagaatgaagatttagtgtcatgttagagttccagcacagtaaatttattgttgctggtcagtgagtgaatgtgccattttgctaagacatggaaacttaaggtaactgctggaaatccagatattgaaactcttctagcatatccacccttgaaagcaggttagtatgaagagccaactgtaatgacatggagtttagccagagtagtacacatgaaccttttgaggattaaaaaacttgctacactgctacaaaaagcttttattctaacacatataacacattctagtgttaatagtattatatttatgtagtatggttttatattagtctgaaaatttctacaagtgacaggtttgtacttgtaggtttggtgaatttttatgtttatttttttaaaatatgacgatacaagttaattcccggtcttaaaaaaatttgagggttagttttaaacttttgcattgcccctaacaaatcttgtgctggaactcaaatgatattttgattaagtgattgaatactgtgatacaaacactaagttaatatgttttacatcaagaacagtcaacatagagttactggaaattctaaaaagttacattcaattcgttttaaaatttttgtcctgtctgagccacaaaacatttgtgttaggcgagagtttgttgcttcctgttggcatattggcaggctaacagtgccaagcttaaaagaatagatatctttttcttttgatttagatagccactaccacaagatctgtgtatttgtttgaagttttgttaatagcaaatctaaaaatcttgtttggatttgggatgagaaatgtcagtgttttactttttagttaattaattttattttttgcagtggcctttttttatttctaaatacttttctggtggttgattattcttttaaatctgtggttagggaaacataagctatgaaagagctattgtaactatgatctgagattagaatttgactctccaaatgacctattgtaggtcagtgttgtataaattaaagctgtgtgaccctagaatctgcccttaaaaaaaaaaagaaaagactcgtggattttagaatacattgagaattgttcaggtacactctgtttggtgtgaaacttctttgatttatactccaagaaatgtgttaattgaaataaaatgacgaagctggtttggtgggaatttttgaacacttttgctttaacagttattagcactattgattattttgttaaaattttccctcattgtggcctttgatctggctccataatataccccattcccttattcagcagctctttgaaataaaagtgattttagttcctaggactatttgttatacttttggagctgtctctttccctccctcaggatgtaaaatgtatttcctgtttgtatataccacttcatttaaaaatatttttccttgaggctcaagacagtatgagtaatgataatttttagaggcattaggatcttgattgaaattctggctctgttgtatcctgttgtgatgtcactgtaagaattgtgcatttaatattgatcttcaagcatagttttgcatattttaacatctgaaatcagaaagtgtctttactgggtttttggttttagaaacataaaataataatgtatgttaaaattgatggcatttttgactcgatgatatatttttatattcagatatcctttataagaattaaacattttatcctttgtaattagaacaattattttatggattttgataaaccagtttttaaattttcaatgaattttgaaacatttgtgtacttgtgtggctacattaagtcaagataaagaacatttctgtcacctcagaaagaccctttttgttcttttgtggccatactccacccatggtcctgggcatccattgacctgctttctgtccctgtagattagttttgcctgttctagaattttatgtatgtaagtggaatgatgtactatgtatgtttgtgtttggcttatttttaccagcaagtttttgaggttcatgttattgtgtgtatcagaagttagtttctatttattgctcagtagtatttcattctgtgaatttaccatggtctgtttaatatattcatctattgatgatgaacatttagattacttttagtttttgcctattaaaaataaagttagtatgaatatgcatgtacaagttgtattgtggatatactttgtgataataactagaaccaggagtggttcaaaatttaatttacacatctactccctgtgttatttgcctgctcttagtgtgccaaatgttatttagtacatttgaaaggatgaatctcagtatagactgagtttgtattgtggtccccaatgtttagatcatatatctgtaaatatgtatacagatttacatatagataaatataaatttacgtatgtaaatgtatatgtaaatatatgtaaatctgtatacctatctctgcgatgattttcatcatcatttcagtaactcagatttaccaagttcttattctgtatcaggtgataattgtaatccctgtatgtcttatgtcacttaaactatacaactgaggtgggttctatccccatgttgcagtgaggaagctaaagtacaaactagctgttaagtggtagagacagaattcttgattggatttctgatcctgcacatataatttaacttgtaattatgatatctcttgatatttatactattatgtaaaagtgcttctgtaaaaaattaaatttgaaatttcatcttgaggtgtagacatgtattcttccccctctactgcccttacttgcttctattgctttagcacatctgatcggttcagagtcagtttacctacttctgctgctttgttttgagggagtccagctttgctcattgttattagcctggtcattatggatgttttgagtttgtgactcttttaccagcggatagaagaggtagggatggcccttagtcccctctttttttaggttaagactgtggtgtaaaatttataggtttcatgattagaagtgtaatttggggcaagttacactctatatgtattagttcccattttgaaatggggataaaaaaatatagggtttttgttaggattacaggagaacactaacttgtattgctcagtacataatcctttgataactattaattgttaatcagtgggcctgcttttttcctgtctccctctctccgtactgacttccatttgtgtcataatttggaaatattttttggttctgtacataatttctcattacattgtaaatgagactcacgtgtcttgattttccacatcttcatcctagtgattttagtgacaaattacatgtaaatctaacttggtttctgaagttttaggtgcctgaaatttgattagttatgtataaattatctgaagtgggttatagtaagatgatgctgctgtttcctagttataaaagttattttttattttcttatctagactgattattgaagacctgagtatttttagcaaaggttttttgaaacaaaccagtgtgatccaataaggacttagataattacagttttttgtagaaagctataggtcttttagtaggctagagggatacatgggtataaaacatacattatgttcatttttcaagagtattcacaatataattaattatgatttcttaaacaggttccagcaacagatagaaatgctttaagttcactctggggaaagctggcctctgaaatcttaatgcagaattgggatgcagccatggaagaccttacacggttaaaagagaccatagataataatgtgagttcgactttttcacagttattctctgaaatatctgtgtatccttcacactttctgatgaggaaaatcactatgcattttgggaattaaaaaaaaaaattcatattagcttttgttgaccttacaaaaatcatagtggattagtggcttgactagtttgaatctccttgaatgaaattgtcagacttcttttggctcttagagaaaaaacgtagccttcatttctgttttacagctactgtgccctttttttctatgccagtcaaaatgacactatgctgttagtgccacctattattgaaagtcctatgcagaagacagttttcatctacaattatctaattaaaccacttactatgaaatgttcagtttaattcttgcttttaaaatgttttctgaaatgattataatttataacttctgtaagagtttataaattagagcgtcttcagtagacattattgaatctgtctctaagaacagggtaataatttggaatgtcgagggatcatgtagagagaaggcatagggggtcggacattgatcataatgacctccgtgcatgccttagaaggggctcatttttaattacagttttgaagttagtgatgtttgtcctcctgcctctttcttatatattaatattttttatgtatatatttttaaatcctttagtctgtgagttctccacttcagtctcttcagcagagaacatggctcattcactggtctctgtttgttttcttcaatcaccccaaaggtcgcgataatattattgacctcttcctttatcagccacagtaagttatttcactgtgtaattttggctttgtttagataaaattacatggagttgtttaaacttaaaatatacttttttctatcatttgaatttgttgtcacctgtttttttttttcttcatgtagtagatttgcttgttactgaaaagtatgcatgtgactcttaagtaaactatttgacagagtgtaccctaagccttttaaagtgctatttaaagtgtggtccctgggccagcagcatagaaatcatatagaatctcaggactcaccctagaactaaattagaatctgcattttaataagatcccaggtaactcatgtaaacatcaaagctttagaaatgaggctctagggcatactacttgaaaggaatacgtgcatctttttatatcatctttgctctgtcaactagcttttgtttaatattttggtgatgagaaattcactgcttatgaactagaccattcttttgtaagctagaaattatttgtaaaatttactcttccagtggaactcaaatacctctgaaacttctgcccattatttcttgtttgtttggaatgacagaaaacaagactgcttcatggaaactctttagatgttttaagataattttttactcctctctgcttccttcaggctaaatatctctagttttattaagtaacacagtttttcagaccctttagtattttgattgcctttttagataatttctattcatattcttacaatctagatgttcataattgaaattttattctaggattgtcatctaaactttatagattacagtggcaatattagctcatgttacttgtatgtatgcttttactaatatagcctaagattgcagtagcaattttagcagttgcttcatggtatgagttatattgtattgactatattattgggcaaattttacaataacacttttttttttagataatgtctggctgtgttgcccagactggagtgcagcggcattatcttgcctgactgcagcctctacctcccaggctcaagccatcctcccccgtcagcctcccaagtagctgggactacaggcacatgccaccatgcctggctaatttttctattttttgtaagacagggtttcaccgtgttgtgcaggctggtctcaaactcctgagctcaagcagttctcctacctcagcctcccaaagtgctgagattacaggcatgagccactgggcccagccctacattaacagtcttagttcatacttttactatttgttcatctaaatgaagattttatagtttcattacattttatcttgtagaaatgaaaatggtttcatatgacaaatgaaataataagaattctaaatcattaggaaatactatatacttggctgatatcctccaaaatctgaaataccctgtgtggcattatcagatcagttaactgagggaggaatcatggggggttttgctttgtttttaaatgattccattaacaggattatgggtcctgatgaatgtattggtcagtatttaaaaagtgtgtgcatatgggaatatatcctaactttgtggggcaaaaaatcccttatttgaacatccagtaaagccttcctcctcaaacattaaagttagatagatatacactgaaaagccattggatatttggaaggaagagaaaaatgatattaaaattatatttgggagtatttttaccagccagtgcttcttaaacattttggtcttggaacccgtttacactgttaagaattattgaatgtaggctgggcgcagtggcttacgcctgtaatttcagcactttggaaggccgaggtgggtggatcacctgaggtcaggagttcgagaccagccatggtcaacgtggtgaaactccatctctactaaaaatacaaaaaattagccccacgtggtggtaggcacctgtaatcccagctactcagaaggctgaggaaggtgaattgcttgagtttgggaggtggaggttgcagtgagcctagatcacaccattgcactccagcctaggcaacaagagtgaagctccgtctcaaaaaaaaaaaaaaaaaagaattattgaatgtaattttctttgcattggttttatctcttggtgtatacagtaagtcctcaatattgtctctaggttcttggaaactgcatctctaagcaaaacaatgaataatgaaacaattttctttctcaacagcttcataatgaaagaatgttacttggttttaaagtcgtagtttccaagaaggtaccgattatgttaaggacttaactgtattaaaaatcaaaacaaattaaaaattttctcattaataaatggtaaattgattcaatttaacacataatagaattttaacgaaagtaactttgaaaacaaaattagtgagaagagtgacattgctttacatttttgcagaccttcagttgctgggttaattgacaactgggttttcatgcctgctttcttgcagtctgttgtgatgtgctttaactgtaggatgaaaaacctagcttcacacatgtagttggaaaagaaaggtgtgttttattaataatatccttttccgataattgtgaatattcttttttgaagatacagtaaaattcagtaagaagtacagataaaataaaactcaacaagaaatagtttttaaaaggttgtttgtaatgtagaatctgaaaccatgtggttaaactttttgggatcctaagctgtactggtattctagactgtattgagctatcttgcacttggaatggatcttttttacccatgcatgattttatagtatcattcattggttgtttgggaaatacttactggtccagtgagttatgcaggtattccagtgtgttgacattatacaacaccagaaaaaccacattcatgaacatcactaccagacccatagaaacgggtttaagcattggaaagctttcaagctcccagtggctgatacaaattttccaaaattctagtttttcttgaaagctctaattttatcatttgtttttcttgaaggacaggctcacttcattttctagaaaatgtctggcaaattcccaagtctgaatgtctgaatagctttagtttgtctgccattctttcaagtaaaaacagtgttctgtgagaaaagcagctggttcatcttgtttctcagttgcacaagtgcttttccttaaggacagccgtgacagtgaagtgtgtatacagcagaagcactttatgaatacttaccatttagtcatacagaagactagaaagattagtacttaagggttgaagtttttaaaaattaatttgggctacgtgattcaaggacatagttgaaactttttgtgtgttttttaaaactgcaaaagtgtggtggtgaaaaatatagggactgctagtatagtttgatgccactgctttgatttactctaaagtacaagaagaatttgtttgtttatagtttagtaatttttagtaacttaactgagtgatataaccatcacaagtcagttttagaacatttttattgccccagtaagaaccatcatgcctgtggaactattttctttgaacagaaacagcctgtggaaaagaaaactactcagtagtatgatgacttttagttgtttacaaaagtactgtgtttactgttttcacttgctatagggtcagattgctgtcttattttctgtcttgttaagtcttcttgcctgattttgatttttgcttgattctgacttttttcctaatggaaatatacccagttgacttgacagatcattgtttcacccatttcctggacttcatattcttgaagtgggagagctatttactgttgagattgtgtgtgatttgcatttgtatatctataatcagtatgtgtttttcagttgtctctgtttaagatttatgaaaaaagtagttctaatttcttatagcacagtaggtagttggttgattgcatgttcaatggatattatatgtagattgtaaattgcatatttttaaaaattattttatttttattttttttgagacggagtctcactctgtcgcccaggctgaagtgcagtggcgcaatctcggctcacttcaagctctgcctcccgagttcacgccattctcctgcctcagcctcccgagtagctgggactacaggcgcccaccaccacgcctggctactttttttttttgtatttttagtagagattgggtttcaccgtgttagccaggatggtctctatctcctgacctcgtgacccgcccaccttggaatcccaaagtgctgggattactggtgtgagccaccgtgcctggccatactttttatttttaatataaaagtacgttagagatcatgtatacgtttgtccttaaaatgaaagtttagataccagtgcaggttaaagtctcttacatcacatatattaccatttctgccataatttattctgaatctaaaatggagatgatttacacatttgaaaagtgttgaacttttaaatgtaacataatatataagataaggtggcaggtgtaagatagagcagtgttcgtaggctatcggagatgaggctttgccactaaatgtagatgctgttaggaaaaagaatccatttgtaatacaatgccctattactctccacttgtagaaagaaagatgcaaagttcagttagtaaaagagtattttgttttctcaataaaaataatctgaattttctaagaaatttcaagttttactattaaccaatccactatgtgatgtccagaatttgtacagacagacctttcctgctgttattttccttatattttctaattagttcctggtaaaaaaaactctttgtcgtgcagatagtttacctgctttagctcactcaggatgacctccaaggtcctcatctggaggtctatttagtgtcctacctgtgtttttgtttttctctttttaaagcctgtccttcatgaaatgcacttccctttttgttctttcttgtccaaaacctatctgtttttaaggtccagctcagatttacttccttcgtgaagtcatttcagtgtattttgtttagcttgtatttggtgtttagttacttaaagctgttaaaataaacaaaacttataatagcttcatctccccaacttgtaagcatagttacagacagagttgtcatttttcatgttcttgtagcacatagtagatacttaagtatttttaatttggtggcatattttatgttttgattattaaattttctgtgtttaattatgaaacactgtaggaaaactcccataaagctgtacagttggggaagattgtgctagaatgaaaaaataaactaaaacattttacttacctagcttgaaatttcacttcatagcacaaatactgagtctgttattttaaaaaaaaaaaaaaaaaaactaagaaaatttgatttcaaaactatgagaagtatagcctgctattacacagcttagaattcaaacgagtaacataataagtaatacaagagcatgtctaataagtacatacagtggtattgtacatgctaaatactggagaagttagaagcatccagtccttgaagataaaaattgatctgtcttaaatttggttggacagagaagagagataagccagggaagtaaaacagaagagcacattggtcattggtaggctaactgttaaaatatatacctgtggttttggtcatgtttgaagtaagtttttaattgctgatccttcaagaatgtgaattgagataacaaaataatcacctctaatctccactcctattccttcctctccttatctatatatagatgcatacacacctaaatgtttatatacaggatggatcacttttgccctgtaaggtagggagtctgccatgtttcaaagtctggctgggcatggtagctcctccctgtaatcccagctacttggaaggctgggacaggaagatcgcttgaagccaggggttttgaagcctgcctgggtaacatagtgagacctatctctaaaacatttttttagaaattagctgggcattgtgattcactcctgtggccccaactacttgggaggttggggcaggaggatggtttgagtccaggagttaaaggctgtagtgaactatgactgtaacactgcactccagcctaggggacagagtcagattccatctctaaaaagtaaaaacgcctggagccatggtgatactgtataccaaggatctgcaaactatggaccatgggctaaaatctggcccacagcctgtttttatatgtctggcagtctagaatggctttcatattttaattggctaaaaaaatgtgaaaagaataataatattttgtgatgtgaaaatgacatgaaatttcagttttagtgttcataactttttattggaaaacagccactttgtgtgtgtgtgtgtgtgtgtgcgtgtgtgtagtctggcagcttttgagctctaatggtagatctaagtagttgagacagagatgatatgttgcacttttgccacctcatactcttctcagtttactacaaatccaagtgatgccagttatacctggacagtgtttctcaagccccatattgtcacactgcaacattttatttatatgttattttattaccagtgcttatttaccgtgtcaaaacagagaagtgaacttcgactatgattataaagcacagtggagtggagatttttattgtaggaattacaaagcaaagtactaaactgacactgtaggtaagctaataatatacatccacattaccggactataatcacttatcacaactgtcacatgttctcaaactgacaggaaagcaactgtcagaaaaattataacctttagaaatggaatattagatcccagcagaattttttcacaaaaattaatgaaagtgaggcatcaaaatttctagcccagagcattgcctcatgcccatagccctatcacttaggctaaggcaggaggatcagttgagcctgggagactgagtagtgatcatttcactgcacttcagcctgggtgacagaatgagaccctgctctaaaatttttttttcagttaagtgtctgaggggttcttttcttttctttctttccttttctttcttttcctttcccttttcttttcattcccagttctttttctttttcttttcatcctgtcctgtcctgtcctgtcctttcctgtctgtccatgtctcgctctgtcgcgcagtctggagtgcagtggtggaatcttggcttactgcagcctcggttcactcactccctgggctcagatgatccttcctcccaattcagcctcctgagtagctgggactataggctcacaccactacgcccaggcatgtgtagtacttttatcagccaagtaaggaaagtcatttaccagtggtgatccagttaaaacatgtttgattttagcagccagagaaatctgtccagtgaagtaaacttgtttaaaactattaacctttcagcgagaacagttgctctgagttgaggatattgacagcatgttgatctggggagagattgaaagtgcccccaacccgttatcaaacactgaatggctctggaagttaacttttgcagcagacttgataatgtttcttagtttgtgccatctaaaattgcaaaacaaaagtgtttatatgtagaatttatattgcagtaaagtcatttcagtgacaacatggtatgaatcataagtaataaaaagccagctgctttacacattttgtgttctgtcagaagttaaaacacaaagggagaccttcattgctaaataggattgtagcagatgcatttccaagttcaaattatagttgcagaaagttttagacctcattgcaagtatgaaggaaatttctatatttcaaaatttaactacagttgaattgaaagtgattaatctgcaatgtgatgacacgctaaaagataataccaaaataatagaattgtacatgtctttctaaatgtgctcaattaaaataatatgcttgtcagttggtgtttgatgtcagcatttactagtgcctgtgcatgtttttacattttccttttttttttttttgggagatggagtcttgctccgtcgcccaggcctggagtgcagtggcaccatctcagctcactgcaacctccacctcccgggttcaagtgattctcttgcctcagcctcctgagtagcagggattacaggtgcctgcctccacacctgggtaatttttgtatttttagtagagacagggtttcaccgtgttggccaggctgatgtcaaactcctgacctcaagtgatccacccacctcggcctcccaaagcactaggattacaggcatgagccaccatgccccgcctacattttcttttttctttctttttttgaggcagggtcttgctctgtcacccaggttggaagtgcagtggtgcagtaacggcttattgcagcctcgacctcctaagctcaggtgatcctccacctcaattttattattatttttttttgtagagacaaggtttcactatgttgcccaggctagtcttgaactcctgggctcaagcagtcctctcacctcggcctcccaaagggttgggattacaggcatgagtcatggcacctggccgtttttacattttcaaggactaaatatgtaaaatctcattacagattacattatcagaaaaacatttgcaatactttttaatgatatggacctctaaatttgaaattaattaagcaaaattattcccagtgaaagaattccattggtctcattagcagacctatattttggaaatttgtttcctctctttttatagaagtatctggcataatattctgaatttgcctcttgcccacaaagccaaaaatgtttactatctggttctttacaaaaattttgctggcttctgaaatacactcacagaaacaaagagtagatttcccaaataagtaatcctccagtaaaaataattaagatgtatatggagcaatggtataaactcaggataagtaaaaataactatgagttgaacacactatacaacaaacttatagaactatttatgtataaattgattttagataaattaatgatgagtctcataaacgtgcactaaaatgacctactttgtctgagtggagtggctcatgcctgtaatcccagcactttgggaggccaaggcaggcaggtcacttgactcagcagttcgagaccagcctggccaacacggtgaaaccccatctctactaaaaatacaaaaaagttagccaggtgtggtggtgtgcacctgtagttccaactactcgggaggctgaggcaggagaatctcttgaatctgggaagcggaggtttcagtgaactgagatggtgccactgcactccagcctaggagacagagtgagacttcgtctcaaaaaaaaaaaaaaaaaagaaataaaataaaaaaataaaatcacctactttaaaactgatagtaagagaaacaatcatgctttcctgtgtttgtacctgagctctctggcaagagaagtaattgttctaaatgagtattgcaatacaaaattttcatttctaactcaagcttaatttttcagatgatgtaatttagccagtgtgtttttggtgtcttttcctagaaattatttattcttgagtggatattctttttatacttcacctcgtttagagggcattcagggtggctaagtgggactagatattattaagtgttcaattctagggtcctctaaagagtttaaacaacattttgtgggaatctataatataataaaatacagatttactcatcattgcctgggggaacttagaagataaggtattgaagctggaccttgaaggatggctaggatttaggctttcaggggtatgtatttgggagaccaatctgtgtggagtgaacttgaagaaaagagagaggaagctgtcaatggtagtgtgatgggagatgtagctggatggataatttggggcttgaatattcacctaaaagaaatggactttattgacataattctgagatatgtatagtgtctggcactcagaggtgctaaattagtatttattgggtaaataaatagggagctatttgaggaaattaagcaggagaaataagggtaaacacctaattacagggcattgtcccatgttgatcatcacaacagcaagatttgctaaatattagccaagaccctgttaatgtttacctgacatctattccttcctaattcctactgctaccactttaaccaatgtcttgtaatattgtaatattccttccccgttgcttccagtctttcatcccctgaattatttaatttaagtggctgattttctcattagtatgagtgctttgcacataggttttcacacatttttttctaatgggtgaatgaaagtcatcgcttagtagccttttggaacagactgacagcatgtcaatgaaccttgcaaaatcctgttactcaaaaataataataggataattagcctcttgattgagtcttccatctcaccccatattaaagaaatagtggctagcattctcctcatttggattcctgaaactggattctgtttttaaatttccttggaggagattttcttataatactcattcttaagtgtttgcagtcttaggctagtgaaatagtacaatctaatgacctgctcgagagttttctttatctcaccctgggtaagttattaaataacttttatattttttcttagatatcttaatgcaattcagacaatgtgtccacacattcttcgctatttgactacagcagtcataacaaacaaggatgttcgaaaacgtcggcaggttctaaaagatctagttaaagttattcaacaggtaaaactaaaatatatattgattttttttttaaatacctaagctttaggtctaacctctttttctaaggtaagacttagttcttaaggtacaaacgtttttaaaaataggtggaaggaatacttgaagtttagaaaagagaagaccctcaaatgggcttttgttttccttaagtccaagatacacaagttggatgtggtaggaatgattattactgtctgctagatgaacacttaatatatacattatgtgtatgtgtttctcttattgcaaagagtgaagaaaatctggaacctggaggtgggggtcattacctgtataattctacatgggtgaactttatatacaataccgtttcaatagaccccaagttgggcaaaaggtttcaggcagccatgctgattgatatttagtgagcttgtcagcaaaacccgtagattagaaatataacttaaatatttatttaagagtgtattaaatacaaagaagttattgtcattcagtagggaatgaatacccttatgattggggaagtttattactgtttattgaccaagggagacttttggtagtagaggaatttgaaagctttcagaatgcttctaggatgagactttagagaacttggtttgaaagacataataagcttaaggtgtggtctggaatcaggataggaacaattgttttgggaagatgctaggtaatttggctagaaattaatggtaaagaaggagaaaacaagaagattgggatattctggggcaatctgctaaacaatgttgaatcagacttaccttgaccgttgacttatttttacaggagtcttacacatataaagacccaattacagaatttgttgaatgtttatatgttaactttgactttgatggggctcagaaaaagctgagggaatgtgaatcagtaagtgtgaatttttatttataaactaatactattcttaaatttttggatattgtaacgttaatcttgcagtgtcttccttaaagtaatgaagtaattataacggaaatatgcttattaatcttaaaaaggcctaaatggctcatgtttattaaccttaaaatggcttaaatggcttgtgtttattaatcttaaaatgggaatgtgctagagtgatgacttttttaatgttgttgccatgtgtttatcccttttgtgagggagtttgttaaaacattgggggtaatttaaatttacagacatatccataatttcatgtcttaaatctcgaatgaatatttttaatatttcatatgtacaggcaaggtcactttgaattgcaaataacaactgtgtttttaattttggttcatagatgggcttatctttagaatatttcccatggttgtatttaacatttgtgataaaccaggcaattcattgtaattacgaattttataacggcggtgtctcttattgtttagtagaaattaaagtacctttagagcaaatggaagacttatagttgttttgaataattagtttacaagttttaagaaactaaactaagaattctaactgctaaatgtagttgcatttaccagattcacaagttactggttatcagtttcacccttggaaccaaaattttggcacaaaatgggcaatttgttgacaaatatcttacttctctaaggaaaaaaatgatcatgcaaatatccattccctgatgattttcttattttattttttttcagacagagtctcactctgttgccgaggctggagtgcagtggcatgatcccggctcactgcaaactccacctcccgggttcacaccattctcctgcctcagcctcccaagtagctgggaccataggcgcccaccaccacgcccggttaattttttgtatttttagtagagacagggtttcaccatgttagccaggatggtctcgatctcctgatcttgtgatctgcccacctcggcctcccaaagtgctgggattacaggcgtcagccaccgcacctggcctccctgatgattttcaaacattagatggaatagaaaattagaatccaatatggtaattggtgtttttttttgtagtcatatattgcattattaaggtaaatattggcgtatattcattatgctaagtgtctaggttttgatgttaaaagacctagagggtacttggttgctgttcttgaaattaaaatattctctcttaattacaccatctgtggaatagtagccaccttttgcattcttttccttctaatttctaagtctacttaatattgtagaaatactccgagcttgtagtccatttataattattttaaatagttggaagagataacattatctgcagagcatttatgtagaataatggatagtaccaaactttgttgtcagaaggctactttattaaagttatcagaaacattgcagtttttaggtctttatcttgtggtattcgtttactacttatttaaatcattaaagatttgaacacagtgttctagaaagtgctgtggtataaaactcatgattgtagaatggaaaaataaagcagataaagtatttgattcacgtttcaggcaattgcttgtcagcatcattaatttttgttgtatttgtacatataggtgcttgtgaatgacttcttcttggtggcttgtcttgaggatttcattgaaaatgcccgtctcttcatatttgagactttctgtcgcatccaccagtgtatcagcattaagtaagaacaccgtgatttgatttggattttctactttaaaattcctggaaatttccatttattgtgaatttacacttaatagaattccagttaattggatttttatttatttttgctttcagaagaacaatgaaacaatttgataaaattatttaaaaacctaacttttgctacaggctcagatagttttagcttgagtggcataatttttcaaaatactaagttgaaggcaatatatgattatcagttaccttattgaagagtaaatactcttgtacctttacgtaaggagaaaagtgtagtaaacatttctaaaatggttttcaacaacagtacaaaggagatacccattaaattggaaattctgttgaaagaccactacatttggtaatcctttccatttagtttgtatgatttaattacatatttgacttctcctatagtaaactcctatggcatcttaaaatgttgaaagatggaaaaattatagtgaattttagttgtaatttcctgttttgtcagaaaatattgggaaaaaattgtgaaatgtacataacctattagaaataaattgtacacattacagtttgaaaaatgactagtgccctttgggcacagaggaagtcaaacaaatgtttaaaaacctactgctttagtgtttgcttctgaggaattgtgcataaaacaaattctttttctttaatgccatttgtttttgcttatccatacttcgcttgcctaattttagtgggccgtccgttgaagtggttgtccagagttagaaggatagtataatcatgggatttttcctatgggaattgaatccttgccttcacagttttattagcactttactgtagcttgcagacagaattttttaaacctgattctcttacaaattacatgaaaattcctaataatgtaattggttatgaaataaagaggtaggtacatcatatgtggggctccggtggatagtagtaactgaattcttgcattgttctttgtttttaaggtttgtaattagggcttgtgaaagagggatgttagtattttggtttcccttgtagaattttctccatttctcattagaatgtggtcatttgggtgttttttggtccagaactgacttagctactaccgctgttgtgggccttttgaaagctgacccttttttttgcatctttagcacctaacatactaactttgtagcacctaatatgctttgtacagtatagtgtgagtatacaatataaatatttgttaagtaaatttcttctgttattagtgaacttggcatttttgtccatgataatgcttgtctgctttggtgtttgcttccgaggtactatcaataagatttgttgtagctcttttcctttaactctgcagccatgtattcattattttctttcttgggatttggtttattatcttttaagaggaacatagattaagtatgtgttctccttactgaagggagatgtgcagctcaaagaagttaatagagtgggaatgtttctatatacctttatgtgacactacctaagaatttttcagacttttctccgtgtagatttttattacttccttgatctctgtagttttctgctagacaaaaatctacaaagcattttcagactaaagtcctagtggctttccagagtctaaaaatatttttttttctagtagtagcattttctttcacttcagttcttcaatttttttttcaatgttttactaagatgattaagagtacatagatcaataatgtatgtttttctttttctttctttttttggggggagacacagtcctgcactgttgcctaggcttgggtatagtggtgcgatctctgctcactgcaacctctgcctctcgcgttcaagagattctcgtgcctcagcctcccaagtagctgagattacaggcatgtgccaccacgcccagctaatttttgtgcttttagtagagatggggtttcaccatgttggccaggcttgtcttgaactcctggcctcaagtgatctccctgccttgttctcccaaagtgctgggattacaggcgtgagccacttgcgcccagcgttttttcaagtactatggtagaattttcaatctgaaagaaatcttagggatcttctgatccaacaacacagttacttttcaggtgaaggacttctcagtagaattttctgtagtgatagaaatgttttatatctgaaaatgtgtttctatgtgttcagtacagtatacttcatagatggctcacatttcaagatcttgaagtatggtttccaaatctctgtgtgacagtgggacttattttcaaatgcaatatcatatatatgaatatatgtatttatatatgtgtataagcagatcaaagcagagcccattcaccgtgcctatcttacagttctgttcagcttctctcctgactaccaagacacctctttggaacacagttttacaaaacactgactcagaacaactgcattgttttgtagccaggaaatttaaagctcaaggacattaagctaggtcttgatagagcctgtactaaaggtatctgacattcattgtactgtacctcactgtaaattcttttatattgtgaacaatttatatttttagaaatgtcaggtttagattaatttgtcatttagtttatcagttgagccagaggataaagatgaaaaccctaagtcactttaactctgtgtttcagaatctttgtagagtttgttttataaactccctatagccaccctaaaccattgaatcagatttattgagtaggctatgctatgatttgcagcagggctgctgtgctgtatcttgagggtggttattccgaagcacagccagaatccaaaaccactgcattaggtaaccagttttttaggcgtgtaattacagcctgctaaagtaatggagtgaaaaatcagtaatttaatacctttattatataatgaattaagaagataagcttcttcgtgtttctaaggatgctttagtgggttagaaagacaaaagaaactaccatcagagtgaacagacaacctacagaataggagaaaatttttagcatctacccatctgacaaagggctaatatccagaatctacaaagtacctaaacaaatttacaagaaaaaaacaaccccatcaaaaagtgggcaaaggatatgaacagatacttctgaaaagaagacatttatgcagccaacagacatatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggtgattcctcaaggatctagaactagaaataccatttgacccagccatcccattactggacatatacccaaaggataataaatcatgctgctataaagacacgtgcacacatatgtttattgaggcactattcacaatagcaaagacttggaaccgacccaaatgttcatcaatgatagactggattaagaaaatgtgacacatatacaccatggaatactatgcagccataaaaaatgatgagttcatgtcctttgtagggacatggatgaagctagaaaccatcattctgagcaaactatcacaaggacagaaaaccaaacaccgcatgttctcactcataggtgggaattgaacaatgagaacacttggacacagggtggggaacatcacacaccggggcctgtcgtggggtggggggagtggggagggatagcattaggagatatacctaatgtaaatgacgagttaatgggtgcagcacaccaacatggcacatgtgtgcatatgtaacaaacctgcacgttgtacaaatgtaccctagaacttaaactataataatagaaaaaagacagtggctggaaataatacgtatttatgttgggattttataaatacagctaacattttaatttggactccaagaatttgtaatccgtgataatgaccaacagagctaaaaattacctttaaacattacacgggaaaaaaagtacttgttctttaagccagaggttttaaacctagttgtacattgaaatcatctggagaagtaaaataacaagaatttagcttaaaaataatagatttcctggttttatcccaggccttctgaatcaaaatctctgtgatgtaggcttgagaatctgggattaaagcttctcaggtgattcttttgcagtcagccttggggaatcattgctgtaaattagtgactttatagtactgacaacacattagaatcaaatgggaaactctaaaaagtaataaacagaaatactatatgactgagcctaacctttaaaaaacaaaaacattctctggagggagaccccatagactgtgttttaaaaaaaggtcctctaagtgattttgatgcaagatctggcttaaaaaaaaaaaaaaagttaaactgtttattttgagatgattatgtatcagttgtaagaaatgataaaaagaccccctatgtcctttactcagtttctcccattagtaacatcttgcaaaaccacagtaaaatatagcagccaggatgttgatgttgatacattcaagatacagaacatttctatcacaaggatccttcaagctgctcttttatagtggtaccctcttccctgccaccctgtccttaatttctggcaactactcatttgttctccattcctatatttttattactttgagaatatgcaaaacattttctaaaagttagtgttcagcttcctaaacggcaaatatgctatgtatcatgattatggtataattaattactagcaacctaactagtagtacagctctccaaagaaaacattacagatgttaatgagtgcctcttttggccaaacacggggtagaaagtagtgagtacactttcaaagaacttaaaatccagaggaagaagcggatattaaataagtggacaaataaatataaagttacaaattattgaaaatatttgtaattttgggaaatttcaaaatttcatatttgaagttacacattattaaaaataggtccatatcattctctctagtcactctgcattggggaacaatgagaagaaaattaggtagggtcagtgaatcctgataactctccaaatgaaatatctttaagccccaaaatagacttttttccactgaatactaactatggcatattattccattcactagtttatgctggcttatttttgcctttaattagtttaaagctatctgatgttctgtcttttgagggggaagggaaaggatatatctcagcttctttttctcccaccaaaggacacatttcaaatgctgaaaatagtattataaaacccataattgtttattaaataactctttctatttgtaatttggaacattctctgttaatagatttcctgactaaatgcctgtaagcacatgtgatagtcagctttataaaaatgcatattaagaatgttttatatgtttttatacaaccttattgatatgtaggataagttacaaatctgtttaccataaagtttgcaacatctgtcaaaaaagattactgtgttggggtttaatttagtatagctgaatcattttatcagctatggcatgtgtctgaaatttaaaagctgttctaaaataattcttggacgagttttcaattgtagatgaaaacaaattatggaagtaatattttggatgtgtatgataaacatgttggagcatacattagtataatttcccaatgggggttacttaagttttgaagttattctactttgcttattttattaagttatattttagttcttaatatttttcttaaagttcttattaccacataacaatttacatttagaatgtaaatgtatggagacaaacagtttcaaaggccattatcattgcatttctgcattatcaataaggttcagttatttataagattataaagagataattttcagttttcacataaggatttagcatttctcaattttctcctcttttctttgtcctgtttcctcccaatcatacagttaaacatagtttacacttaacactgattctttaattagttgtcttaaactaattagaaaagacttggagtacttttctttggatatgctgaatagttggccagtagtcttcagtgaaaactagaccagaggtttctatatccaaatggttaaatcagcagtattttgaaataaattgtgcctatcagataaaatttggaaagccaggttattcaaagaggtaattaataagacaggtgaaatatcagatccccaggccttatttttccaagtgtttgttaagatgagaggttgggggaagatggtggctatgggagggtttagaaaagtaagaccatttgaaagattaggcactcaaaacctgatagaaaatctagagttgatacaacccttatcagttccctaaattaagacttatatatcttctgtccttaagtgggatctctggtattttttacttcctggaaacaaaaaaatatttccctaaatcaagacttaaatttatcttgtgtccttaagtgggatctctgttattttttacttcctggaaacaaagtatttcattttgtgctagaagcatgaacatgtttaattaaattgaactgaggatgaaagatttgtttttgctttgtcttttgaaatagcacttaagaattctgtgcatatcttatttaacatattcgatgttgtgttttgtgtgtgtgtcagttgagcagcagagctagttaggttaaagatatttataaaggatttacagaacatatttaagtatctaccttaagctgcctacagacaaggttgagatttttagtgtaatctaaataatctagaaatttgggtgtttaaaatctggattggactagatatttttctcagaaattctgcattttgatggattttgtcttttagtttattaataaattgaattattttcagtaacatgaggcaagcatgttctgggataggttacgccaactttttgtctttttaaaattggttttatttctccctagccactagaccaccagggacagccttttaagctttgataggatattacacttttattttaatatctgtagactttgatgatttctattagtccttttttttcctttgcgttttgtagagacagggtcttgctgtgttgcccaggctggtctgaaattcctgggctcaagcagtcctcctgcctcggcctcccaaagtgctgagattacaggcctattaatcatttggtttcttttactgagtgtattttcatgttactgaaaccagattatttctacattctttaattcagtcagagtgataatcagcagcttagataaactgagatgccatcaattatttactagtattccttgggccttatttcaggtttttctttgacctgattcacttcgaaaagtaaagatcaacaaataaaagatcaacaagcacagtgcaaacaaagatccacaaagtaagatatggctcagagcgtgcaggcatttatggatcttgatgcttgttgcaaaattacaccagctatgttggaatgagtcttagaatatggatgtaaagaaagagagagggatagagaattctagttagagttattacataagatggaatttttttttataaagacacaggatcttgttctgtcacccaagctggagtacagtggcgcaatcatagcttactgcagtctgaaactgctgggctcaaatgatactcacaccttagcctctcgagtatctgggactataggtgcaggccactgtgcgtgcgtgcgtgtgtatgtgtgtgtgtgtgtgtctgtgcgaccatgccagtgtgtgtgtgtgtgttgtgtgcacacatgtgcacagaatcttgctgtgttgctcagactggtctcagacttctggcctcagcctcccaaagtgttggaattataggtatgagccaccacatccagcctagaatggaattttcactctatggtcttaaaaatctaagattaaatatcatttccttaggtaagctgttcccaaatctccagattagaactggtagacctttttgcatttcacatacataggtccttccactttttcttttttctttctttttctttttttttgacatgggggtctcactttgttgcccatgctggaatgcagtgatgccatctcagctcactgtaacctctgcctcccaagatcaagcgatgtttaagtcaagacccccttgacttaaactctgtaaaggctggcaacagaggatgttttgccagtagcatctaacacggttggtattttgttgagtaaatgtcaacaaagtaaaaggattggtttggtttggctggcatgttatatttatgaaggagaatgatgggaacttggaaagttaaaagtgttgaaaggaatttggaaataaactgggtatagtagtctccctttacccaaggggatatgttccaaaacccccagaggatgcttgaaactgcaggtagtaccaaacccaatacagactaggtttttccctgtgcacacataactatgataaagtttaatttataagttgagcacagtagaagattaacaacaacaataataaatagaacaattataacaatatgccagcatcactactcttgtactttggggccattactaagtaaaataatggttccttgaacataagctctgtgatatcaagacacttgatagctggaatagctactatgtaactgatgggcgggtagcgtatacagtgtcgatatgctggacaaagggatgattcaagtcctaggtgagacagtaggacaatacaagatgtcatcatgctagccagaacagtttacaatttaaagcttatcaattgtttatttctggagttttctatttaatattttcagactgggattgactgctgataacagaaaccacagaaagtggaactacggataagtgggaactactgtagttgggttgtagaactaacctggcagatgtgtaagatagattgtagagactcaagaggtaaagtagttagaaaactaagaaatagtaatggagcctggactagggtagtgactagaataagaatcaatcagacagtaaatatttatcgtctcctgtgtatgaggagtcatgctgctaattgctggacataacggcagtgaatgaggaagatacggtgcgtgcactttggttacatgtatacggtctaccttggaagcagatattcagtaaaacaactatagcaaaaataggtgctatgaaagcacctaactgatgtatcacagatgggagaggtgtcttagaaggcttatgagggtcttattttagctgagacctgatagcttccatgaagataaaagacagtatataaacacacatacatacatgcatgtatactacatactcttaaatattttacatgcatatgtaggtactcttccatcagcggaactgacttaacctatttactaagactggtgtgtttttaattctgataaattaagctctgcaatggccctcttcaacctgatcataaaattggaaaaatacaaaatgcagattggttgatatcaaagagtattttagatcaagatcttcatggtctggtctgctccctctgtctcttttatctgaaattcagtctctctctctctctctctctctctctctctctctctctctctatatatatatatatatacatacatactatatatagtatatagctccagggagtgcccccacagtttatagcacaaatatacacaatgcccgtcagttttatttatgttttcctgagattatacttattactgatgctctttatagtaggcttacttttttaaaaattttatttcagtagcttttggagtacacgtggtgtttcgttacatggatgaataatatagtggtgaattctgggattttagctcatagcttagctcccacttataaaggagaacataaggtttttggttttccactcctgcattacttcacctagaataatggcctccagtttcatccaaattgctgcagaagacattattttcttccttttcatggctgagtagtattccatggtttatatataccagatttactttatccactcattagttgatgggcacgtaggttggttcctaagtgaattgtgaattgtgctgctgtaaatatatctgtacaagtgtctttttcatatgtcttctttatccaaagaaacctttatacaaaggtttactttgtataaccattatatagttgtcccttgatatccttgggggactggttctaggaccctcctggatgccaaaatgcatagattcccaagtgtcttaaataaaatggggtgatattttcatataacctatgcatgttatctcatatacttttaatcatctctgggttacttttaaaaatgtaaatgctatgtaaataggtgttatactgtattggtttttcatttgtattatttttgtattcttttttattgtttgtttgctttttcccaaatattttctatctatggtttgttgaatctgaggatgtggaacctgtggatatggagggctgacttatatagagggaacatcataaaacctttttctcccttagatcattacttcttgagcacctggcaaatgtaaagtactgttctagaagctgaaggatttccgtaaatgcagaatatgttaccctaccctcaaggattttacagtccagttggtgaatggaataggtcgtgcatagtacaagtcaataggcacaagcacatgaacaaatcagacagtaggggtcatggtatataagagaagggtgatccagaaataccaaaaagtatctatgcagagtgtgagtcaacactgtgtacataaaactaagtttttaggcccagttaattaacattgctgtttttactttttcattagcatgttggcagataaattgaacatgactccagaagaagctgaaaggtggattgtaaatttgattagaaatgcaagactggatgccaagattgattctaaattagtgagtattatgttagctatgctacatactatcagttcctgattatacttttgggaattcttaactaggacattttattacctcctttaataatttattttgttttaatgtaaaacagttctttgaaggcaacagaagcctcctattttttttcttccttggtaaatattgtcatctctatacagtgcattaaaatatgcgcaaaggtatgtcatgctttttacttacctgagaaactcagtcattaacattataggatcaatttccctgtgtttccttttagggtcatgtggttatgggtaacaatgcagtctcaccctatcagcaagtgattgaaaagaccaaaagcctttcctttagaagccagatgttggccatgaatattgagaagaaacttaatcagaatagcaggtcagaggtaagaaccacacatcttctattctgtctggggtttagcaaccatgtaattgttacatgaagtttcaaagtgtattgatgagttgtagctgattttgtttttctctttaaagatatgaacatttttaagaaattactaaacagaaaattttttcttagatgtattatatgcattaaacatagaaactgaaaaagaaattgtgttcctagtttattataactatttttcttttgctttgactcttcctgtgtgacttcattaactcatttcctcagggttttcaacacatcattttgatactggcagatgataacttacatgtgtagccctctttcaagtgttcgaaatgtgtattctttctaaatctaaagaaataattctgtaaaaatgttgatcttattatatgtattagtgctgatcttatacaaatttcattatctttcatctgatattcatatcaaaaattaatctcccattttgatagagatcctgcatgttagagattgaagaaacttgaatggccttataattttggaatcctaaactgtgttgtttagacattatgattatgtgtaactggagggtaggaagtcattaggaagcagttgtgggatatgcagagaccccatttgattgaaattttaggaacaaatttgtgtccgcagaataatcctttagttcaaatgagaaggatgcattagaattcaagttgcatattttagccaagtttagaataactgagcctagaaagtaactttcatatgatgtttttttctgtatgctttaggattaatttgtatcatttattgttccagtattaatgatactgttattgctatatattttaattggccaaaagctataccagataataattttggtgtttgttttgtcctgagtgggacatctgacatctagtaattgcaggagttaagatcttagaatggtttggcaagagactatagtgctgaagtaaatgctgtgttactttcttctatgttagtttttttccgaaagtattttcttttcacggtgttgatttctttttgcatattttaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcattttatcttgctgtcagttttcttgcatgtgcaagtttgtgtttttttaactttcttttttggaataattatattcagaggaagttgcaaaaatagtacagagaagtccctgtaggctgaaccctgtttccctcaattttttcactttgtgttactatggtacagtatcaaaaccaggatgttgacattggtacaatgtgtgtacaaatagctccctaccattttatcacgtgtagatttgtgtaaccatcactgcagccaagatagagaactatcatcatgatctccctcatgctacctttttgtagccatacctactcccaaccaactctaaccctaggaaccactaatctgttcctcatcgctatattttgtcattatgagaatgttatataaatggaattacataatacacaacctttgagattagcttttttcattcatcacaatgctcttgagagccatccaagttgagagatagatatatatatatatatgatcagtagttaattccttttttattgccaaatagtattccatggtattgatgtgccacgtggtttaactggtattgatgtgccatgtggtttaaccatgtacctattgaaggatattttagttgtttccagtttggtactattacaaataaaactgttgttccttaatttcttaaaagtggctcctcagtcactcactgtatagttacggagactaggcatataagttgaattttataagtgtcaaatgttaaatacagacatactgtttactggatactggaggtatttaagagctacagagccctcactgggtcccttttttacatagaagtggcttgatttttcactttggttgaactgacagccagtcagataacagaaacttgttgctgctctcaaggaggaggttcaaagataaaaaggtacatactgttcttttatttgacatctgatcaggccaccttccatactcagtttagagactacggtagttaggttgcatctgccattcaaagagcatggagacctcccaatactaaacagcatgggggtctacaaacttttttttgtaaaaggtcagatattaaatcttaggctttgcaggcagtatgttctctgttttaggtattcaactctgtcatgtagcacaaaagcagcctttgtatgtaaatggatgcttatggctgtgttccagtaaaactatttacaaaaacaggccaaggccagatttgtttcacctgctgtggtttccaacccttggcttggggtattggtacttctaagctttagtctaagggtgctgaaactaggaagattattggttaggataagccaagtactatttttttatttatctgtaaccagtattgtgaaaatgccaggtatagggcaggaaaaaatacataaagaaataaaagaggattcttggtagtacaaaatggtcaagggtcatggagaaagtaccaaagtgttgaaacagtaacaaggtaggacagtaacaagacagaccctttatatatgtagcagctaattccatgaattaaaagttcttatctttatcaaatagagccatagttatatagaaccatataaaatggcatatattactcaggctatgtagaattgagaaagatgttctcggctgagaaggaaggaaacaagacttcatgtttccttcaccagtaaccaaagggccaaaagttcctacatggagacatcattaatcaccgtttaagactgtagctcaaccaagccacattaatagctaacgaagatttctggatgattacatagctcagcagctaaaaacaattattaaatatgccctagtggactagtaaaagccccagataggaaaaataggaagccaataataagtatttaccatgtgtcataggaagccagtagtaagtatttaccatgtgtcaggcatttttatgtcctctgtttctctaaataaactaacctaaggagaaagaagggaatcttaacatttgaatgccttgcttaagcctggaaatactaaaatttaggtggtattatttatatgttattgatgaggaagcatactcacatggttgcctaaggcaggagtccgcagcccctgggctgtggactggtaccagtctgtggcagcattcgattcttataggactgtgaaccctagtgtgaactaagcatgagagggatctaggttgcgcactccttaagagaatctaatgtggcctaccccccatccgtggaaaacttgtcttccacgaaaccggtgcctggtgccaaaacgattggggactgctggcttaaggtaatacctaatacaagttaaagtaaggaaaagactcttaagttatgtcacactaaccttccttacatcattcattgttgccttataattagaaattgcaaagagttaagggatacatatttagtaggttgtgcgaacaggtcttgatcaccaaactaggtttctcagcaccattatcttccaataagagcaaagggtactctatttttctacgggtataatcattggatacaagtggccccttacacacaaaacctgttggaacatagaaaactctgaagaacatctctttgatttttcttttttctatttatgctctgctccttcaagactatctgctatatgaataattaatgctcacttctaccactttttttcttttcacatattgtcatcttttgaacttgaaagatgatgccactatggattactagtatcaattagaaagaaaaaaactatatacaactaatggccatttttgcacattaccaatacttgtttgtcattaaaacccatttttgaagtttgcataataaaagttacttgatttggggcttaaccttaagttttgataacaggtaggctgttccagtaaagtattgagcaccaaataagtacttactaattttcttgtgctcttttttttttctttttttcccattcagtagatagtacatcctcctatgtgttagcagcttttataaacacatcgaagaagagcattcatgaaacttatgttaaaaaaaagttgctttgagtcctttaaatttttttctgtgcactcataagcatatgtgtttatgcctttttaatatgaactatacaaaagtatacgtaaacgtccagtttacagaagaaaaaaaatgcatttacccaataccaatacttcctacatgctactgagctgaagaaatagaatggtcctagtaattggcccctcagtaattgtattttcttctttgcccctaaaaagtaaacactaccataacttttgtgttaatttctttgtttttattgttttatcacacacacacatacacacatatataccatatatacccacagttgacccttgaacaacatgggttagggacacctattcaccagtaacccgaaagtaaaaaatcattacatggagacacatagagtcaaaagtccatgtataacttacaactcccccaaaactactaatagcttactgataaatgattgattaataaatatttagtatgttatatactgtatttttataattaagctatagaaaatgttatgaggaaataagagaaaatatacttaacatttattaggtagaaatgggtcatattataaaggtcttcatccttgtcttcacattgagtaggctgaggagggggttggtcttgcagtctcatgggtagcagaggaggaagtggaggaggtggaaggggaggcatgaagcaggcacacctgcaactttaaagaaacactgtaattcaacttttttgctttttcattttttaaaaaatatttgtatatgatactcatccttttttctccatttgtgtagttttcagtgcctgtatcagaagggtctgtgccatgaaggaagtcaaaagcaatcttgaataatcggaacccttctgtcggatgtctaacatcaatttgtgttctggcactgttgcttctgcattgtcttatcatctggcactggttcagaaacatctccatcaagtcgtgttttgttaattcctgtggtatggtgtctgttagctcttgaatttctccaagatctgtatcttgaaaccctgcaccccccaccttttttgccatgtccataacctctttcatgatttccttgattggttctgttgtaaatcctgtgaagttttgcacaacatctggacacagttttctgcagcaggaatttattgttttgggcatgagggctttcacggctttttttttttttttttttttttgtaacaacaatgtatctttaagtggtgtaattcttccagactttcatgatgttctctccatctgggttgtcttccacagcattgacaattctttccatagagtaccatgggcattgaggcttaaaggtccttattaactcctaattgagaggctcaattaaatgtaatgtgtttgcgggcaagtagaccacttgaacacctttagtgttgaacttacagacttctggttggccaggggattgtccagtatcagaaaaacctaaaaggcagtctcttactggccaggtacttgctgaattcaggaaaaaagcactgatggaaccaatccagaaaaagggttaaagttgtccagtcttttttgtacaaccaaaagactggcaactggtgtttatcctttcccttcaagctcgggggttagcaggtttattgataagggcagtcctgatcatgacttcttgtgcataaggcagtagagttagcctatttcttactgccttaaatcctggtgctctcttctctttcttacaaataagtgtactttttcccagaatagggcagttttgtctgcaattaaaaacttgttcatgcagacatccgttctcttcagtgattttcttaatgtctgggaactcatctgctacctcttacagcagaagctgcttctcctatcttgacactttttaagcccatcctctttaaaattatcaagccatcctttgctggcactaaattctccagctttagaccttcaccttcctttggcttttagttgtcatataatgaccactatgtcttgaaccatattagagtctatagctatgcctttcttataacaatcctgcactcacataaaaagtgcattttcaatatgagataaaaatgtatttcacaaaaagtacaagatttctgtacctgctggcatagctgcagcaatagctttatacatttccttttttttttttttttacaatagttcctacgctagattcatttatcttgaaatggcaggcaatccagatgcacacctcaatttacagcacatatcaagcaattcagctttttcttgtaacgtcatgacttctctctgcttcttgggaccacttccaggaccactagtggcattttttatgggctccatggtgttatggtatggcactaaacgaaaaatacatgagaaccatgaaagatcactttttactgcaatatgcaatttattggagagatgaactgctcacacagagatggtagcatcacatggcatttgaagtggttattcaccagaactcactgcaatagcaacaagaggtggctatgaaagtattacagtgatacagtatgaactacagttaattttatgcatgagtggtttaatactgcatctttacatttgtttacatttctctcgactgggaatgggaccatgtctgtaagtgtttgtgtaagttttgaaaatttttaactttttataatagatttgtgtgtattttatggtagtaaatgataaaatagatgggtagctacatatttttatacattcatgacaactttattttaatttcgtcaatatttctcagctacattgttgtctgtgagttttttcaaactgtgatgtgttcaagggtcaattgtagttggtcaatgcctgtcctagactgtcattttcatttatttatgtatgatatctatctggttcactactgaatccctaatgtctggctcttattaggccctcaataaattattgaatgaatgaatcaatgaatgttcagaatggcataatggaaaaaattggacttgaaggtaaaaggttaaaaaatgtatctttcggaaaactttagttttcttttattatcaggtgatcatgaccaaaatcatgtatttcttattctccaatttcctaatgcgtcaaatggcagtattgactgctttgtgtgcctggctatttgggattaagtaccaataaataaattttaaaaaccacaaaacccagaaacatcatagcccttctctacatgagttcacagtttacgtctgggacagacacatgaacataagataaaatgataagtactactgtatgtgaaaacacttagacttatgaagtgcttctgtaagatacatttcttaaaatggttaaagtcagttgaagacctgttaaaaatcatcaggatattgcagtgtatgaaaagttttataaaagttatctttttcttggtcttgaccccgtcttggtaatagtggaagtaaaaatggagagaggcagatacactgtctcagatgtttttcttcctctcaacttcccagttgtcaaacaaaaagctggacagcatacaaaactattggacttataaactcacaatacaatactgacctcgtgttgtttgccagcctatgattgatcaccgcatatgaccactgttttgctttctagctggtggctttgtgaacaaagcatagcggtacagatatcctcaaataccctcatgtaccttgaagaggtcacttgggtagtaaacccttttggttcccgtgccactaacacaggagcaattgagagcctaaactgggtttgcctcagcaatagaggccagtagtaaaaattcagccgtaaagaccagcagtaagaaaagtagtcaaggtcaggggcaaactatctgctggagtgaaatgtttaaagcttccaatgaggctttaattagattcaaaaaacatcccgctgttaaactgttttgtgtttcccatgcataatttactcccatgcattttaattctcagtgatcaaacgtcctctggaaaagcgctaacttcctggagaggtaacacaaacactgttatgttttgataatttttcatctcatgtatttaataaacagtttgactgttagaatctgcaagaaataacattaatctaaggcatctcctattttggttctaaaaccatgactcttgtgctgacttccatttagtctgatgagattgggagaacaatgccagattgattcattttgtttttaattgtcgtaaagaccattgaggggtgaggagaatgttgtttgaatttgacattttgaactgggaaacagcttggaaatgtaggcacaattccaggtaaataaactaaatatacttatgtgtgtatgtatatgtaagtctaattgcttaaaggtatacctctaagattccaaattgattgatgctagaaggcagctgtttgaggaccagaggcatggcttatatgcaaaatgatatggaaaaaaaataattggatcacagaaagacagtattatttaatcagaatttgaaatctggcagctctcctaggagaataaaatactattggattgcatttatttgtcaacattttttatcttgcctctacattgctccttaggcactgtaactctccaaacagaagggataataatagatacttggtagatacctacttgttcactgtccattcatgcatgcaggtagacaggtgatgtttggaaagtatcacagctgcagtctggcagaaagaacatgattgattccctctgctttcctctgctgagggagtatgcagcttttcatttcattttagagacaaatggtctgcacgggaaggaagcacatgggtagctgtgtctttgttcatttcgctaacaaggccagagctgtgggtccatctctgcataagccagttagtgtttctctgctcctaaccacagatttgcacttgaacctttgccagctgtttcccaagtgcatgccattggatgtgagggagacctgaaatgagtgcagatagattagcttaaaatcatcacaactttttcaaacaaaacaaagcataaagcatgaagcccttaatggcagatcagaagttttatctttgtgtattcaaaggtcaaaacctttataccacatgtgctgctgtcagagtatatgctatatgataggaacaaaacttaagaagctgtgaccaacttgaatattgaaacttttgttatcatttttatctaaaaaaattaaatttttggtggcaagttagtgtaaccagtcctagaaaatagtggttggaatgaggatgatctcattgattcagaaatcatcaagaggtctacaaaaccagtatgcctcctgttttaatagaggacataactagagaaatgttcttagttgtctagctcccttgccctgggatttgtgcctagttctttgaggatttgtaggactcagatttctctaacaatcaataatcctttttattttctttatattttcacttttagataacatccatctatgatcatttatatgattttaagtgagtttgagaacaaccttgtaatgtaaataaggtattagtcttgaagtttacctggttggttatttggcaataaccatttttatctgaccattagtgacttaaacaactctgagaagaataattgacaataaagtggaaaaaaaaagcatagtcctatactaacaaaattaattctaagacactgcattctgttatcagaaaacaatgtgaaagtttagatatcattcatcaaagtttatttttcttaagttataaacttttttttcccttttacagtatctgaggaaaaaaagtaaaataactctctttgggatctctggacagttgaatagacaaggaagaactgtagtctttttttttttttttttttcagctaaattatcctaagaacactctgctccaacataggaatgccatggaacaagagatggtaacacaagatacaccaggagactcgaggttttgtgtgtttgaaacttatattctactataattagactaaattgtagagaagcaaaactaatgtgtgtgttgtttttttaaaatttacccaatgtttttttggttctgtcttctaggagtgaacaaactccttttgttttttgtttgtttgtttgcttgttgttaaatgttcactcttaaattttataaaacaaaattttaaagttacattaaaactttccatttttttgattatatttattcattcaaaatagaaatgccaaagacatataaaggtaaaaagtggtatgcagtgtttttatgtcctacataactgatttaaattagtaggactatttttatctttcaacttttaattttcttataaaagtcaagtaaatacaatgattgttattagctgaatagcagatgagatctcagtatttaaaagaacagatttcttcttataaacttgcttttgattttaattcaagaataattatgctgggttcttacgtatgactggacaaaaaaacatgcggttgtgtgttttggcatgtgttcttccagatttttcagtgatgctcatgacaaccaacaagggaaatttagattgtaaggcctttttctataccagattctaatcattgctctaagaaaaatttcatcacctattgcttacttttgcttgaagactttatgtgtatacatgttgattgatgacttttggtggtggaaaataaggatacgaaattcagaagaataaacttttggaacacaatcaaataatacctgcacaacactttgggaggccgaggcaggcggatcacgaggtcaggagatcgaaaccatcctggctaacacggtgaaaccccgtctctactaaaaatacaaaaaaaattagcccgggcatggtggcgggcgcctgtagtcccagctgctcgggaggctgaggcaggagaatggcgtgaacctgggaggcag

SEQ ID NO: 557 - DNA, 1502 bp, Homo sapiens
agactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 558 - protein, 445 aa, Homo sapiens
MAEYDLTTRIAHFLDRHLVFPLLEFLSVKEIYNEKELLQGKLDLLSDTNMVDFAMDVYKNLYSDDIPHALREKRTTVVAQLKQLQAETEPIVKMFEDPETTRQMQSTRDGRMLFDYLADKHGFRQEYLDTLYRYAKFQYECGNYSGAAEYLYFFRVLVPATDRNALSSLWGKLASEILMQNWDAAMEDLTRLKETIDNNSVSSPLQSLQQRTWLIHWSLFVFFNHPKGRDNIIDLFLYQPQYLNAIQTMCPHILRYLTTAVITNKDVRKRRQVLKDLVKVIQQESYTYKDPITEFVECLYVNFDFDGAQKKLRECESVLVNDFFLVACLEDFIENARLFIFETFCRIHQCISINMLADKLNMTPEEAERWIVNLIRNARLDAKIDSKLGHVVMGNNAVSPYQQVIEKTKSLSFRSQMLAMNIEKKLNQNSRSEAPNWATQDSGFY

SEQ ID NO: 559 - DNA, 59359 bp, Mus musculus
  misc_feature (1)...(59359): n = A,T,C or G
aaaaagcaaagtaggagcattgcctggtaggctaggccaagcattttttagggtctggatgtcctgggttgtccagctctggggagtgaggggcacaggtcagcagggcaatggattctcacctctctcaccattctgattaattttgctctgcactcctcaccccagttttgtgtgcccttggagaaaagcagaggatcaggaagaagctagaaggcatgtggatgaactattggctcaagtccccaagaccatctgtttgcactatgggcggtcccaagccagaaactccctgaatgggattctcacatcccaacagggatgcatagatgtaggatgatgaaggagagtctcatcacagggatgaaaaattatactgagaatcctgctaacaatgataaggtcaggaaggttacataagcaaggacagaaaatcctgccctatttctgaaaacttcagaaaattcaccagcctgaagcacatctaaggatcaggctctcctgagataacatttcatccagcagtcggtccctgcctgacatccatagaaaacttcagttgggaccaaatcattgtattcgtgcatgggtcagattcatctctgataaacctgagaggtggaaggacagaggccagccctgctgacatgcaaaggccagggcactgcacagatgactgtaatgaacagcctccagcttatgtcctgtaagtaatgttgcagagcccttacactagaaagctccttgttcttattcccaaagcaggagggggccaacgaccaactgagggtacccacggaaatagcacccttatcagaaaggcaggcttacagatctcccaagatttaaccttgtacacctacaaagaatagagataaaatatttcttctttgtttgacaaaatataacctgatttaatgaaattgtgtcctgactgctcaacgtaaaattcttaagtaattgtgcatcattctgtgcctaagacagcatggataagactttttctgttcctaaagtttttcaaaataactgattagcaaatcctgtggcctcttcatttttaaattgtatagtaaaattactacttttgtcatgttggattagtgtgtgtgtgtgtgtgtgtgtgtgtgtgtgtgagagagagagagagaatgaaagtgcttgggggatagagtcaaaggcctgaaagttttataaacttaggtactcttagctttctaaaatctatcaaaatggggtctattaagtaatcttcctaaaatcttaatattcttaaatgctatttgcttatttaggacaacatccattgaactataagcgtttaaaactatttttaacaactattgttaattgtgcacatgaatgcccataaagtccagatgtgtccgaaagaccaccttggggatgtttgttgtgaggtgcctcacatgagtgttgggaattgaacttggatcctaggtaaaagcaatttgtgccagtaacattgagccatccctccagctccataatatggaggttttgctaatcaataacatttagcattggcagtataattttgatagtaattttctcccaaaataggttctagaaagaaactaggtttttatttcatttttctttaatagtcaaaggtgacagaaaaacaagaatacctaaaactgctttatgctaatcaaaatatctctaaaaatgtatgttaaaatacttttgttagattaacagtgctagattattttccaataatattcctaatttataaatgataattgtgaaattttttattgatgctgtagtatacatgaaatgatggatatatacgtttgtcaaataactttgtgataatttttctttgtatgatgaaagttacagacaataggatctcagcaattggggccaggcagaaggtagagaaacttttctgtatgtgaagggaaagggcagtgttactgagtcaagagagagagtgtgagaatgagagcgagagcgagagtgagagagcaagagagagagagagcaagagtgagagagagagagagagagagagagagagagagagagagagagagagagagagagagagagaaagactgagagagacagagacagagatagcaataaagacatcaagtctaggattattgttcactcacaattgtgatcttaaggcataagatgtattgccagtctgcctgagctctcctcttttaacaaagcccaatgttttcaagaaccttctgttgtctgatttaagactaaagaaaacaagatagctatctcaaagctgagctgttgatgcctgtccaccatgttaagcactaaaagtaatcaggttaggtgcagagtctctatgacccaaagccttccacttcatttatgtgaagagtcctggctttggaagtccagatattgggttaaggattgtataatgctattgagaaggtaatcagataatggtctaatttaacattgacaaatgaggggctcagcagttaagagtgctgactgctcttccagaggaccctggttcaattcctaacacccatatggcagcttacaattgcttgtatatctagttccagggcacctaatgctgtctgcaggaaccaggcatgtacatggtacacatatacgcgtgcaggtgaaaggcacataaaaagtaaaagatttttaaaaacctgacaaatgatagatgtgaataaaagcttcaaagcctttggttgttaagtctgtccttatgcatggtgtggtggtctgaattaaaatggccttcatagactcacagagagtggcactaacggtggtgtggccttgttggagtaggtgtgggatgggcttcgaggtttcagaagctcaagccaggcctagtgacttctttttctttctgtgcctaccaatctggatgtagcactcttagctacctctctagcaccacgtcttcctataggccactgtgcttctcaccatgatgataatggactaaacctctgaaactgtaagccagtgccagttaaatgctttcctttataagagttgtcttggtcatggtgtgtcttcacagcaagagaaaccctaactaagacacatggttatgtgtttgtgtgtgtggtccatctgtgctcacacaagttaacagtcacataaaactactcagacccaattccaaataatggacctgggattttagaacaaaaatccccagccttggcagctccatagggtacgcttaattgtcagttccattatgccaataaagagacaataataatgatgggcagggaaataaatgttattaatatgggcatgatgggggagaaaacagagatgttttatgaacctcagatctgtcttttgggtatgacataaaattttcttaattacttaattgtttatttattttataacaaggtaccttaaaacctagtgatattaaataagttacctgttaagtctcagggttctatggatgtccttaatgttgtccctgaacctttgttgttgtggaaagtaaaatgcagtgccatcaggttcccggacatcagtgaaagttcttgtctatagtgtcagttcttctctgtgcatcctgtaagtacccaacgaatttgtgtagcatccatttacagcattgcaagatagcaatgttaaatgctgaaggtggagccagatgttgttggtgcacacaacaacaacactggcactggggaggcagaggccggtggatctctgtaggagggatggtggctgccacctctgtgtaaactctggtagctgtgcagccacaaaggcatcttctgcaggaggacctaattgaggacttcctgagagaccaaggattgatgcagacaatgccagccaatcgggaactgctgtttagaggagacactttcttgggaccaatggggcacaggtggagagtattaaaggagcttgcaacagcattcagacaagcttactgtggtgtttctcacctgctcctgagtctgtgtcattgattctgagggtcagcagaaagtagtccacggcccaggcagcagatctccatgagttcaaagccagcctggtctacagagccagttccagggcagtcagggtatataaagaaactctgtcttcaaaaacaaaaacaaagcaaaacaacaaaaaaggatgaaggcggaaactgtaagagttcttgaggccaggctccagaagtcaatgaccagtacgtctgccatactctgtcagctaaagcaaatagcaaggcccacacgaagtcagcatccggacagagctgactggacctctgcaagtaagtagcggtgaaagccggtgcaaagagatctgcctgccaggacgtgactatgaagggaagagctttgtgctaagatgtcacttctgatattttttgactctatctttgggttagtctgacctggattttaaatttaaggaggaggaggaggaggacatgggcagctactgatataaaatatacctgttaaaaagatattttaacagaaattaacttataaattggcttttggtgttctcaaaaaaagagatagaatggaggcagcttaataggtccaaggaaaggcaggtaactatcgcataccttagagaaccccaggtttcagagagaggatgttaaaggggcagtgctcacagagttgtggaaaacaagggccctggaaaagaactgccctctttagagttcttataaacaaggcgttatcccccttgcaaagagggaaatcattgttagggaaaggatggtgccctaccttccaaagggagagtgggccttcagcttcagtgatggcggccattacagacggattctgcctgaagtcccctgaaaaacacctgctcaagccatggtagactgccactggagcaccttgggtaacttttgatgtagcagacaaaaagtgttatttttcttttcaatatcagggctttgttctttgcctgaatcaataaccttgaagtccttactaaacgaacttgtttgttcaaatttctatgtatctaacaaatgttggataaaatatctccaaatgaagagaattattgatgttaatttcagctttgggaattgttccatacatggtccaataacaaggcacaacattgggaatccttacctagaagttagggatcattcagacccacagcttacttctgcagatcagatctgtaacatgtggctgttagaatctgtactctctaggatgtttataaacaatagtagcaaaagcaatgctaataggtgagccttgccaaggttatgaacatcttctgatgtttggtgacactttctcagggtgaataaagacctgtcctacctagattaaaagacccccaaaagtccttatctgaaataaaacctttgcttacccctttgaatgtcacagtctcagtcttaaagacatggctgactatagaaacaaaatgctgaaaacccttattttttttcctctgagggaacagaaggatgtctgtcttatcttcttaaatacaaagatagcccctattttataaatcagtcagcatttgccacctttcgtttggttttcttattctttctgaggtacttttgttatttcatgattactactttccttattctatccaagatttttttatattctcaattatataaccatcagtatacctcttcccaccaggaactcaaggaatttcatctcgagagcaagctgggcaaagatggcttctgggacaatcatgaccatggctttcttggctcttgcctctcatggaaccatttttggtatgatgatgtgactgcttcttagacacttcaaatatttttgacatgtgtgtctttaaatgtgtgaaagttcaaaccaagctcctatgatgcaggccatccaaagccttatcttcccctggggaatcaaataagacacgctgtggtcctcttatcagaatggaagaagttatagatcactactcaccatccttcagcttcatcagaagctctcagtggggaactgaggcaggagagtaggatgaagacaaaggcaacaagattgagcctttgtcttaaccactgcccacctcacaggcacgtctcagatgagaagtggcagatgccctaatctgtaggtttagagaaatgtatttagaagtcagtttgatcacgtgtccatttagcaatggaatggtaggctcatccttagggcctatgagctcttcagccaattttccagctagacttatagtatgaggcatgtttttgcttctgtacaatgagccttaaatccaatcagaaagaattggttgcccccatgattttcatgccactgttgtacccatggctggtcattactatgccttgcagactcacacctgggcaagattatgttgggctgtgaatctgcctcaccactggggtgctgagagcatcaccaacaagctgctcagaggaggcagaacacagcctatgataggtgtcccgcccacgttttgtgtttctccagatgggaaacagggaggtctgggacagatgctgttgttctcaatctcctgtgaaccaagacgccactggggacctcgagtagttgagagtgatctggttctgagtgagtgctgagtgtatagaggggctggaagagagaaggccttctctgagagatttaggcactgtactttacaatgaagcccccaaccgcaagctcctgtgatccttaatgaaggagacaatccttgatggagactagctcttggttgttcaaactgctttattgttatggaagatgtcaatgcacacaccttactcagggtgaaccagtatattaactatctcttgcaggaaggaacagctaggacgggaagctcattgagtgaacattctgccttatctagatacctaactagcatgaagaaccccaggcttttatgctacatgatatgatcatttgtcattgtcctctcagtggggtgacatggtcatgtgttgcaggacaggtagagcctggctgggagctggttccatgcctgctgctctcaattatgagatctcctggggggttttgaacctcctccaaccttaccagttcttctgcctggtggcatagtccacttgccccacaaccttgttgatggcttctctcccccagcactccagaactatgaaagctatccagcagggaaggatttctaggtcagcacaggtggatttctctaagttttgtcatcaaaatgtgtgatatcttctgcaatagggtcttatcaagttctggtgagaaaccaaaagcaatgtcaatagcctgtgtttgaggggtctctgggagtcccaagtccaaccactcaaggggaatatccatacctgtcagtgggtagtttatttgtgacttctggaaagaacattttccacggtgttgggtagctccatttaagtacatatttaagaagtttgtcgaggtttccatgttctcccccaagcatcccaatgttaattatccatttctccacatcttcctctgtcttctcttcccaccccttccccaagtatctgtctgtttgttcctccatatcacctgtgctctgttcagagtgcaaagagcaagtggctgtgatttgttcagacacgaatggggacatctacatcatacgccttcctctaaggttcagagaatatcactgaagaggaggtggggagattgtatgagtcagaggtcagggcagactggggagaaacagtgtcatctaaatatgacaggaccattgtatttacagcagctgtgggagcctgtgtaagacttgcagaagaccaagccagtcaatggtccagcatggagtggaaggggctcagatgaagaccactgactctgcatgggagctattgacggctgctggaggagggggttcccctccccactggggaggtggtggtagagggtgttctctggtaggtcaatcactcattgggtttcccaccccacatgtgtgtatgggccacattaattaaactcagtgggttactgaaaaaaaaaaagagggcacgaaattgtgaagggaatatggggtcatcctggaatataatagaaatacattataggcatatatgaaattctcaaataacaaaaatcttatattataaaaaaccaaaaccaccaacaaaagtacagagctgaagtcctttaagaaagataagcatatgaaagtgaccaatgtcagggcttgatagatggctcagtggttaagagcacagctgctcttccagaagtcccgaattcaattccaagcaaccacatagcaattcatagttgatgctttcttccagtgtgcagacttacacacgtacaaaacacttatgtaaggaaataaatattgaaaaaaaggaagtgaccaatgtcagagactggaacctcgttttcatccatgaccaagaactacatgtaagaaacaaaacatgtctacatgtctaacatataaatgagggggctggcaggcactatgtaaatggctcataaaatgtctcagccagttatcattgatcttctcctgccccagtcttccacgagctgggactagaagggtgtgtcactatacccagaaaaatatcactatctttaaatgaagttaagtattggtaagttaccattaattatagcatactgaatactcaccccaacccccttcccttccttttggctttctctatctatctaattctcttcttacttttgttgtgttgttgttgttgttttttgttgtttttgtttttttaggttttaagacagagtcttactctgtagaccatgctgacctgggattgaccatggaatctgccaacctggttttgaattcaaagtcatcttctggtttcagcctcttaaatggtagaactgaagagataaaccaccatgccctcgtttgagttttaaaatgtttaagttctctagggttctgtctcccaacttctattttctcttaacccatctacccctttcctcaatggtacccaaggtctgactcatctcttccttactggtgactctgctagttatgttcccagctcccattgggttgtagaaccatgttcactctatgactgcttataaatatttccacagcccatctagcggatgtgatggattgaatacgcctaaaccttcagtgtagtcatgctctctgtccacctttgtcaatccctgcttcatgatgtcttccttgcagtaaccatatgatattgatcaccaccatgaagtgtctgtcacacattagataaatatttgttgaatacataaatagttgaatacataaatagtatttttatctttaatgtgtgtcttaggtagcctattagaaaaccagaataattcatataatcacaaagcatcttttttttttttggctctggtgggtagctgcagctcccacagaatcatgcctgccagtattcacactcctttgtaaaacattcccacaatgaaatctggtcttaggacactccaggagctgttgtcatgaatactgctgaccacttataagtctggtgtcctagagcgatcatggtgaaacagtctttcatatttagtcttatttttatgcacctttatctaggactgagggatgattgttagtaagtaatcgggatgctggagttaatgttatacctacgatcagaatgatcagtgcagcttcaagtcaaggcatcatagttctccagcagcccctggaatcgctttccttttggcagaactggtgtagaaactacagcaggcacggttttgcatggatccaacacagccatgccaagtaccaaggaggtgtagagttcctggcaggtagcttaaatctgggctatcctcctcccaccacacgggggcgagacggcgccacagtccgtacagccgcagccggccaggactgggactggggaaacggacttggctctcacaagggcggagcaaaaagcgccggagaggtccccagggcaggaagtgagggggcggggcttgggaaaggtgtgcgcctgcgcggagccggctgttggattccgctcgggctgtggcttcagtgcgcgctcacggtgacggctcggcgttcttccagagcggggcggggagggcggagaggggagcggggcccgggggattcggggaccgcggtgggcctaggccgtgccggacgaggcgaacggctcggtgggtggagctttctggaagtttgcctcccgcctcgggtggtggcttcctcctaagcggcgcttcctccaggcgttgccggtctggcctgtgcgggtctcccctccgcctcgccgctcgtccttgtgcagagcgacacatgctctcctgccccagctcgcagcattagcgcagtcggagcagttccagggagctcattggtttcctcaaaaacttgtattcaaggatcacttgttataatacttagcactcgcggtgtgacggggagcaactgtgctggggcaaacctccgccagaaatgttagtcccagcagatgaaaaccccacatttggaatttaggagttcatcgcctcctagcgtctctcaaggtcttggagccctcttaaaaggatttaacttcataggcatcatcccgagccaagatgcaggggtgcggtgtgacatttggaagcttaagagccaaccctgataacttacttttttttttttttttttttttttaagaagctgtccatcatgtgtacttagctggaatgattattttaaagtgcatgtcctatttttgccaatctgacagctgtttccatagaaactagagaagaaattgtagttttcagtaagagttgttaaaactgtctcctagccatcagcagtgagtgcgagtgagtgcgcactacttgctcattctgagatggcacttgaagaactaagggtttgaaatgttcttagaggctagcaatccaaattgtgtaattttctcacatcattaatttcctaatcctacaagtctgccagctatgtttgttggcctgccacagttctttgaagagcacacgtcagtcccagttcttcttaggtgctgtgtagtgtagtgactggctctttgaaaatgtataaacagatttctttccccattaaaaacattttttttttgaaggattaatcagtgattacggattaacaactacggtttctattctggatggcacttgattgccagtgttagaaatgctaatgattttaattatgtacctagtgtttggagcttttgtttttaccttctatgggtagactacgttaaatatgtttgcacctgctctgaaatgagcacttttctcatgagcagatagatcccagcagttcgaatagggtgcatgacatttggaagagagtttattttctgaggggggatatctatacactagatgttctgtcatttagcagtggatgaaggaggcttggagaaggtgcctttggaactgggaagctggaagcaacattaggaagtttattgaaaagctcacagataaccagtggaaattacagaagagcttgcttggcttaggattcacaaagtaacataccctgtaaacacttaaattgcccagaaagaggaaatactggattcctcataaacaccgttctgccccctgaatttcacgtaggctttttataagacttatatctgtatctattcgtgtgttttgtctttactagctttactgattgggcaggcatttttgtcttgtctttgctttttatctgctacacagagtggcgtctgacttgtagcattcattcctataatgatttatcaatgaattaatgaatcaatgactaaaacaatccttaaccaatgagatacaggaatgtttggttaagatgatcaacttttattaatttggttggcaacattttaaaataggtaaatttcacattaagactgaatttgtagcgtttgcagaaacgtttgtaacatttggcaacataaaaaacaaattttgttatatagttgggcctcctttgtgtgactgttcacatctgcctggccttgctgcagcttgcctgcatctatcacactaacccgcactgtgcagagctgtcctcttattcattttaataaaaatgaagcagagtacaaattgtgctcctcatatgcacctagccacacgccagggctgccatagtggacagcacagggaacattctataggaagtcttatgtagtgttgcttttggcattggactttgcttctcctgttaccctgttggactgaagttttgtttttaaattgtcttgaacagctctgtgactcaagtgctagagtacaggctcgctcttctcagcttcagggctcttgcaggtagtagcacgtcctgctgtttgtagattagcatatcatcttggttatggatcagagcaatgtatcttaattcatttctaaagaaagggtttcttcctgtaggcttggctgtcctgggactcgatctgtagaccagggtggccttgaactcacagagatccctgccagcttgtgcttcctgagtgctgggattaatggtatgtgccaccactgcccacctggtttgatttgccttcctgagggattgctttaggttccttagaggaggggttggtagtgaactaaagtgaggtagttacaatatagtaaaatctctaactcgggggcccaaaagtaggatgagctgggctgaggtagtgaggtagattggcagggctgacttaaagtgacctttggtttttctggatgttaacatcctaaggctaagtctgtatagttgggaacgtggtttgtagaagattgggaagttggagtagggagcatccctcagattgtctcatgacacagttaccatggaaatgttaacttgcacatgggtcttgtacagctgcctcctgccatgggaatgttgagctcatttctaggtaagacagggagactgggtgaagagcaggagctaccttagagagcctctgaagcccaggcagatgtggaaagcacagtagggtctcagaaccatgaaggccttcaggcatcttctgcatgagtcggtagtcagcctgtctcagccctgccttcccctccctgtggtctctcacatatggtaggtacgtttcgtcgtccttttctgtgcaagcctgtgcagagcctttcctcccaggtctagcttacctgccctttgtgtgctgcggcaccaactataggccctacgtgggtctttgtattcatatgctggatacggcgtaatgtgaagttttctctgtgctaagtgtctaccgatgtctttgagaccaatggctactagggactaacatgacctcctggctcattctctaagttgaggtcatgcctggacaagtgtctgagctttgtaacagtaaatcatcagatttgaagggaagaaatgtattcatgtcatttttatagtttgatctctattaaaagagcttaaatatactttcctatgtgaaacagttcaattttttttgtctttctcctaccagtgtcttaagaacgacttctgccttgtgtaactagctagctcactgctttaacacgtggaatttagttataacaactcgaatatccttgtctactaatactgccatttgtattagataggagtcagcttcctttgattaatatttctttaattctgtgaatctcattttctgcttggtaattttaaattgtgaattacatgttgctaaatgtttattttttgattcttgagttttttttgttttgttttgttttgttttttaaatccaagatgtggctattagaagcagcttgatcctttagagtgctgtttctctgggtgtttgttttagtctttgctattggggctagagcagctctcacatccgtgctggactctttggagttccacccaatttctgtgaattacaaatgggaacttttcccactttgatcaatgggagcagatattgcaccctggcctgtgcattgtgcccagaaattatggttctttgcaagcttcagggggatttcttattcgtatgcccagctagtactcagctgcatagggaggcctgcagagaagggaggggcttgcagagaccttgagttctctctttgggttttgtgtttccttctgcccataagctctagctgcctggtccacaggcgtgcccagcatcacaccttcagtttagggcacttataggcgtagtccttctcttatgtgtggtttggagactcaccaaagccattctctggggcagttgtaggttgagtcttgtttcccatcattcagtccttctttgcctaccccccaagtatgtggaaatcctcattttatgcattccctttaaaaagtcaattttaggtggcattaaagtccctcttttcatcctgattctaatcaaaagccccatgggtttattggaatgagtacattaaaagtcttaaagataacatttttttaagttagcctttctatcccattatactcttattactgtcaactgattcacatttgttgttttatcgaagctatttcttattttgacaaatgatttgctgatcaaatagagtgccctgcaactaaaaaaaatataaaatgttttttcttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagccatcatgtggttgctgggatttgaactcaggacctttggaagagcagtcatgctcttaaccgctgagccaccttgccagcccctcagcatgtgtttcttaagcattacattcccagtttgtaaatacatgttttccacaggtgtttatatcttatttgtgtgtgtgtgtgttctagataaccaagcaaaagaaagatgagcctcctttatggactgcagtctaccaggataaatcggtttctctctggagtgaataacctggccaacaggagacagtggacccccccagcaagctgtccactggcaccaaagctccgagcagtaaatgcatactggggactgaacacagtcagtcattgtcattcagtgaccttactgcctagaaactttcttttctgtaggactctcaatcacaaaaaatcaagatgcctctcaagtgcccaaagcaaggaattgggggtgcttacctacagatgtactgtgcggggtgattctgttctaagacaaggagcaaggaaagtggctggcgttcctgctctcgcggcctcctgttctccaagctgtcctgccgtaatagaggcccggagtttccgtacatctgcaagggttcaggctgccccagtccctctcttgctgctcattctgaagccagtgcaaaagctccttgctatcatcgtgggcaggtaaatatactttggggggaaaacagtgtttgtgttaaagttcatgaagttttatgttcacatgtgtatcaacatataatactttttaataattaaactttagtatttataaaactacttttaaggaaacctttccctaggccatatttagctcaaaatttaaaggtaaattctatcagtcttgtgtgtatgattttaataatcttgaaatataatttgttgcaaattaattgtgcacaaatgtgatccttaagttttgttggttgagatatttctaaaagatttcacatttctaattataaggataacgggcaatattgacaatgatttgtgtaacaacagcacttaagaacattgccctttgattttgtggaattttaggcagttggcatgaaatgaaggacttcatttatatagttaggtgctcagccttagccacgctgataaagctcacaccaccattctgttttcaggggatttttgtcacgtttctcttggtagtcctttctaactgtgcactttatatccaagtggctatttctcaaccccttttccttagttcatgaaggctgaagaaagcaaatctgtctcttcataaagttttgctaagttggctaaatatgccgaccctccttgccagactaacaacccagtctacttttattcaaaatccaagactttctctgtaatgtatttaattctgttgtttgatgttgacagaaaatgggtatctacgttggctcctgagaaacaaactcatcctcacttgtaggaatgattgctttgtgaggtctagtcctataaattgtttgatcttggtgtcgatcttactattatacatttcctcttataatctgttacacatatacttaagtaggcagtgatgctgtaagtgttgtagtaggaaatgagtatacttcattgttttgtggcccttctggttcagtcgctttctctgtgttagtcggcctcggacactatgatgaaataaccaagataataagggagcgaggacttattttggttcatgctttctgagattttagtctgtggttgcataggctgggctcgctcagtgcctggtgtgggaatgcttggcagaggagacttgtccatttcatgatggtcaggaaggtaaaggcagaagcaggcagtggctggggttctaatagcccctttgaggacatctctccagagaccccacattctcttactagttcctgtttcctgtgggtcataccactcccagtagtgcaacaggccaagggccaagcctttgatattgaatacatagacttttggtggatacttccaaatgatagcagggacttagtaagattgtagtaacttcacaaaattgttttgtagaatgaattcttgtcaagagaaatttcacatatgtgtgtgtgcatgataaattttaagacttaaaaaaagtgtatccacaaggaaatgttttgtcaaaatgttttcgtacctagcctggcactttagagaaccactgtccactactgccagccagcaaggccctccccagatggcttctgtaacagctcacttttattactctggtacttcacctcccctactcccccaggacggtagtggggctgctgcttctgagcagggctgcttattgtcggtcagtgctgaggtagtgcctccggttccttgctggagcctgaggagccagtgggaaaggtacagtttatcctccatgactccaagatgcttgtctgcggacttcatccttgttaagtggtcagtctgggaatggctttccccttggctaggtttttctctgtaacaaggtgttagaaagagcacacgcatagtgattaggcagcacttagcatatggtaaataggaagtgttattagtgggagttgtaacaacactgctccttattctagggttttccttcacattagcaggtgtgggaaagccttaggagttttaattatcattttgtagagtcgatgactttccattctctagctgagagttttcttagttaaagagctatgtgtacagaagcaaaggtggaaggggttggttttggtgaggtgtgagcatgcacttacagacgggccatttctgatttgtcacaggggcataaggaaatggtggcaagcacttccccctaacaagaaggagctatttaaagacagcgtgaggaagaacaagtggcggctgcttcttggtctgagtgcatttggactgctctttgtagtgttttatttcactcacctggaagtgagccctgtcaccggaaggagtaaactactgttagtgggcaaagaacacttccgacttctgtcagacctggaatatgaagtagtaagtagtgagaattgtctgtaactacactgcacaagctaacacacaaagcaggaagctttttaacatacagaagatacactgcttttagttttagttttgacacattagtcatctcctccaaggtctcccattgggaaaggtgtttgcacgtgtgcatggctgtcctcccagccagccggctcctgctgtgctgtgcttgtgcgtcatggtggtcccactcaggaaagccttcccccatgctcaggctggatccgactgcgactcagcccgtagagctgagaactggacttttgtggtcttgttccgtgcttggcaggactgcattaggtcccagctttccttccctttgtcttctttacattatggaactttccgtggtctgtgcccttctccctttttagcctaagctctgtgggaccgacaaccttgttggtttgtttgttctaggatctaacaccatgcaaactagtgcttagtttttatgtatcaaataagtaaacatgctgtgagaatttatatacctcgaaagtcaggtataagatagttgtttcccaaaagtcagttttgactgaaattttattgtattttctgccaatttttttcttcttaaaacagagttttgctatgtagggttggcccctcaacctgtgacccttatgcctcagcctcctaagcaataagctcgctggtatgtgccccataatcacttgttttctgaatagaaaataatggtgggattcagaaatctcagctcgtggagacatacagtcacaatgtgttctcgtgtgtcctcaaagatggacatcattgtgttttagtaattacatccagggaagtgctggatgctgttgttgaatgggtaatggcttcgggtcttcatatgcttgggtacaaatgaacacatgaacttagcaaagttatcactaatagcaatgacttttttgctataaaagttgatcttaactaagataataattagaagaatacaaacaaatttaaactatgtcttaaaatctagtcttaataggaagacaggtttgagaaaaacattttggtaagattggaacaaaccttgcaaaaattttgaagtatcttctactattcagatagtttaaaatacatgcagatatgaatggatttgcatatatgaatactgtatatatacacgtggatctgtatgtatgtataagtgtgttcatatgaatagacatttttactgcttaacttattggtctgtgaatttaaacatcttatagagctgttataaagtactctaattacatggggtgcaaactagtatgctgtcaacttgacacaaactaaaatcatctgagaggagagagcctcaactgagaaaatgcctgcataagattggcctgtacatagtcaggatggggcaatggattgatgaatgattgacgtgcaaggtccctgctcattgtaagcagtgccacccttgggtaggtggccctggggtgtataagaaaatgaactaagcaagccatggagaccaccaggccattcgtccatggtttctgtttcagtctctgcttccaagtacttgccttgagttcctttgatgattgactgtggactgggagttgtacgctggaataatcccttttctccccaagtggttcttggttgtggtgtctgtcacagtaatagatacaaactaagatacagataagagtcccttgattgttttcgaagagttaatagaagacttttctttacaactgttaaattattctttaaaatgataattgatgtagtctttaagttcatattctatgaagtcatatattttaatgcatcttaaaaaggctatcaacttgatttgaatgttaaactatatagtttatgaaaattaagtatttgtagaatattcttaattttctcagtatatatgagagaatctctcacaaaaagcttcagaaaaagnnnnnnnnnnnnnnnnnnnncctcccttcctccctcccttccctctcttccctcccttccccttttctttcttctttccttccttccttttttggttcttttcttttttttttttttttgtttttgttttttcgagacagggtctctgtgtagccctggctgtcctggagctcactttgtagaccaggttggcctcgaactcagaaatctgcctgcccctgccttttgagtgctgggattaaaggcatgtgccaccacgcccgggcttggcttggcttggcttggcttggcttggcttggcttggcttcgcttctccttctccttctccttctccttctccttctccttctccttctccttctccttctccttctctcttctcttctcttctcttctcttctcttttcttttcttttcttttcttttcttttcttttcttttctttctgacactgggttcttagtatcccagactggccttaaatttactgtgcagcaggcatggccttatacttgtaatcatcctggttcctggtcttcagtgtttggaccacagggatgtgtaagcacactgggtgtatgtagtgctgagaaccgaactgtgttcttgtatatgctatgagagtgagcacttctatcaactgagcttcagttttcttttttttatatgagattttttaatgtgagatctagtcagctttattttctgaagttcttaggaaagtagaaatagttcattttacttggcatgtagactaatagaaaagaataaaacttggattgaagcatgtttatataaaaaaaattataatttattcctatgtgagaaaccatactgctctcccatgaataattcaaatttcagaaatttgagtgtttaatatatgtaaatttttgcacagttcaagattaaatgcccaatactcatcagatacccttccatgaggcagcagaagcattttgtagtgaaaaatctcttaatagtactttttaaaaaaatcttctagtggatggaagaatttaagaacgatctgctgcctgagagagacccccgctacctgactgtgaaagaaatggtttatcatctgacacagtgcaatcgagacgtcccggggatctcggagaccaactgggtggttcatgtggttgactccccagccgtcaatgcctttgtgctcccagtaaggaaattctttatgcacgtttgctgttgttgctgctagcttgagcgtctttgagttttactgtgagctaattgcttatcctgttctctctgtgcagaatggacaagtgtttattttcaccgggcttctgaatagtgtgacggacgtgcaccagctgtccttcctcctgggccatgagatcgcacacgcagtcctggggcacgccgtgagtaccgggatgtgcagctgctgaatgtttgctttgatattagcaagtggaatcctttaaggaacacagtcttttcttctttcaatttcttcttcttcttttaatagatgggacgtaattgccttattctgtacctgaaaaaatgtgattagctgatttcgagaatttttgcagtctttcgtatatgatcctgaataattagtgtttcccttaaatactgtttttatcacctgtctcttttgctaaaaagtaattagtctcagactctaattatttcactttaagttttaaatttccataattattaacatacttgtaaactagtcagaaaattaattgttgtaaagttatactactatttaagtggtaaatcagttttattcttactattttcacatgatggcttggaatgttgttggaaatgcctaaatgatatgcaatatggagttaatgtggaacagtaatgacatgggccgattagtttacagaacttcatctagtatgttccttctcattcagagctttaacttataagtatgtatttatcatccctggtttttaatattaggaaactaacatttgaaacgactaatggtggccatgtaggttttaataaggatgtaaaaatggatgtctttttgtattcatttttgattgctattcattaaaaatatgaatgaatcttttatgtatataactagagaaaagtatattttttatttttaatcagaacatgcaggtaaatatttgtgaaaggattagtgcatgctaaataataagtgcaaatagtataaacttcaaatggaaactatcgtgtttattattaatcttcctcaaagtcttttcaaattctacctatcccttagaggaatagtaagatgaggtgggccaatgttgttcttttttgaagcatccctgatttcttttgatctacaggaaaaagaaatgtttcctaaatagatacaagaataaatctaagccatagaaatagtatcattatactgtgttctaacttctctcaaatactggtgtcataaacactggtgatgtactaatgagtgacacagagactttctcctggtttgacaagcatgggcccatgcttggtttctccactctctccctgtgaacttggtgcttagtgtgcatgtgtgtgtgcgcttgcttgttatgtgcatgcatgcatgatattatatatatatatgtgtgtgtgtatatatatatatgtatatatatatatatatatatatatatatatatatatatagagagagagagagagagagagagagagagacagacagatagacctatctctccctgttacctgtgtgtgtttgaatctgtgctgtgtctctgtttatgccagcatagcaaacaggcgctaccatcctatatctacatgttagtttcaacatttatagggcattttcggctgctttcaacctgttggctattttcagcaagcgatcacaatacatacacacattattctgggtctggcatagaaagtaacataatttaagattaaagctatacattagttcagattgtaaaagctgaatgtattagaaattcaaggcatagtaaggttggttatattgcttatttttaaaaggcaggttaaacttacacagtaggatagcaggttaagtatgtagtgttaaatgaccttaaggcatgttcttttatcaaattgactgtgaggtctagaaaagttcattctccttggggtcaagagcttagctttggctgttgtagctttaaaatgtgttaaccattcccctggctcaatctctggcatccagcctgggcctgctgtcagtggaaggtcaccactgccaccagcgcaaggtggcgctgatgagacaagggaggcagggagcagctttaatggaaagcagttaacattgagatgacaaaggctctttgatcaacgcagtgttttctcttttggaaatcctagttttcattaaatcagctattatgctgtttcctttttctacaaatagacagttctaaactctttctaacttggtgtggtagtccatgcctttaatcccagcattcaaggaggcagaggcaggcagatctgtgtaagttagagtcctgcctggtctataaatcaagttccaggatagtcagggctacgcagagaaacgcagagaaatcctgtcttcaaacaagcaagctagcaagcaaacaaacaaaaaacaaagccaaacataaccaaaaaagtttttatttttgaagactaataacagttagactcttaataaccatagcaagcaaggcatttctcttcataaatgctttgtcattttgacttcagtcttttgtggtaaaacagttcaataattattttacagctaacagctgttatagtgtgatagttggttctgtgaaagattatattgatggggtcctagtctgactttggtgtgtggtgagtaagcccatgcatttaccttgtattaggcattgttgtgcagaatacactttatatagaccttaactggttagtgctgtgattctgcccgaaactcacagaatccagctctcagtgacaaataccaaacttacacaattaaaaacttgtgtcattgtactacgcctttatgtattaggtcataaccccaaaacttttatgtaaagtaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataagtgcaatgaatacttttatttgatttgtagaatatagtgtctacattacataccaaaatagccttggcttggatttttggtccttttactaattaatagctgtgtgaattgggacaatcaaaaaatttccatttccatgatctatgaaatgaggcttattgaactagaagaattgttgtatctgctcatataagaaactgtagcttattgtcgctgtctttggcgatgaataattagctcggtgaaagtggtaaactgtcataaaggcataaatggctcatagcgtgtaagcaaagaaaagggacattccaggagatggcttggatgtgaggggagaaatttgggtctttggttgctgagatggctcaacaagtaacaatgatgccccaagcctgacacatgtctgggcttacatatggatgcagagaactgactcccacaagttgtcctctggcctctttgtactgtggcgtaccgtgcccacatatatgtaccacaaaaaatacatataacaaattaaaaaaatcaatcttggcttgtgttggccagttgagcacacaaaattatttagtatggctaaatagtgtctagaaagtacaaatatgtactgtctccatttgctaattgtggctgtcattattttgattattcttaggcagaaaaggctagcttggttcatttactggatttccttggtatgatttttctcacaatgatttgggccatttgtccccgagacagcttggcagttttgggccagtggatacagtcaaagttgcaggaggtaagtctgagatggtctgtggtgagcatgcaactctgttcgtgtgaagcagtgtgcatcagaatttaaagtctgtcctagtgacagtactgagtttagtgtctgctctaccctataggtgctgctcccttatagcatttaattaagaaatactacatctgtgtgatgatttttaaggattgattaaaagagctactgttccaactttgggctaattaattttcttttttaaattcatagttgttgatattacagaaagaaagcctagtcagggctcccttctctttgttctgtcactgacctacttgctgtcagtggagttgatggggtttccccttatgtataagtagttgctttttaaaataacagaatcataagagtcgatgttaacaagggcagtgtcgttgtttttctcttgaaacactaaatgagccccacctcttgagcacggcttttctatgtaataattaactggggatgaaccaggggttccgctagtgtggattcttttctgctgagctgagcccctcagtgactgttgtcaggagatgctgtttctcttggcaagcccttctcaccatgctttgtgagcagagagggatgctgtcagcgctgcactgtggagtgggaatggctcacattccttgcctttcacttacgtggtggctgctacactagggctctgttaaaactaccaatgttttgctctggattattattgctgtgtggccttgtcctggtattacagggttttttcttgcatatatggcccctactcagtagatgtccatttatcttgctctccacagtgtctcgatggcttagggtttagagcctatgttcttcttacagaggagctgagtttagtttgattcccagaacccatatggccatctgtaagcaggggattatatgccctctttgctttcttgtgtaccaggcatacgcacggtgtacttacatgcatggaaaaaccacttatatgcataaaataaataaacctaaaagtaataattaaaataaatgcctctgctagatggcatagtgatgcacacctatagtcccagtacttgaagagctaaggcaggaaggaggttttcctgagttcatgaatttgagacagcatgaccttataactccaaacacaactatctccaagagtcaaaatcacctatctacccggttatccacccacccggtcggtcagccaccactcactcactcactcactcactcactcactcactcactcaggattgaaaactactttttaaaagcgttttgtgtagtaccaggcacaaagtaagaactcagctaataggaatgattattttatcattggctcatgtaatactctgtataaatcgaggagcttgttaccgttgttagcttcgttttgcatgttgccctgtgagttcttcttgttaccgttgttagcttcgttttgcatgttgccctgtgagttcttctgttgaagctgatgcgctatcgggttagcacagtcggtggcacacactcagcctgccctgagagctgacactctgccatgcagtgcttcagctgaagcagatgtagccgagcgggaaggaagtcatgttctgtgctcacatactgtgaacagcagtttaggttgcttgtatccatagcaagtatgttgctgggtttggaaagttgctcagtggataaatagctcctttttaaaaagttctgcttatcaatccatctcctacaaagttttaggacttactgcaaattaaaatttaattggaaaacatactcataaatataagtaattaggaaaattaaagttaggatagctgtgtttttttaaaaattgaagtcaagaaggaaattttattttactaactaatcaatatttagaaaaggaaatgaagataatccatcagagaagaacctctgctttgtgattagtttgctcactgaagttttctgctagtgtgactggctctcatatacctacattttctcgatttccctttagaattgtgacagattaacgtttcttggccatagttaagcttgcaccagtgtgtgcacttaggcagctctctgttcagtcatggagaatatgaatagaaaaggaaagaaacaatggcaacccaggctgtgggggaaggcaagggcctcatgttccctattgtcatgtttaaagtatgagtctaatggcagaaacaaaggccacatttacattttataccttagaggacagagatttcatactagattttcagtgaaattagtttaacatacatttttaaattcctttgatcatgaaatgaatttgcttaatggagttttctgtcctgtttcttcttagtacatgtttgatcgaccatacagtagaacattggaggccgaagctgacaaagttggactacagctggctgcaaaggtaaagtggacagtagctcaaatacagtgtccctcatacagttgacaaaaacgtgtgctgttttaatgtttggcccaagtgcaggccaaacattaagacatgtactgtgttaacccattgtaagactcatctttataatactataacaaaatgctggacacagctcagttataataagaagaggtttgtccacaggtacggagattcagaggcacggtgattgcctccattggttcagttgtaagaatagaagagggtggcacatgtcaagatcgtgtgtagaagcaaatcagttacatccagacaaaggaagagaaaaagagagtacagtcagggaggcacagttccctttcaagggcctgtccttgccatctcccataggaggttggggctaggcctttagtcataatggaccctttggggctacttagatctcaccaagccatagtacttttaatgtaattttcataaatctgtaatatttgaagattgtatctcttaaaggaatggatgaaaatattcaactctcttctccatatgaggctgtaattggtattatatattaaaagtcctttttttcaataatttatttttttattcacttacatcccattgcagccccattcctcctccccagtctctcccttagaaattcctctccccattaccttcttcccttctccccagagaaggaaaagtgcccccttaggtaccacaccactctgggatatcaagtcccaggaggactaagcccattctcaccctctgaggttcagccaggcaggggatccaatggcaggcaacagagtgagagacagctcctgctccagttgttaggggacccgcatgaacaacaagctgcacatctgctacaaatgtacagggcctaggtctcgtccacacatgcactttggttggtggttcagcctctgtgatcccccatgggcccaggttagtcgactctgtaggtgctcttgtagtgtccttgacccctccagcttgttcagttctgtccccactcttctacaagactccctgagccccgcttgatgattggctataggtctttacacctgttcccatctaacgctggatgaagcctctcaggagacagttacactaagctcctgtctgcaagcatagcagagtattactaatagtgtcaggagttggtctctcacatgggatgggtctctagtttagcagtcattggttggccattccctcagtctctgttccatctttatccctgcatgtcttgtaggcagggcaaattttgggttgaaggttttgtgggtgggttgttatccccttccctccacgggaagtactctttggctacaggaggtggccacttcagactctatattccatgctggtaggaatctcacttcccaaagccttctggtcccaggcctccagctagtcccagagatgctcccactgatatccattctccaagccctgtcccgcccctcaacattgccaaactcagtctgtgaggccacaggcaccctgatacctgaaccacacaaagactcaacaaagaaagagaatttcagatcagtttctcttatgaacattgatgtaaaaatactcagtaaaatacttgcaaactgattccaagaacacatcaaaaagatcatccaccatgatcaagggcttcatcctaaggacgcagcaattgttcagtatatgaaaatccatcagtgtaatacaccatggaaacaactggaaggaaaagaatcacatgctcatttcattagatgctgaaaacgcctttgacataatccagcaccccttcatgttaaaagtcctggagagatcaggaatacaggggacattcataaacataataaaagcaatagccgacatcaaattaaatggagagaaacttcaagcgactccactaaaatcagagctaagacaaggctgcccattctctatctatctcatcaatatagtacttgaagttctagctagagcaataagacaactaaaggagatcaaggggatacaaattggaaaggaagaagtcaaagtatcactattcacagatgatatgatagtatatataagtgacctcacaaaaaatctgtcagagaacttctaaacctgataaagaacttcagcaaagtgtctggatataaaattaactaaaaaaccaatagctcttctttgtacaagtgatagatagacggagaaagaagctggagagacaatacctttcccagcaggtcgaatcatataaaacaccttgttgtatctctaaccaaacaagtgagagacctgcatgacaagaacttcaagtctctgaagaaagaaattaaagaagatctcagaagatggaaagatctcccatgctcatggatcggtaggattaatatagtgaaaatggacatcttaccaaaaacaaaatggaattcccatcaatattacaacatgattctttacagacctcgaaagagcaattctcaagttcatgtggaaaaacaaaaaaacaaggatagctaaaacaatcctgtacaataaaagaacttctggaggtatcgccatccatgatttcaagctatatataccacagagcagtactataaaaaccacatggcattgccataaaaacagacaggttgatccatggaatagaatcgaagacccagaagtaagctcacatacctatggacacttgatatttgacaaagaagatgaaaccatacaatagaaaaaggaaagtatttttttagttaaagtctaattgttattagatataattttttgcatgtatgaaatttttggttatagaaatgaagtatgcaaattaaaactttaaaaacataatggatatataatgtcttcggcccttattactctgtgtaccttctgggagggcagtgttgcctctgtcctatactccttgtttcttggtcctaaggggctttgagaggacgggaccatgtatagctgttttccctcacttggagaaggttagacctattgctgtcgggattcaggctgagcatctgagtgtctgcgctgagatgtgctgtggagaacaagtgagggctgctggggcagctctctgtgagctgcagaagtggccctcaggcttcaccggattcgtgctgtttctctgttgggaaggaccaatcctacctaattattattttaaccacctgtgatagctcagttatcattattagtagaacattttttaaatgagtataaacatacagtttatatattaaattaaattatcatttggctctttgctgagtttccggtagctattaattattaaaactcactattatttaaacttctcattgtgaatattaatgaatttggctctgtaaatgatattacatgtttacaaaagtaaaagtgttccttggtgtgtcgagtaggatcaagtgcagtatcaggctgcatgcagtaaggagttaccaagtaagagacagagagctggtctgtgtgggctactagtttgacttcactgtctgtcaagtttccctttaagcatgttttgtgctgtggttaagaaactttgatttaccttagtaaattgcttgtgttttatttctacgaaacttcagtaatattagttcttttatgtcacatgcagaagtgattgaggtaattctgttttctctgtggacagataaaatactcagccccaattatagaaagagtagatctgggggcatagagttgtaatacctgtaatttcagtaccttggaggtgaaggcaggaggagcaaaagttcacgctagcctgagctacattagaccctgtctcaaaagagttatttttgtcttagcagttaattgccactttggagatttgttcccttgtgactagtcattcatccatagcacatgacctctgtagctttgtcatagtcggtacagcaaatagctctgttctgtaatgcagttacgtaatggacttgatgttcttggatcttcacattcttgtttacatttcctaacggtctcactaaattatatgtccacatgacactggcccgagcattggatgggataggtggccagtgcctaacacactgactttccccatctaggaacatgatgtgtttgtcatttatttagttgttctttatagaaatataattgactcatgtaactgactacctgtctgcttccctccctcctgccgtcctcccttccttcccaatcagtgtttctctatcttattactagtgtaatattcagataagttagcacaagctgataacaggcaactttgtcttccctatctttttttttttctggtttttcaagacagggtttctctgtgtagccctggctgtcctggaactcactttgtagaccaggctggcctcgaactcagaaaccgcctgcctctgcctcccaagtgctgggattaaaggcgttcgccaccacgcccagcttgtcttccctatcttataagaggaaaatatctgcttttttcctcagctctcatggttcttgtaagctctcttagagaccgtattagctactcttgtggttgctgtgataaaacatgatgaccaaggcagaaggaagggcatatttgggcttatggttccagagagtaaagagcccagagcatgctagtaagcagcaggtggggcaggggcagggggcagggggcagggggcagggggcagggggcagggggcagggggcagggggcaggggcgacagggacagggccagggaccagggcagggccagggccagggccagggcccgagagctcagctagaacgtgaagtggagagagccacctggaatggctccaggcttttcatctccgagcccccagtgacacagtttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctctttctccacatccacaccagcatctgctgtcacctgtagtttttgatcttagccattctgactggtgtgaggtggaatctcagggttgttttgatttgcatttccctgatgattaagaatgctgaacattttttcaggtgcttctctgccattcggtattcctcaggtgagaattctttgttcagttctgagccccattttttaatggggttatttgaatttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttgaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctgcacgataacaaccagttgtgccagcaccaattgttgaaaatgctgtctttcttccactggatggttttagctcccttgtcgaagatcaagtgaccataggtgtgtgggttcatttctgggtcttcatttctattccattggtctacttgtctgtctctataccagtaccatgcagtttttatcacaattgctctgtagtaaagctttaggtcaggcatggtgattccaccagaggttcttttatccttgagaagagtttttgctatcctaggttttttgttattccagatgaatttgcaaattgctccttctaattcgttgaagaattgagttggaattttgatggggattgcattgaatctgtagattgctttaggcaagatagccatttttacaatgttgatccagccaatccatgagcatgggagatctttccatcttctgagatcttctttaatttctttcttcagagatttgaagtttttatcatacagatctttcacttccttagttagagtcacgccaagatatttctaattataaaagagtattgtatgttgtaacatgcatttgttgaatttattgagatggttatgttattcttttaatctatgaatgtggaaaactacattttttaagttacgctaaccttttatttctgaaaatatgtatgtataaaacgtgtgtgtatgtgtgtatgttgcaagcatttcctctcattctatgggaacttttagctttttattgggttcattttgaagaacaagagttttatgtttttctgaagtttaatttttttactttggatttaactattgttataattttctaagatggagctcaggtaattaattttagactttcttgttcttaacacaagcagttaaagctaaaattttcacttcttattattttacctgaacttgaaacattttgatacatattttcatcatcattttagtaaaaatgtttcccagtgtcctttgtagttttcttctcttatgtacagcttgttttaattcaattgatgtctagatatttggagtttgtataaatttttttttatcattttttatttctaatttactttcttgcaagtcaaagagcatgcgtgttaaatcttaatctttgtgctggctgcttttatgtcaacttgacacacgctggagttatctgggaagaagaactcagttgagaaaatgcctgcatgaaattggcctgtaagaaagtctgtatgtatgtagtacattctcttagtgatgtgggagggcctgtgggtggtggtcctgattgagtaagccacgaagagcaagctagtaagaagagcttctccatggtttctgcacccgctactgccttgagttcctgcctaagttctttgatgatgaactgtggcctgagagtgtaagctggacacccttgcttcctaagttgctttgtcttggtgctatcctagtagaaatctaaccatagaaacttgctttggaggaagaagcccttggcctctcttggtgactgcgtgttttacagtaactcagtgggtttttatgaataaatactaggctaacttggtttactgtatcattcaggttaatatgctgatctttaggaagaagagtttaaaatattttaactataaatgtagacttgtgtgttagcttttgcctcatgtaatttgaagactgttttagacacatatttgggattttttcctccttttgaataatttaatcattttgaagtacatttatctatctatctgtctgtctgtctgtctgtctgtctgtctgtctatctacctgattcagggcactatgactctagctctggctggcctagaatttgcatggaatgcactcgcttcccaagcactactgggattataagcgtgtgccaccacacctggcttctttttttttttttttgtccttccttccttccttccttccttccttacttacttccttccttccttccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaaactgacatcggaagctcaaggacagtttattagagtttaaagcaaaacaaaacaaaaacaaaaacccagggcaggccaactgtagatccgggtgggggtgggggaatgggtggagaaagaaaaaaaaagctgtactgcctcttgggcacagaggtcagacacatggtggacaagcagccacagaggtcagacacatggtggacaagcagccagaggtaaggatgggtgcttccttttaggtttcagacctgagacaagggactgaggtgcatattttacaccaaagcagacctggcctccagattctcccagcatccctcagtccctgcctggcatgccctgccccaaacctgaactttgcagcccaggggcagggctgtcttccctcaggagctcttccctatataagctaggcattttagtctctccctctctgtcttgtctcctctttgctctctgcatgcacacccctttctttcgttctctttttctctctacctcccttcccctctccacccccttttcccatggtgacttctctggccttggtccagtgaactagctcacccaagaacagcttcccaataaacaaactgccttaatataatctaatctgacttaaattggctcatttcacctgcagcagagaaataacctatctcttctgagaaagagtaaggaagctcaaatatgggagaagcccaaagtgttagaaagcatacctagaaaagagatagaaagaagaaagaaattatgttcttctgaataaattggaaaagcaggcagatttgtgaagccactggatgaggacaagagtcctgggaaggagaagttcagtttatccttaaaggaccaattattctgctttaacaaagtgagctaccttcttaggtgcaatcccttggccagatggctgagctggaccaactggaaggaggaacctttgccttggtattttacatgactgttgcaggggatagattgtttttctggttctgttaactcaagacacagtcagatttttgcaatctatgtgcacatgctgtctcaacagttttctttagtagggtattgcttctaacacctcactgtctcctggaaatggtcttaggtctagccactgatcttatgcatccatacattgttctgtaccaggggcacaaagggtcataaaggggaattagggaatgtggaaaaaaaccaaagccaagttttcaaattagctctaatccgaagcgtagcaggagcttaaagatcagtggactctaaacagtttttcagaaatatcatccccataaaggagtctgtttaaaaagtaaatttctcatttgctgatcttcttcagccccacggccttaccagcttcctgtttcttctcttcctgctagatgccagcgtgggctgtgaggcagcctgtcagtcctgctctcttgactgtaagcatttctccattagctttctgtcttccatctgtgaacccagcatggccattgctccagaagcagggagagataccttaggaatggttaatcttagttcttctacagttttcagtgttaaattctcttctggcttctgggtaatttatagtttcctataattgttaagtaatagctactcctaatcaagattttagcgttgttctgttgtaagatccctgtaaccacacttccttttccactactgaaagctgacctgcttttgcagagtatttctgtgggacacaggtgtttctctccgcaggtcgatgatggcctttgggcacttcgtaatttaactgtcctctttgagatgccaccctgccgtcctttagtcacgattgctaagcttgcatttttgggatagcattggaaatgtaattgaagaaaatatgtaataaaaaaaagaaaaaaaataatttgaattaaaaaaaaagaatgtgcagatggtgtggtgagcctgtgctgtccttggttctgtctccccggtctggattctccccctcagtctttacctttatgagttacacacaaacactatggtgagtagacagcagctaactccttttcttagttacctcactaatgctccccccataagattctacagtacgtggtttggggagcgttgatggaggatgcacagctgggaatgttcaccattgccaggttcctaatcagctataacaaagggcaaagcgacccccactgagccaggttccaggtctctagactcagtgctagtcattcttcctccccaacaaacacctttgctctgtttttactgtccctcttgtccccatgtttaatcattaacaaacatttagatcatttctaggaattactaacattgtaaataattttggagaagacattgtattcatagatccttaaactccatgagtatttccctccctccctcatttctttccttcctttctctttcatggttgcagtttccaaagcatactaaatgtgttgtgccgtgtgagacttccagttgtgataatatggtctgtttatgtcaagcacaaagaaatgttgctacagatgttaaatctgtctttgttatgaaacactcaggatgaaaaatgccatctctaaagtacaagtatttatttcctgtcaaaaagagaagcagtatgaaagctccaaatatagtatttatgctgcttttactctgtgaaagcatcctttgagataatgtcacctctagttccagttactgcttgtctgccaggacttcgcgtggtgcttcgggtgtgctgcctgctctgactctgtgaagtggctactgctgtcatcattggctcctctttacaagtgaggcccacacaggttgtgttagcttctttgttaaaaatacaatggtagaagttgtgattcaaacagcaatgggacagagatttgtttattttgaccggctcattatggaaacatatattctgttatgacctacagtggtctctttctttgttgctgtggttaggtacctggcaggaagccgcctaagagagaaggagttgcggggcttttggcttctggttcaagggcatacagtcatggtggatacaatccagcacagaggtaggaacctgaggcagctgatcatactgtgtccccaggcaggaagcagacagtggacaggaagtgaggccaggctataaaagctcaacatgcacacctaatgccctcctccttttagtgatgctctgcttcctaaagacttcctaaccttcccattcagtcagcaccactagctggagaccagggtttaaacatacacttagactacagtctgaacgttatactttttcttttaaagatttatttatcatatgtacttgagtatactgtctctgtctttaggcgtaccagaagagggcatcagatcccattacagatggttatgagccaccatgtggttgctgggaattgaactcaggacctctggaagagcagtcggtgctcttagctgctgagccatctctccagcccctgaactttatgcggttacccctgcgtttattgttaggcaccggtggtgtggagagccctgatatcagcgtggcagctgagctagaccacccacatatggactctgctctgctggttagctgtttgatcgtgagcacagtagttatttttgcttttctgcatcagcagttttccctacctgggtgatggtgctttggacatttctcgttcagtcaatgcaatttgagttcctagagcactaggcttctgctttccctagtcaacaaggctctcaggtggaggtattcaatactgaatcttggagttttacctacctatttctgatactttttttttttttctgacaaatgttccatcttgtattcagttgctgttttaaatgcctacaatcggttgtcattcttgctcatttaagatttgcatctgatctttcaccaagtcctggcaattccatgtataaaatatgtctcattgtgtttccacgtccactgttagcatcttttaccagaatgaacttctgctacaactctattatagctttcattgactgcattctgactgcctctcacttcacgccccacccagctacacatgatgaagcaggtctggtgagccagcattggcctctggacttctccagggcatctgggctgacaggcttctaattctgatggcttttgttttcttttgccgtcttacccagttccgcatggttgccctcctttatcatatggttttcatttattaactgaatatgtatttgttgtacaccttgctgtctaccaagtaactggaagttacaatgtcagtaggacacagatataactggttaataattttaacaaagtttggagcactgtggtaaagacacacaggcaggttcatcccatgaaagaatgcagcagaatgatagtacttgtatccacgtttgaatgacagcccaggaaagggaccgagaaagactcatttaaaacacagctctttgagataactaaggattatcctagtgtggtgctgggggtggtctcagggaagatttggtacagaaaatagtttgcttaaaggtgaggaaaacagggcctgtcctggaattaatatctctctgtggctgaaatatagacagttcaggagtgtccatggaaagatgggacggaaaaggtaggcagagactttgttagtggtcttaaagactaagccttgactgagctcacagatggagacgcagggtgtcacagagatcttggaactctgatttcttacatgcgaccacagaccacaggcaggcaggttacttaccctctctgtgtcctgtctgaaaagaggatgatgatgctcctgcttgcagtgttccctttggtgtcgtgggcttgattcctgtttgcgatgggtaccccgtaccctgcatcttttggatgtttactgatcagatgcttgtgtgtatgtgtggattcaggtgtctcatgctgtgagacaagaaactctctagcgttgagctaactccccaaccctggcctgcagttcccatcagagtgccaaattatgctaagatttgtctatagttatgatttgtagcttagcttcctttgttacccacctgtgagagagcaaatgtgctgacccagggacagacacccacaccttacatagtcggcctgactgctctaagttgtcattacaattctgcatggaacttgtgagtgtggttaaggggacctttctgtgaggtagatctgttgctcacagatctgaggccaaggagcaaacagaatatagaaaattccataagtaacatgtaagcatttcttcaaacaggctctgtctccttaagatactttgtgcctcggctctgctgttgctgtgaagatgtcagttttatatgcttacgtttttatttgggagagctgtgagttatcattatgaaaatgatcagaatgcttaatttagaattagtgattaacttgtaagtctactgtggactgagcatagaataaacagttcaaatcagctgggcaaaggatatttgactgtttgatttttttgatatgtatattcatttgtcattgtgaggaaattttgacacttggcagtcatttgtagaaatgactgtattttttaatttcacaagcaaccaaaccatctatattcatttctgagtatccgtactgaaatctaaaaagagaaagctaattttcttttaatgcttctaaattgggggcaggctccttggagggcattatgtgtgattgcttttgattattacggagactggggaggcgtggatgtgttatttgtttagtgggtgggaggtaaggatgataaatacacaagagtggtttgagagccctccctgggagagattgtccagccccagaattgctaaggatccttctggaagcattactgttttctgctagtgacctgagataactgtgctcatagcaccatctagtgagtaaagtgggtaatagcagaatcccctttatcacagaaataagaacccaaaagtttaagactcctgtatgctcacagtcagctattggatggatcacagggcccccaatggaagagctagagaaaatacccaaggagctaaagggatctgcaaccctataggtagaacaacattatgaactaaccagtaccccagagctcgtgtttctagctgcatatgtagcagaagatggcctagtcggctatcattgggaagagaggccccttggtcttacaaactttatatgcctaagtacaggggaacgccagggccaaaaaagtgggagtgggtgggtaggggagtgggggggagggcatgggggactttttggtataacattggaaatgaaaatgaggaaaatacctaataaaatatttttaaaaaaggaaaaaaaatccaattgagttcctctactcacattcacagatgaggaaggtgacaaaaaaccaaaaacaaaacaaacaaacaaacaaacaaacaaaaacagtaggttatagaaccataagtgttgggcccagggaggaaaactggagctaacttaactcaacttctccttttacaggcagggaaactagagtccaaagtggtgatgtgatttacctaatagcatacttcgttagtagcaagactcctgacccttgtcttccaggttagtgctgagtcttcatcacagcgaacgcctttttgttgtacttggatgagtgcctaggttcttagattactcatttaagaatgaatcaacagcaaacaaagaaaagtcttgttccagagacatgttatatagtaacttccacaacacacacgctgtgcccaagttttgttttgaatctattctccccagaaaatgaggattaacttgattattcgttgttggatttgcattgagcactgagtcttatgactcaataagactacaagagacagaaaagaagtgtgtgtaaaattcatccagaactttaccatcggtactgaccggtgaaccggcacagtggcaggcagacgatacagaagatgtaggcaaggacttgcagttaccgaaccatgaaataacaacccatttctcctctgtgctggcacacactaggtgttactgataagtaacaatttctattgacaaatcctgagaatgactcagctacaagtaagtttttatatcacgtttgatcagagaagagcagttttaaattattgactggaaaaacttgtaaaggacaagtgacttacagaagaagagtgactgtagacaggagatacactgggacaggctgaggctgtgtgtgcagatgaagggagcttgcttccgggagatgctgaggacagtgcaggcatgccttcaggacggggacacctgagcccatgcacggagaaggactgctcaggtgacgctggccatgctgtttacagttagtctcagtaatgtttatgtgtgggtcctgtcctaagtgggttacatgtagtaattcttgtacttttcatttcagccttgagggacaggcactgttacattcttggttttacaaatgaaactcgacaaaagagaagttaaatgacatgggcatctctcactgatggtgggtttctccctgctccgagaggaggtgcattcctgtgggatgcggaccttctttcttccaagctgctggaagcatcacctctaaaagatgcctgttcttatacatgttttgttccctttaaatatcataccattcttagcgtattttcccagctcttggccattctgtaacagtcctttgtagtactgtcaggttattgacctgcctctgacacgtctgtgtgggatacagagaggatgctagaacatctggttcagatgcacaatgctactggccttcaaaaaagactccatgctaatctcaggcttttccttttgaaggggtgatggctaagagttcagagcccctttcagtttgtacttggtagtgaccattttggtcataggtgagatagatgtagtctcagcttggtctttctctggtgtgttggtgttgggaaatgtacaggttttaaggatggttattatagtactgtatgccttatggatatcataccctgttgagtttataatcaaataaaagagattcattatcaattaatgtcttttactgcatattcatgcatattgttattatactctggatttaactatatcctttgttatttatgaatttataacactatctcttatgactagacatagcatcttataattatcataggcacctggctactctgggaaagaaggacagagacatgtgttctgggttctagactggctgcttttcattctgatgatctgcacattaagtttcagagggtgtatttggtggtctcagagactgaattgttggtctagggcactaactggcacctggctattggagttcagattgtgactcagtccctcactctcctcatctgctctgtaaactgatgtaaaatagcatcactcatcacctaaagttgttatgaagactgaatacatagtcaatgcttgtagtctacttatagttcatttttaattaaataagtagacaggatttcagtcacatgtcttactggttgtagaccctgtggtctcgacattcctctgactctgcagtattctagaacacatttcccaccaacatctgcccttatttgacctgggacttgtgatcatcaccggctctacttgaataaggaaaggtagtctagaaagagccttatcttttcttcatgtactcccacaaacttggtaaatggattctcttctattagatagtaattttaaaaaaagattttatgccaagtatgatggcacacacttttaaactcagcacttggagccagagacaggcagagctctgtaagtctaaccccagtctggtatatgagcaagttccatgtcagccagggatacatagagagatcctgtcttttttttttaaaaagattttattatttttattttatatatgtaacttttgcctgtatgttttctatgcaccatgtctgtgcaatgcccgcagtgtccagaggagggcattggattccctggaactagaattgcaggcagttgtgaatcacctttttggtggtgggagttgagcctgagacctccttgtaaagcaacaggtgctcgtaaccaccaaaccatctctagcccattaggcattgttttgcttgcttgcttgtttgcttatgtatctgcttgtgcctttacttatgcacctgtttgtgcatgcgtgctccacggtgcacatgtggatgccttgtaggcatcagttcgcttctaccacacaacctctggggattaaatttacttcatcagggttggtggcaactgccatcagccactgggccttcttgttgctcccttccccctttttttgtggtaaaaataacataagatgtgttcacttatacatttaaatgtatagtaaagagtgacttttgggaacagtgtcatagagcacatatctagaacctactttccagtgaacagtggctgcccaccacctcctgctgtatccctctcacagtcctgccctgtgtgagtttccctattgtagatgccccatgttagttgaattgggctgcttgtcccatgcccagttcgtttttcttagccaggtgtcctcagtgtttatcctgctgttgctgtggctttgtcttatggatagcactcatttttgactttgtttcacattattacttaatagctatattggaatttgtatttcagtctaaatgatttcctttacaattcctgtaaggtgaatctgatagttgtgaactccctttgcctctgagacagtgtcttaactgtgtggtctccctcttcctacctcataggctggattttagttgcacgccaccatatctcagtcgttccatagcttttgtttgtctcagaaagttttcatttcttcctcatctatgaaagacagcactgcaggaaaaaagccttttggttggcaattatttcctttatcacttgaatgcattttcatctctctctctctctctctgctgggtttctgctgagaaatcttctgataggcagtgttgaagcagccttttaaagagaaatgcatgttcttttttgagttgaatttgactggtgacagctgtacttcctgctcttgagtgatgacatctggaagtttccagcatcatttccttcaagtctctttctagtccttcttcgtcttcctacaactgccataatgtgcttgtgtgtgtgccctcttggtgatggcccatggctcacacaggggtcctctctcagcctttttgatcctgtggagagtttcgaatgttctgtcttgcagcttactctctttgtcccagtagagtaaccattgaagatttttattgagttttctagtttagtcattgtatttttaatttccaattttcttttctttttaaattatctttgtttggtagacttggtttttttgtttttaattgttagcttgatctcacttttattttttattttttatagtttactgaacttatttattagtgtatcctaaattcaattgtgaatcattttgtagatcttcatttatttggggtccattattgtagcctatcaagtttcttttcaaagtttctttgtttgtttgttcatttctctttcttttttctttttttaacatagggtctcatgtagctcaggctaccctcaaactcagtgtgtacctaagggtgaccttgagcttctgactgtcctgtgtcagcttcccatgatataggatggcagggatggccattgtgtctaggttatgagctatttccgaccccaggcaggcctgcagctctcttctggctgagctacatcccagcccagtgcctctcttagttgtggttatactcgcacctctctgtcgaggtctgtgcttccgagaagcaccctcctggcttctactgtattctttgatgtactctgagggtcagctagtgacaaacacagtggggtgatgaagctgtttttagcttgaaatacttttgctatctactgggataattttttctctatttctatatatcaaatgttttaaatattgccttcaactttgttacttagattgagtgggtaaatattttacttgtctctttgttaacatttgcaagctccccccccccaaaagtatgtttttggttttttagcagatataaaagtgaatgtttatatccacttattaggataatactttgggtctttaaacattttaaaattgatttttgtgtgtatatgcattcatgtaagggcacgctcgcacacaggcacacgtgtcaccgtgttaatgcggccatctaagggcaactttcaggagttgggtctttatcttgtttctgctgcagtgttgcctgctccgggctgctgaccagcacatttccaggtggttttcctgtctgcagtctcactggggcagtgctgggattaaaggtgctgctgccctaccgggaagtgaggccttcatggctagcacttcatgctctaagacactcgtccagctctgcctgaggtgcacttaaagtgcttaaagaattacactgatttgaacattgaattgaaattgaatttcagatcatttttttctctttgcttcctaaccttgaaaaatgtcttcttagtgttttatgagcagggaggcagcatagatgttgactggctgttgaccataaatctttgttaggtttctattgctgtgttaaaacagcattgccaaaagcaacccgggacagaaagggtttacttcatcctatacttccttcactgagggaagtcaggcagggaactcaaacagggcagggacctggagctgatgtggggccatggagctgcttactggcttgcttcccatggcttactcagcctgcttccttagagaacctaggaccaccagcccatggggtggccctacccattatgggctggaccctcccatattagtcattaaggggacattttctcacttgaggttcctcctcccccgaaggctctagccatgtcagattgacaggacactagcagcacaacatgtggcattctcttgctttttaggtatcacagtcacacaatgtaaggctttttgtagccacactttggccagtctgatagaattttgtccttaatttatttaaaagtaaaatacaaaatataagcacttgtttcctagtatttatagaaggagtaaattaagatgtgaagaaaattgaacagacttctaaagaaacctctaagtcctctgatggaagatttataaagaattcttagaaacactttaatatagttcaaaattaaacctttacttccttcccacctcaggcccttgagttacacatccaggacaactactgtgaacagttctgaggtagccttccacagtgctctgtgtacttaagtgtatgtggaacatatgtacatgagttaaaaatagagtttaaaaataaatagtgttttgaatgggctaaatgtattttttctcatgtagttgagaaaattggacagcttgatacacattaagtattttcttcacctttattaaatgtttcctaattgtatcattctgtataaaatttctatagtgaagtttaataacagattatttttaatagaaacattaatttatatggaagatttcccccttaatacatgtttttaatgtcagttggcttattgaaaacagggtggcggtcagggcgctgggcttgcgttgctgcagtgaaatattgtttgtgttccgcttttctcgttgttctgttttgcagtcctgggatcaaagccagagcctagtgctctaggcatgttactccactgctgattttaattcccagcttgaggttttattcttttaagtagtaaacatatacttctcttttgttacaatggtgatagaaaattagaataattttgaaatgtgtagtgacacaaaagtaaactttccttccttcttctctcctgcttcctccctctcccttcctctccttcctcccccacctcctccttcctttgatctccctccttagccctttgaatacctggctgagttcttttttttttttttttttttaagttgaagtaattaaactcattgtgtgtgttttattaactctgtgtttaggcatgtgccgatgtaagagctagttcagtgttttggcagcagatggagttctcagagagtcttcatggctatcccaagttgccagagtggctgtcgacacatccttctcatgggaaccgagctgagtacttggatagactcataccacaggtgagctaaccccactaattctgttacttttttggtatagaaaaagtgaatttcagtatgcaattattttggttaccataattatcaactattggtttcacagagttgtattgaaaagggaattcctatttacccacaagtcctggggaataaattgctatgtacagctgaatttcctcagtgtaaggtctactctcgtgtctgactgagttgtaattaacttggtaatgtcttaaaccttgagaaggcctggagacgtggttcagttgatgagggcttgcctagcatacaggaaaccctgtattgtacctctagtactttgcaaagtgggtgtggtgatgcacacccgtaataccagtgcttgggaggtggggacaggaaaaccaagagttcaaggacatccctagctccacagtgagtttgaggtcatgagacctcatgagacatgagaccctgtctcaaagcaaaaaaataagcaaaaaaggaaaagaagacaactttgggcattttttcaatatattgatcataatttggtcttatttgatcttcccttaacttttggttttggaataaatgggtattaactctttggttttttgtttgtttgtttgttttagccaaagtcatactacaaagtcttggctagcttggaatttacgatgtagacaagcgtggccaagaattcacagagatatttctgcttctgcctttgtctcccaagttctgggattaaaaatgtgctcccccatgtctacctcttgttagtttgttgttgttgttgtttatttgtctgagacagtctttatgagcctgagctgtctgcaaacttttgtgtaactgaggctgacctcaaactcttgagagttgagagtgtagccctgtactattatacctggttttgtacagtgctggggatacagctcaggcttcgtgtatgttggtcaggagctctaccaaccgatctgcatttccatctctgagtggcttagaaactgttaaaatttgtttctaaatttagaaacagggaaatcttagatcaagcttggtatcttgtaaggacccactttccagtttatagatggctgtctccagtataaccttacatggtgaattaggaagtgaggtctggagtcagtttgtccatgtatccatgtatccatctatccatgcattcatctatccatcctttatttaatgttgtgttttaagtcagggtctcaccgtgaagctgaaggtggtcttgaacttgagatcttcccacctcagtttccccagtgttggacaacatgcatggaccactatgctaggacttatgataagagcatcttttagtaaggcattaatctcattgatgagggggtcgactttcatgacctgatcacccctcaaatgcctcattttataagaatatcaagttggtgtggattttaacgtggagtgtgaaggcacagactttacttgattaccttttatctgactcatatcttacgtagatgcttaacatgaaggaaaagtacagctagcaaagacagtagcgacctatgcctgatgttatctgtagtcactattcacctaaacagggcagtgcatatgcgtcaccagtaatagattctactgagggccggcaaggatctcagatgttagatgccgtggcttgtccctaaagtcatgatgcacagaagttctttttatattttaattctgtgcaattctaaatgatgtggcttgtttaaactagataacaaattctactagccagctgtgatttgaagcctaccctaaattctgtagctgtcttttcaccaagtcactgaggctcttcagacaggttaaaacgaagtgctttagggaggtctgtgaagtcgtcacgagttgattggagagcatgggagcatggctggagaagcaaatgttatttgggatccagtgaggaaggaaaacagggcagctttttttttttttttctaaaaataaaccatcccagttcagaaatttaatttgaaaactgcaggtaaatttcttatattttccccccaagtgattaaattcaatttgaaagcaataaaactctactacaactttgggaataattcagtggtagaagtgagaatgatagttagtacaagggtatactgttaattagaacacacagtcgtaaagattggaacgtgctgttctcctaggcctgatttctgtaatggaagaaagcagccatgtatgtaagatgtacgtctacatgccacaaaagactacattctcaatatgatcatttacttgggatgtttttatttctcaaatgagtccaaggttgaattttactaatggcttctctcccccaacatgtggatagtcggacaccctgttcatttctgaggtctacagttcaaactggctttagcagacacagggctttcagaatttgctctccagaggtcaattgatgaaactgacaaggtcacctaggaacagaggagagaatcaggggaagggcgactttatcctacataggaggataaagttaattgtatggaggacagagcctgctgtggatcagatgtatggggaaaagatcaagaaagaaagacttcatggctctatgacaggaacataaatattggtatctttaatttttaattttatgtgctaaagattataagtattttatcagactctctgaatgccattataaaatagatttcttactatagcttattaatattaaagctatttaaatgtgtatacattcaacagatgctgaatcacttactatgttgtaggttttgtggtggcaacttcagagagatccacatcttcatcagacttattctccagtgaaggaggtggacaggaagggagatagaagacgggaggctctccagtctgtctttgttacgtcactagtcctgttacaaggatcccctatttaggacccaatttatccttaattaccttcttggagactctgtccctaaatgtgggtatgttgggggttaaggctcaaataattcattcttgggtatatagctacagtgtgagcaaagatgggagggctgttgggaaagcacttgaaactggaatagctaggcttgggagtttggatctccagaacctatgtaaaactgagcatggtctcgaatcccagcattcctacagcaaaattggaggtggagacaggagaatctgcagaaactgaggccaggtagcctggtgtacacaaattgttcactttctttttgaaaaatggtgctaaccaacacctgaaaatgtcctctgacctctaggcggtgcctctgtctgcattcacatacatatgaacacaggtatacacacacgcacacagagtttaaaaaaagaaactcaaatgggagcctagagagagtggtcccagtgagcactctgacttgctcagggatgagcttctcatggagggctctgagcagagactggaggtgtgtcctgacttgaacactcactttatcttggaggaatttggtatagtatattgttcagaaaatgagctgcttccttccttgttttttggtttttttgttttgttgttgttgttgttgttgttgtttttgttaagacagggtccctatccatttagtcccggccgtcttggaactcactctgtagaccaggctggcctcagactcagagatctgctttcccccattacttcccaagtactgggatcaaaggcgtatgtcaccattatggcttcttattttatttttaaataaagaaagaacccctaaattagaaaaaaatacccttactaatttttataatgtgaattctgggaaaaagcaacatgcgtaaatataatcgtgtgatccagtagtatttgaaaatgataaatataggtttgtagtaatattatttgttgttgataagctgatatgatataattttatttacttgaaataatcagttagatttaggaaacatactccacatattttggttaccataacaacttgagtgaaaaactgaagaacagatgttgtgccaacctgttgatgtttcatagcgtgggtttcagaattaacagttatgctgtttagactttgagtttatgtacatcataatttgtccttgaaagaaataccttatttaagtattttataaaatatgaattactgtgaataacaaattttgttgaaaggtttattttgaaatcaaaagccttcagattattttttttctgtgttctcattgactttccttctccctgctgttgctcttcgtgagggcgcgaggggtgggcagtgacagcagagctgggaacattgaatctggaattgttgtgcaaggttatataattataatcataatttgaatggaatttgtttctaagtattttaattgtaaacaacattccatctctaggcatgagagtcacttggtagcaggctgtaaatgcattaattttaacctcattttgtttttaatcctttaaactttcaggcagctgggaagttgaactcatgtgtaaatcattcttatgcatttgtaattggataaaacaaatgaataaatcattaatattgtgcatctcatgagcacagaatgtaagtgttaggaattaccatgaaatgtcattgttggccatgtgtaaaaacatacactgttcaccttactaaatctcattctgcctggcatggagagtgttgaggaagtgaacagcagctgctgtaattgaatcggcctctgaatcatatgaagccagaaagcctgacagtaacattgtctaaacccttaaaaacattaggactgaaatgagtggaccattagaaaaaactcgcttggaaggataaggcaagaaagggtactgacatgtttaaagcggaggtgacccgccaccctgcccctgcaccaatatcttgctttctgttttcagcagaggcttttaatctaatcaccaagccctctggcatttccccttttttcctttcacttagttatcatttatattttatggataaataatttctcttttacttgatgtgtagcatgtagaaaaatcgcagtgtatcctagcagttggttcatatttagttgttactagaattaaatgcagccagtgccttaaaaaatacatgtgtgctcactgctcattccttttaacctttgggaatattgtttatggcctacaacatgatgcgtgatgtttgtacacatcgtggagtggtcaggtcaagctaacaagcagatccatggccttacagttttggagggtggcagcccgtgccctcactcttgacagtttcaagtgtgcactgttactggtgcttgtgttgactgcacagtggctctcagaactcccttctttcacctctctgagatgctgcaccctgactcctctccccatgtcttctctgccctcgtggtcaccatggcctcggcttctgtgagctgctttattagattcccctgtgaggccacgctgtgcccttcagattcttcggtgttgggcagattacaagactagatcgttctgtttgctttgttttctggaactttgctctgtagaggaggccggccctgatcttgaggcagtcctccttattctgcattctgagtactgctgtcgtaggcctgtgccacactgcccagctaggacttcctcattcttctggcaggggggttgactagagaaagttttgttcaaaaaccttgcccttccttctcattccccaaagcatcgtacataggtcaaagcagcctttcagccttctttgtttattcacggaaatttctcagttacttatacttcctaacatttggccatttcaaaagcaagtcagagccgggcgtgtggcgcacgcctttaatcccagcactcgggaggcagaggcaggcggatttctgagttcgaggccagcctggtctacaaagtgagttccaggacagccagggctacacagagaaaccctgtctggaaaaacaaacaaacaaacaaacaaacaaaaatcagacttcagttatattgtagttttttaaaagaaataaatcatttatgaggtatttttgagaagtgtaatcctgattcatataaatatttttaatatttatttatattatgtatatgagtgatctatctgcgtgtacacctgcatgccagaagagggcatcagatcccaggatagatggttgtgaaccaccatgttgttgctgggaattgaactcaggacctctggaagagcagctagtgctcttaactgctaagccatctctccagcccatcatataattatttaataaacctacctaaatattatttaaatcattaattaatgaggaaagtggtaaaatgttataactagtataaagggtaatttaacaaccataatgtaaaataagaattcctatatgagatggaagcccgttaaatccaaagactattatatagacttgcagatggaggaatacatctatacccaagtgaagttctactgaaggaaagtgagcctggatttatctaatccagtaataggaactgccaccaaatagtcagaaattctatgaatccacaggactgtacaggtcaaaacaaaaagctgtttctctagagtttctcaaaacgctagagaaaggcattgttaggtttcagaaaattgtttcctctggcagattcagttttgtgtttattttctttattttttttttagattcagtttttgacatgatcttccttctgtcagtagacaccaagcttcagggaaggattcatccattctttctctcttctgtccattctccctccttccctctccctaccactctttagccattctgatgcatatcaataggcatatagtcaataagaaacatagctagctgtaaaatggctctactcagagggcagctgcttcccaccaggcatagtttgcttccatttccatggacaaatatcattttcattattattaattttaaaataacaaaaagaatgcaaatatttggtgatatttttatccaaatgataatggctcaggttaaaatcagaattaaaatgtgtatatagacatgaagcttggtttcaaaaaatatgtgtgttgtgtatatgtgtatatgtgtatatgttgtgtatatgtgtatatgtgtattgtgtatatgtgtgttgtgtatatgtgtatatgtgtgttgtgtatatgtgtatatgtgtattgtgtatatgtgtgttgtgtatatgtgtgtttctgtacagactgacacactaggttcagctattagaactgcggtaaactacaatgagcctccttagactaactttggaaagaggtaaaatgtcaaaagtcagataaaaatttattttagaaacttgtagagtcatagcaaattagccaggtaaaggactccaagccataatgtggctttacttcagtcttagtccacaatcacaaagaacaattacctagtgattaattaattctagcatcaaaatacaaaatgggacatcaactatctgattcattttatgagcacggatgattttgtttcaacaatttgattaaaatgtctttaaaaatttatgaactgggatcattaatcagcaaacaaggcagggctgtatcacaattattatttactaccagcaactaaattgttctcacagtcagtggcatcttaaaggcacatgagagtggaacctttgattcctcgctttcctatgcccctgcatcctgtccatatcagtctgtgggcttcctctactatgcattcagaacctccatggcccttcaccacggccactacctaggacaagccaccatcatcgctcctagttctgcagctctctccctttcaggctccctggttcactgtttctgccaatggtttatttttaccatgtaaacagaatgatcttttaaatgttattctcttgcctaaaaccttccagtgttctttcatgtagtgtagaataagaaactaccctgttgtagctactttctgttgaccaagccagttttggggaggagtgggtttatttagcatataagtcacaaccatcactaaagggagccacagcaggaatctagatccagggtctgaagtgtacgtgtgtgtgtgtgtgtgtgtgtgtgtgtgtgtgtgtgtgtgtgtgtgtgtgtagggaaatggggtgtgggtgctgcttactggcttgcttatcatggctcattcagcttgctttcttatataatccaggaccaagagtgtaagaatggttctgtccacagtgggctggatctttccatatcaatcagtaatcaagaaagtgccccacagacatacttaaaggctaatggatataattccacatttgaggttacctctttcaccgtgactctagcaagatgacaaaaactaaccagcacagtcccatggtcatccagtcacatgacttggcaccgtccattttgctaacaaggtttcccttggctctggtcatttcacatgaggcttgtttcctccttacagacgctccaattgtggatttctctcttccaggcattaccttgccaaagaagctttttctggtccctcagtgtcaaatatcctgtcatccatgcagtcattctccctgttcaaactagaatgatcttgcttactgttgattgactatcttctatcttgaaatatatggtccttgttccctgtggtctccctggtagcttccacagcttctgagatgcctagtgaatacttaaatgaccctaggatatcgaatagtaataaataatagctaaaaatagaacactttgcagtagaactgagtagtgcttgcactgcttaggcgatattagctgtaggaaattatgtccagtaatgagcaaaagtgctcacaggaagtggcaatgtagaaatagcggtgagcttaggggtctttgctttgattctgccccaggtgaccttcctttgagaaggtctaacctttgcttttctccataccttgttaggttagcagactcttcagagttctgccttatgcacctgtgtgtctgtgggtaaggccctgacatctttttctctacttccctcttgacacttgaaaaaaaagtagtttgcattatgatacatgcttagataatgtttgtacattactggtcaaataaaaaaaaagagaacgaataagatgaatagtggctgtctgtggctctcccaactgttgggatctttaaggctggctggtttcacacttatcttcagccttccttccccagggttctccaaactgtatattcctactattggattatctttctattgtctcaaaaattgtaggctctccataatatttttacagcatttattaaaattgattattcatagtttagaatctagcctgcatttatgaagtggcccttatttgcaatgcatagagtcagatagaaaagaaaggcagtggaaggcatattctaggtgcacatggggaaaaaaatcttattcttgaagaaatgtgaagatttatgtaataggatagatttgaatttattaaagggaaaagatgttaacacactgaaatgtaatgaaacatataggaagaaagccaaaaatctagaaattcagaagattttcccatatatgtataatatatatatgtaaaatatatgacctgtaatataatttttttgagaggaacacagggataggaaatctttttgaagaatagtttttctggcgattaaggaaacagcttgagcatttccaaagtgcatgtattcagtgaaaggttcattccaagaagcaagtgtgtggtacagaattcactagcatgaaaagaatactggacaaaagcaaaaggttcagcctttatatttccgacctaattttactttttaaaaagtaagagattggagcatgtgttcttaccggttgggacatcttctggatattcccaggagaggtattgcgggatcctccggtagtactatgtccaattttctgaggaaccgccagactgatttccagagtggttgtacaagcttgcaatcccaccaaccatggaggagtgtt

SEQ ID NO: 560 - DNA, 1284 bp, Mus musculus
tggattccgctcgggctgtggcttcagtgcgcgctcacgataaccaagcaaaagaaagatgagcctcctttatggactgcagtctaccaggataaatcggtttctctctggagtgaataacctggccaacaggagacagtggacccccccagcaagctgtccactggcaccaaagctccgagcagtaaatgcatactggggactgaacacagtcagtcattgtcattcagtgaccttactgcctagaaactttcttttctgtaggactctcaatcacaaaaaatcaagatgcctctcaagtgcccaaagcaaggaattgggggtgcttacctacagatgtactgtgcggggtgattctgttctaagacaaggagcaaggaaagtggctggcgttcctgctctcgcggcctcctgttctccaagctgtcctgccgtaatagaggcccggagtttccgtacatctgcaagggttcaggctgccccagtccctctcttgctgctcattctgaagccagtgcaaaagctccttgctatcatcgtgggcaggggcataaggaaatggtggcaagcacttccccctaacaagaaggagctatttaaagacagcgtgaggaagaacaagtggcggctgcttcttggtctgagtgcatttggactgctctttgtagtgttttatttcactcacctggaagtgagccctgtcaccggaaggagtaaactactgttagtgggcaaagaacacttccgacttctgtcagacctggaatatgaagtatggatggaagaatttaagaacgatctgctgcctgagagagacccccgctacctgactgtgaaagaaatggtttatcatctgacacagtgcaatcgagacgtcccggggatctcggagaccaactgggtggttcatgtggttgactccccagccgtcaatgcctttgtgctcccaaatggacaagtgtttattttcaccgggcttctgaatagtgtgacggacgtgcaccagctgtccttcctcctgggccatgagatcgcacacgcagtcctggggcacgcctacatgtttgatcgaccatacagtagaacattggaggccgaagctgacaaagttggactacagctggctgcaaaggcatgtgccgatgtaagagctagttcagtgttttggcagcagatggagttctcagagagtcttcatggctatcccaagttgccagagtggctgtcgacacatccttctcatgggaaccgagctgagtacttggatagactcataccacaggt

SEQ ID NO: 561 - protein, 414 aa, Mus musculus
  VARIANT (1)...(414): Xaa = Any Amino Acid
PSKRKMSLLYGLQSTRINRFLSGVNNLANRRQWTPPASCPLAPKLRAVNAYWGLNTVSHCHSVTLLPRNFLFCRTLNHKKSRCLSSAQSKELGVLTYRCTVRGDSVLRQGARKVAGVPALAASCSPSCPAVIEARSFRTSARVQAAPVPLLLLILKPVQKLLAIIVGRGIRKWWQALPPNKKELFKDSVRKNKWRLLLGLSAFGLLFVVFYFTHLEVSPVTGRSKLLLVGKEHFRLLSDLEYEVWMEEFKNDLLPERDPRYLTVKEMVYHLTQCNRDVPGISETNWVVHVVDSPAVNAFVLPNGQVFIFTGLLNSVTDVHQLSFLLGHEIAHAVLGHAYMFDRPYSRTLEAEADKVGLQLAAKACADVRASSVFWQQMEFSESLHGYPKLPEWLSTHPSHGNRAEYLDRLIPQX

SEQ ID NO: 562 - DNA, 85859 bp, Homo sapiens
  misc_feature (1)...(85859): n = A,T,C or G
tgccaccggtgtccactcacattttcctttatgttggtgcctggcccatatttctgcacacactggttcaactggcaactgccagaacctgaagctccttgcttgagtctttctctggcctgtaggagcccactcgatgtgcatatgcaggaggctggaagtgtcatagaattaatccttactaggacagctctcaaccaatgctactggcaggaatggtgaataaatagcccagctttcccatcctcacttggtaaaactctgtggcctgttttacacattctcctagcagtcctcagagggacgacaccccattggccccttttgtaactagtttgttaatgtattctttattagctttctttccttccctgtctcacttctctactcaccaatgggtgcttcctaggatcacctcccaaataagttacttgtattggaatctttgtgcttgtcacatttgtatcctcatcttgtacatgctactctttctgtgtgggatgctgtctaatagggaggtctccttgggagacacacagaaagtgtaacatgtataagaacatggaaatttaagcatggatacctcaaattccagaggttatccaaattatttggaaatctgctacctggtctagtgatctgatagatgaagagtcacctgtgcttataaataaatagataccatgatgtgatgacccatgttttattttgggaattgtttaggttgagaggaggagtaggggatttcctattttccctggagcaccagtttctgtagagtatctggcatatagtgtagcctccatagtattattgaatatatagatttgtttattgtatcaaaattagtgtgttaaaaatgcctgtaatataaactacggacttagggtgataatggcatgttaattttaacaaatgtaccactcttggtggtgggggaggctgtgcccatgtagggacagggagtagatgaaaacactctttctgctcaatgttgctgtgatcctaaaatttccctaaaaaataaatcttagtgattagaaacaaaaagcccagtacttactaaataattcatgcgcaatagatgtttgttgaacagaattgagactccatggaaaggtaaacaaatgcctttctttgaacaggcattacaacacttggtagtgatatatgaggaggggaactgtgcccccagtggtgtgtgctctaggaatttggagacttacttcagttagagctcaaggttatgagctgagttgtttgtgagagcaaaatgatagaaatggtttaaatgtccatcaacagtaataaagtaaatgatgcaaaatcttttccagaggacatcttatggtgcttaaaatggattaaattgatctacaagtattgataaagacatttctccaaggcatgttgtgcaagtgataacctggaagttacagaaaatattcatagtgtgataccattatgttaaaaaaaaccactaaaaatatgccacatatctttggttgagatggggactcagcagcagatggggtgggagtgttgaggtgattttttttttttgagatggagtctcactctgtcgcccaggctggagtgcattcgcgcgatctcagctcactgcaagctctgcctaccgggttcacgccattcacctgccttagcctcccaagttgctggtactacgggcgcccaccaccacaccgggctaattttttttgtatttttagtagagacggggtttcaccgtgttagccaggatggtctcgatctcctgacctcgtgatccgcccacctcggcctcccaaagtgctgggattacaggcatgagccaccgcacccggccagtgaggtgatttttaagtcctttcaagcgctgagattccataatcctaagaagtaaagtttatagttccttttaaaaatatactgctttgacccatataagaaaactgtaagactttatggagagacataaaagaagacctggataaatggagatgcacatatttcctagattgacagtcaacattgcaaagatatacatctcacccaaatgaatccaagattaaaaacaacaacaataacagaatcaaaaatcccaattcctttttttttaggaagggagctggaaaaaaactgttcagaagttcatcttgaaggtcaaatgtgtaagagccagacaatatttgaaaataaaatgtatattacaaagttacaataaatagaaagaatcatgcactaactccagaacagtcagaccaaggaaaaaaagggaaactgcagaaacatatgtagatatttacaggaatttagcatatcgtaacagtgatgctttaagtcagtcaggacatgttaaattaattgttgggacagcagttactttggtggtcctaaccatggggagggcacatgcatgcatcctttgtaaaagctccactggcctaattattccgaaaatattttaggttattttttttcctcctattttatgctgaaataaattcctggtagattaaatattttaaaagatttaagaaagaacaaagtcattcaagtactagaataatgataaatatttaatcttaattttgagacagacagtagatatgatctcgaaggcagaaaccataatgaaaagatggatatttttgactgtatcaaaatttcagcaattaagtgtatttttcacctgaatcaacaaagttgaaagacaaacttcaagtggggaaaatgtttgctacataaatgacagacaattcttaaatgtataaaaaaatgttttaagtttataagatacaaatgaatatattacagaaaaatgggttaagggcatgaacaggcaatttgctaaagaagaaatccaaacagcataaaagcatgaaaaagcatttacattattataaatcaaaggaatacacatcaaaacaacgaggaagctttgatctcatcaatgttttaaatatttaaggtaatttaaatcttgcttttcaagtgggttacgcatcaaaatgttaacagtggttattttgggatagtgaggttaagggtgatttttctcttttttgttttgcttttctatggtattagtatttcacttgtgcaataaagaaataatagtttgcactgacacttagaaaagtgctcatctggcatctttgaagaactgatctctggggagtgagcaagggcatgtccacagtaagaccttcccccatggccctgcatggagctcgctgagccatactgaattatcccacacccaatttcaggagctgggtcctggtggctgcagtatagacaagaggaacgaggctggagacagggagaccagtcaggatactagtgcactaataatttagatggcaattcgtaaaaataacacactggaacttggtgtgaccattctcttcaagcaaaaaattaactttaaaatggcagatttattcatgttatgtgggaagaagggctaggatgacacaagaaagaaaaagaagtcaactgtggttgaagtaagcactgagctgatttttgttggagtagaacgtttcaatgaagatgctgaaattctctgtgttggagtgatttcaaattcacaatttcaacccttttggacagtcatgcctggcacatattcaagaaaaacgaaaggccacttcagtcaaggtgccacccatacattgcagccttccaagtacgtgaccctcatcaaatcctgtggctgtttcacctggttctcattctgaatctatatcatcagaggcctgattgttgtctgttgaacttctgtctaaacctgttataagacaagccatgcctcataattcttcagagtcactctcttctttaactcagtattcagcatccagcactttctataggaggtgtgaatgaatgtctttctgtgtcatggcatttaatatagttttccactggagaagactgaattgttttaggctgggttccctggaaacagattctgagataaatctttttgtgcaggcttataggggagagacctcaggaacaacacttatttatttatttatttaggacggagtcttgctctgtcacccaggctggagtgcagtggtgtgatctcggctcactgcaacctctgcctctcagcttcaagcaattcttctgcttcagcctcccgagtagctgggactataggcacgagccgccatgcctatctaatctctgtgtgtgtgtgtgtgtgtgtgtgtgtgtgtgtgtgtgtgtgtgtatgtgtgtatttttagtagagacaggggcttcaccatgttggccaggctgatctcaaactcctgacctcaagtgatctgcccacctcagcgtcccaacttgctgggattacaggcgtgagccactgtgcccggccaaggaacaacaattcttctgcttcagcctcccgagtagctgggactataggcacgagccgccatgcctatctaatctctgtgtgtgtgtgtgtgtgtgtgtgtgtgtttgtgtgtgtgtgtgtatgtgtgtatttttagtagagacaggggcttcaccatgttggccaggctgatctcaaactcctgacctcaagtgatctgcccacctcagcgtcccaagttgctgggattacaggcgtgagccactgtgcccggccaaggaacaacacttataagggagtaagggaaacaggactgggtagaggcagaagtggagcttccagtcccatggaggtctctgccgcgtggatggccttgcagtgttatcctcaattgaagcataggagtcaggactgtgtactcccaaagtttgtggggtaagtgttgtcgctgggcagagagcctatccttggatgaagcaggtgtctccagccaagggaaatctctagggaggcaggcagctgccagaatgataacttcagtgaatggggatctgctggtgtagcacagcatctactttcagtgttacatccaaagtcaaacttcagtgatgctgtcacgggacacagtcttcagtgtgacccttcaagcaaacctcctaccatgaatactctgtaaagaacaccttcaaaagcttcttacacctcattaagctgtgcttaaaatgaagcccttttcccaagggcatatccaaaggaaattattcatgtcaatcctctgaattcagacggggtaaatagctttggaaatttgacaaaagccaaacttttaagtgtagcaaatcaatattgcttggttggaaggttggttctgagaatggaatctgatcatgtgtctcagtcagttcaggttgctacaacaaagtactatagactgactggcttcagcaacaaactattttttcttacagtttgggaagctgaaagtctgaaatgaagatgccagcatggttggattttgtgaggaccctcttcctcgtgtacgaacagctgtcttgttttatcctcacgtggcagagtgggagctctctgatccctttatctccttacagacttgaatctcattcatgagagctccacccccatgacctaattacctcctaaaggcccccatttccaaatactgtaatattgggaatttaggggtcaacatatgaatttcagagggatacaaacattcagtccatagcacgttgattaaaaaattgcttaaagggcagcacaaagaagatgtacagccagaacagaagacttattcaaactctaaatcctccagcagccgtgaccgggaaaatgtgccgctcagatctgctctggggagcatagttgactgccaggccctgcccctgaccttctggctccccaactccatttgtaacaagcgcatgctccccatagactgctcttagccaatgataacgcatggtgtgaacactagtggatgcccatctctgcaaaatatggaactcctctaagcaggcaattttggcctaaggactcctcattttcaaaaccttcttagaactgtgctacaacctgaggtgcttctaatccagtctttcttctttccctctctcctttaaccagtgtcatgatctgagggcccttcctgtctattcctgctcctgctccattatccttcccaggattttccacgcagtaaatatgtcttgcacatctgattccaccctggcatctgctttttagagggcctgttgatacaggtggactagaagtggggtgatctgagaagaagatggtaagatcggctctgagagtggctcattaattgcccaactggctacaagaactccatcttgagtggaatgtggggtcttggatagtgtctggcacaagatagtggcccccgtgtggatttcagtgatggcgacctgggaaactggcccagtggagggcaatgccatttaggtgagatagttaatgcacttgaaagatggagggagcagtgtctgaaagaacagtgcagtgggctggttattgctacattgtgttgatgccctgcatgggataatgagaaagtgagggtcatttgtaaacagttaaggctgagtgggagtcagaggtctccttggtaggtaacagacaggctcttatcacctgcagtggaggagtgtggacagcagaggagcaaaagagattttcatgaaaagagttgtagagccccagagatgtttaaacgcttagccaaggcaggtctgggccctggttgggaaaatctggaatcttgaagcatgaaatgggacatcctgatagaatccctgaggatactgactgcagatcctcagagcttgcagaggtggctgacccttccctagtcaaagctaacacttcccttaagtgggaaggcagtgttgaagcctctagcgtaaggaataaataggtgcccactcaggacctgccccatctcctcttagatatctgccagggtgataactcaggttaaattccagcatcacccagctgcctgtgtgttgggcctgtaaaggtgtggggaggaagattgcataatgtaggagctaaaggaactacctagcgtgtaccagcaggagccaggagaggacccctggaatgggatttctgaaggtgcttgatcaaagtgggcaggaactgtggcgggattgataaggaatcagagataccaagaggttgaggaggatttattatttaggtgcaccggcccagtcggattaacatccaaaggactgagccccgaacaaagagtcaagttaccttttaagcattttatggggttgggggagatctgtgcagggagaagcatgttacagaagcaagaaacaaagacagttatttaattaattgaggcatgcattacatcatttcttacttttcaaggaaaaacgtgtcttaatggcttgagtttatctgtctagtgaccttgcagcgcacagctaaagaaacagggtctttacaatgcctgggaaagggagagataaggctcactagccacagaaaaacaggcagttaatatttaaagagaaagagctcttctcggggggaggtgggttttcttacatagaactgagtttctgtttacacattctttaatttcttttaattcctattccagaacaagcctggctaaataaaaattcattgtcttgggggcactttcttgggacttgggactgtagaagatgggtaaactcactgctaggtgactattagaagctgagagaaagccatagtgcatgcagagtaaagcaggaatgcccgaattgcccttgcaaatggtagaaggacagaggagctgagggaagtggacttgcctgaatgaattttttttgtgtgtagagcctgaaggcagacagaggggaatgttccatgggaggcccagaggatgcatcatattctatggccatggggaatgcacactggcgtgaggggcactagcatcactaagaagttcagagaaggctctcctctggagggaagggctgacggtaggagaggcaatcacagggctgggcttgataatatccattgggataacaggatcctgaagtagtagaagccaggtggtggctttaaccatgaggaccccagaagatgtaattactgtaacacctgccaagggcagaggagcagccaacggggcttgatccacaggaggttgtggagggctttaatagcataaggtatccctaggggaaaaacagacgggcagccaacaagagtgttgcctaacatctacaactggaggaagacaagaagctatttatcctatgcagggagtagttgcttaataaaaggcactgctcattgctcaagtctcagacctgagcctatcttcacactgagaccacagaatctgttgacttaagaggttgttgggtccctataaagaagaatcctgcaatactgaaacaaatatttactgtaattaatgattactctttggtctgtgtcccacggccattttcttgactgattttatgttgaggaaagaggaatacccagacatttcacaggtgttacccaaagtatgtaacacacatggctcctctctaagtgtgggggcttatggggatcaggtaataagcagagtcctggataatgtccagcttacagtgggtccaggaatacactgacccatccagtagtcattttcttagttcctgagtgcataattgggagtacatattgggcagctggagcaatctccacattggtaagaagctcagggtccttggtcttgagttatcatggtggggaaagccaatgggaagcctctgaagctgtccttctttccaagtgaagataataaatcaaaaccgatatttcatctgaggggatagtgagatgatggtggagattaatgtcataattaaagacctaaaatatacaagagtggttggtcatccctgccatatctctacttaacttgccagtctggcccctttggaaatcaggtggacccaggataatgacataatggctctgcgcagtccaaaaggagctggatcaactggaaattccagagaacatcacacccatctatttcaccaatgacattatgctaaccaggcaagatgagcaagaggtggctagcatgctggaaactttggtaagacatgtgcactccagagtttgggagataaaccctacgaagactgaaggacctcctacttcagtttttaggggtccagttgtcaggggttttccaggatatccctttcaaagtaaaaggcaaatcataaaatacacataagataaacgaaacagtaacttacaaattttccaaaagagatacctaaaattgttcatagtgtttatgtcctttgacatagtgtttatgtcctttgagatgttttcattgtgcacagagtgtaaacataataaactaatatgagacctcactactcatccatcacaatccagtgtttatttgtactggcttatttgtacacttttatttatttgtgtttatttgtacacttttttttaatcgcctgtctttcctcactgtgatataaagttcacgaaattcaggtctgtcttgttcactgctacatccttggcacttaaaatgtagttgatgctcaagaaatatgttttggtgaaatgaatgaaacatactatacacataattttggagccagctactttaacctccagacacttaagattatacttcatctttcttaaaatgcgtccctccaaaaatcatatgaaagcactgttcccatactccaaagactatttctatgaatgcagattcagaaccaggaagccttcgtcttttggcagtcttcgagtctcttcccttttggccggtactgccgtagagactacaacggacacagccttgcgtggatcattctttagaggacccaactcaccaaagacgggagaaagttgttcctaggcaagcagcccagcccagggccatgtcccgccttaagccacacggaggcgctagagcgccacagtctccgcggggcccggggcagctgggagaacgactctgggcggctgtattgactgccgggtgtgggcggagcgaagggcgccccggccggtatggcgggcaggaagtgcgggtgcgcgcctgcgcataggtcgggtcggcggtgtcaccgctttcgcttctgcttgagtcagtcctcacggtgacgcttttccccagcttttccgagtaggatcgtgcccaggggaggaggcagagtgcggcagtggggagggggcggagcgcagagcgcctgcgggggcgcccgggcaaggagtggggatccttggggatgggggtacgggaggaggcgtgggtgggcgataaggctgcgtggaggggaggggcggggggcgccggggcgggagacggaggggatctgtcctgggggagcccggttctcccctagccttgcccggggcacgccggtgaccccgtgtgtctgccccgtggcagtactttcgtgggccgcctgccctccccctcagcccgcccttatccgcggctccgctttcagagcagggtttctcacccgcggggcttcgggctcctcacccggcacctctgccagaggggaccgcctcccggcgcgtcgggcattcgtctctttcaccccttccctcttcaggagaaactgaacacgttttccagcctaaactcggcagggcaaaccagaacattccccgtctaagcagttccggggagttttaacaatttcctcgtaaactcgtctacagaactcactgtatactgtttaaatgtcgcctgtgtgtggagcaacagttttattgtgccgtgcaatcctcaacaagaaattgtagtccagggagatgaaaatcccttatttggcattcaggcgttgatcaaggtcgtgcaaccctcgctaaaaggatttaggttcatctccgtcattctcagccggggtgaaggggtgtagtctgacatttggaagcttaagaaccaagtctgctgccgtccaattcttttttaaagccttccatcatgtgtgtactttgcttgaatgattattttaaagtacatgtcctatttttgccaatctgacagctgtttccatagaaactagagaagaaatagtcattttcagcaagagttgttaaaactgtcttccaggcttcagctgtgagtgccagtgagtgctgcacttgctcattcggagatggtacttaaagaattaaggatctgaaatgttcgtagaggctaacaatccaaattgtttaattttctcacatcattaattttgttatcctagaagtctgccagctatgtttgttgacctgccacagctctttgaagagaatatgtcagccctgatttttttttttcttatgtgctctgtagtctagtgattggctccttgaaaatgcatgaatagatttcttccctcattctttaccctttcttcaggataaaccgggtattacaaaatatcaggcactgtttctattcaaaacgacacttggttgtcagtgatagaaatgataatggttttaattatatatgcgtagtgttggggcttttgcttataccttctgtgtcaataggattcttttaaaatttttacacaagtcatgagaaatgagaaggagtttgcttgtcatgagcagagctaagcagtgtgaatagatgtgcatagacatagagatgagagctttctttttctgtggggtgtaagtaaatcagggagtttggaatttaggaatgggtgaaggagggttggggaaggtgcctggagaagtagtaggagggcctggttcgccatatgaaggagtttgtggaagccatggaaaaccaacgaaagtccaggcgtggtggctcatgactgtaatcccaacacttcgcagtgcagtatgatcagttgagcccaggagttaaaaaccagcctgggcaacatagtgacacaccgtgtctacagaaaaaaattaaaaaattagctgggctggccaggtgcggtggctcaggcctataatcccaacactttgggagaccgaggtgagcagatcacttgaggccaggagttcgagactagcctgggcaatttgccgaaaccccgtctctactaaaaatacaaaaattagccagatgtggtaatgcatgcttgtaatcccagctactgaggagactgaggcacgagaattgcttgaacccaagaggcgaggttgcagtgagccgaggtggcaccactgcactccagcctggacaacgacaaagtgagaccctgtctcgaaaagaaaagaaaaacaatgggaattacagaaatagttgcctgagtggaggtttaaaaaagtaataatacatcctgtagaaatttgaactgcacagaaatatataaggtgaaaatactaataatccctcttaaccaccattctgccattcaaaataattgtgaatagtttggtgtatcttttttcagatttatttttgtatatactagcatattttctcattactatttttgcaaattggggagggtttttttaaatctgttttgttctctgcagtatctctagcatccattatggtgcgtagcatttagtgggcactcattaaacattttcagaatgaatgaataataatacagttcagaggtcaaaaatacaaaatctgaatgtttgattaaggtcgttaaaattttttaagttcattgccaacatttaaaaattgataaatttcacctaaaatctgaaattctggctttacttaaaagttttgaatcatttggccacagcaagttcaaattccatcataactgtttgcacctcctttagatggtcatgaatctgcattcacatcagtatcactttgctgatattcacttgcctggaccctacaaacctgtactgtgcgatacagtagacactagccacatatggccatttaactgagttaaaaatttcattcctcagatgcaccagtcacatttcaaatgctcagtagccacatctaggggctaccttattggacagtgcagacatgaacatttttatcattgtagaaaggtctgttgtatggtgcttctttagatgtttgagtttgccacctctgttatacagaagtttttaggtagcatttattattatttttaaatttgtatatccctttgccagagattgctatcttttaaatcttttaaagatttacagatcatcatgtcattttttaaatgattacatggtatttaccagggtaggactgtatgttaattgtcggggtaggattctgttgccagggtttgcattttagaaataatgctttagctctagtttggggtcaaactgtagtgggaggggttagtggtgaaataaggcagggagattaggtgggtagtgatcaacaccataagaccacagagcccaggaaaggctagaatgagataagaaggaggtagaattgacatgactgatttaatgtgggctgagatattttggatgctaaagttgctgtagagataatccagtatttctggaactgattaaatgttgaaaattggtaaatttggctttgcaaagtgtaggaggaaccctcagctagttccagtaaacaacatgtataatattaaaatgctgtcaatttacaaaaacaaatgtataactgttttataccatgtaaacgtcttagagatcatttatttgcagaatacagaaactcattgaagaaagcgcattattttggggataaagtaaaagctcatgaagctcaattaagtgtaggaagtacaatggtttcatgggaatcagggaggtcttattctctcatattcactctggctttgtggtctctcacttatcttctgtctacacttaatagtccattgtcttttctgtggatccacttttttttttttaaaaaagctttttgtttgtagttcttgctttcatattgctttgtttagccatagcacccgctgtagacccaacttacacatgcccttatattcctgtgcggaatactgttttatgtaaaatcttttcagtatcaaatacctactcctagctctgtagctaatggtaggggttgctagggatgaatgtggccgtctaagcctgtcccctaaaatgaggctgtaagatgcacatttggaaaaggacttgtgcttgggcaagtgtctgaagcttatctactacagtaaatcatcagatttgaggtcaaggaaagaaagtgggcttgggttgtttttgcagtttgacttctagaagaagactttacatttaaaccttaatacactttcccatttaaaacagttctttccatttttttttgtctttctgcatctgcctaaatggcatgaaaaataattgctgccttcctgaactcttcagctactcatggatgtctttttaagaatgcatacagtatgtagtatttaataactgaattttattatcccctaatagtcttacttaggttcagttttgtctccccaactagattataacctccatgagagcaggactatattctgtgctgcataactctcatggcccctagccaatgaaaaccttactagctactccagtatgaattgtgaaatgacttctaggcttaaattatttaacaatttttcagcttggttcaaaaaagtaaaaacaaagtatcttgttaataatgtcaaactattatatatcagcctggactttactaatttaaaattggttgtatttcaaaaagggttaactcaaagttaatgttttacttagcatgccctttattaacattatacattaacagtgcaagggcaggatgtatgaattacataaaaaataaatttgagtaattttcaaatggtttgatatatagataatactattaaaactggtagtcctggagcatctttctagataatatcgtattagcttaggttgaagtttacatatttttttccccaacttttatatgaagattttgaaacatgcagaaaaatttaaggaacacatatgtaactatcactgagatacaatgattgctgatattttgtttattgactttatgtcctttgtgtgtgtacctttgctgtacaatttgaaagtgagttttatttatcatgaacagatccttcagcaagtatctcaggaataaaatagtcagataaccacaatattatcacctaagaaaataataattacctaaaacaacttgaaattcaattcatatttagattccctcaatctgggtttttttgttttttgtttttggtttttttttttttttttttttttttttgacaggttctcattctgttgcccacgccggagtgtagtggcacaattttggctcactgcagtctcttgcctcccaggttcaagtgattctcctgcctcagcctcccaagtagctgggtttacaggcaagcaccactctttgtaatcccttcccctgctgcttttttcctacaactcctcaagcagtcactcatctctctgtcactatggattagtttgcattttttgcagtttatattatagagatgtaatcagagtatgtactttcttgtgtttttcctgttttttttttttttttttttttttttttttttttttttttgagacagagtctcactctgttgcccaggctggaatgcaatggcgtcattttggctcactgcaacctccgcctcccgggttcaagcgattctcctgcctcagcctcctgagtagctgggattacaggcaagtgccaccacacctgcctaatttttgtatttttagtagagacggggtttcacgcctcgaatgcctgacctcaaatgatccacctgcctcggcctcccaaagtgctgggattacaggcgtgagccaccatgcccagctttttttgtgtttttcaatgaatttatacagttcacctaagatgtcaagtttaagattttatctttcattgattttaagaagttatgtgccttgtagtttttttcctttgtgtttcttttgtgtaggatttgttaaactttttgaatttgtggttttataattttcatcaagtttggaaaacttttggccattatttcaagtgttttttttttctgtctacacctcctccccgctttttggggacttcagttagatgaatattaggccacttgaagttattgcatacctcattgatgccctgtgcctttttttattattgtattttttctctgtatttcattttagatggtttctattgatacgtcttcaaagtcacaaatctttatttctacaatgttaatctgctgttagtctcatctagtatgtttttcatcttagttcttacagttttcttgtctaaaagtttaggtcttttaaagaaatatattacatatctctacataacatgctcatattttcctttagcttcttaaacatgtgcagtatagttacaataactaatatccttatctactaatgctgttatttgtttatttaggagttagtttccactgattgatatttcttctaattgtggatcacatatcttgctgcttgcatgcttggtgatttttaattataaattgcaccttgttaagtgttaaatagttttgtgtcctaatacctgtttagattttttttttttcctgggatgcagttgttgcttggaagcatttaatctttttgggggttgcttttaatatttgttaggtggggccagagcagctttcggtctcagactaatctttctctaatgttgaggcaaaacccttctgagtactctacccacgaatgataaggttttccactttgaatggtggggaggggataggcagtataccatgccctgtgtgagccctgtatattattccctgcaatcttttcaggtggccctttcccagctccagggaattttcttacacatatgcccagacaggactcagctgaatatgggagggggattctctgcagaactctagagttatttctctgtgcagctcttgtcttctcttgtcctctgtcctgtgagctctagcaaccttggtttacttgacctcccagctttatctcttcgatttaggggaaccactgggctccacctaggtttaccctgtctgcattgtggcctggaagcactctccaggcaataagctaggacagttgtagggctctgtttcccatctgttagggatcactgttcttcattgcgtaatgtccagtgcattttataagttagattttactattctgtatcacatgcttccttccagttattgcaaactgataaagttttactgttgtttttatctaatccactttattgctcaaatcatttgccattaaaatacaaatggctcttccctaactaaaaattaaaaatgaaatgaaaaaaattcaagcttctaaagtaaacgttgcatagtaaatatcgtggtatatatactctggtttatcttgctgaaaggcgttgctctaggggtgatgagttgaaacccaaggtaatttagcctgagatgtgttagaagaacaactgacacgcctatttaataagtgttatagtcccagtttggtaagtaaatattttccacagatatttatagttttttttttgtttcaggtagtcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggtaaaatgcttttttagaataaaaacttttatattaactttttgcattaatattttgtgctaacgtattaacttttagaaattaatttttttatttataaaactgtacttttaaagaaaccttgccagatcccctgtctccccccatttagctcaaagtgaagtttctaaacagtaggtcctgcccaattttgttctgtatgatttaataatcttgaaacaatttcctgcatactaatttatggtatagaaatatctctttaaaaagttattcttacattttgtataggcattaaaaaaatcttatatttatgactacaaaatcttaggatatatggatcagaagtgctggttatcacttatgtataagaagagtacttacaaacatttctttttaatttgtggaatttaaggcagcaaatcataaaattgaggaactttgcttatataagggtgggctcactcctagttaactcttaagtcattaatgcttcttttctttctattctgttcccaacaaatctttgtttttttccttggtgatcctttataataatattttcacagcttgtagtgctttaaccctttttctcttatttgttttatgaagatggaagaaagctaatcactgtttcttcataaagctttcttgtgtttgatgactgtgaagtcccttctagccttcttactaccacatgaaccaaaccagtttgcttttgatcaaaaaccaagaacttctatttgtaacttattgtgtttttcatgatttggtgttggcacccaaaagcgatacagctgtattgactattggttgaagtaatacgctcatcccaggttcttcggatgctctttctgatttctgctatgtcctcatccttttaaattatttatttgtaactttcttgtttttgttactattgttgatcacctaaaatttttcatttagaatatgtctttcatacattttaaataaaggataatgtcatgtaaagttttaaataggaaataagtatactcgatagtttgatttatgtccctttaaatggacacactttgtgtaaaggcattggggtgtgtcacttcacaaagagaactttaagaatttgtaaaataaatttttgtcaagagaatgatgtatatatggtaaatttttgttgtgattttacagatcaactcataaggaaaatttttgtcccagtattgaaaacattgcttgttgtcaaaatgtttctgaacactgctaagtggcagagagtattgttgcctggtagaaattggaccttctcagatgttatctataaaatctcccactttcttatgaatacctaggatcttgttatctctcctttttcacgttgtaaagaggatagtggagtttctgctactgagcactatttatttccaaaatgaatgctgaggcagtttcccttgtaccttgtggaatcactggcaaattgtgttggaggtctgaggagcagtgggaaaagtagtggttccaggtatagatttattgtactgtaacctcttacataattatttaggcatttatccctattaagtggctaagtggtcagactctggaatgtcattgccttcattgcttggttttccttttattacctcagtggccatggacaagttacctaacaattttatcttctgtaacagggttattatgaagattaaatgagatggtatatatatatatacagagagagagagagagagagagaattttgcatgtactagatagtaataaatattaaccagtggtagttatagtaaactagcatctcatttagtgtttatccttaaaatagctgaagaagaaaatttcgatgagtattagaattttttaactgtaactttacatcattgattattttttcatcatttagctaagaattttattaattggaaaagcgatgtattcagcgaaatacatcatacaaattcaggtatttgaggacgtaaaattctagtgtatgcatttgagctttagtgatatgtgctggaatgattttcagaactttgaatttttctttttgctttaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcagtaagtagtaagagttgtttttaattagactgcttaatataacactcaaagtaggaaagtatcttaaatgtgaaagatatgttgttttttaattttagtctttgatatgaaattagcatttttttttcccgaaggcctcagacctttcacacttagtattcctactgcctacattgcttttcctagcattcacccagctaactcctgctcagcacatttcaccttaaatgtcacttttctcaggaaaaccttccttgattatccagactgggttaggcagggtgactggatcaggccctaggaggtatccttcataccgactgaattatgaaccagctcatttgtagttgcgcccattgcttggctttactggggttaggtctcctaggctttttttctctgcatactgtacttttccttcaaagcactcatgagagtaacataattatttgcataattatttttttgattgtctttcttgttagactaagcttcatgggggcagggatcttacctgttttgtttatggttttaaatactaacacagtatgtaagagtagagcttagtatatatttattgaataaatagatttatagtcagaattcttataccttgaaaatcaagtaatataagatttttttcccaaacatcagttttagcaatttattatattttttgaatccaaatttaagttataatttagaagtcttacctctttggaaagtatagtaactcaggtagttaaacattttgtaccctagtgagtttcttagggacagaggtcattttctctccagttcatagcacatacacatgttatgtgccctgtggctcaattaatatttttcgaattcatgtccagtagcctcacttgacagctttggcatggctgaatcttttttttttttttttttttgagacagagacttgctctgtcacccaggctgtactgcagtggtgccatcttggctcactgcaacctccaccttacaggttcaaattattctcctgcctcagcctcccgagtagctgggactacaggcgtgcgccaccacgcctggccaatttgtgtatttttagtagagatggggtttcatccgtgttggccaggatggtcttgatctcctgacctcgtgatctgcccacctcctaaagtgctgggattacaggcatgagccaccatgcccagccgcttgttgattcttaagtgaaaaaaagcatacactttatgaaagttaaagtaatatttcagaacatttttaattttctcagtacacttgaaagagctctcatgaatataacttcagaaaaagtatcttctgtggtggctagtcttaatcagcatcttttagagacagtgataatgctcattagttctgagaattcagtaatttcctttcaatctgtgagtaaaacaccttaaaattaatgaaatgtctattttggtagtttaactttcttattaggtatagggtgtttttctgttcaatgcattgtgaatttaattttcttttgtattttacttagatgaaatcttaagttctccaggctctccttttcttttctttttgagatgggatctccctctgtcacccaggttggtgttggagtgcagtggcgagatctcagctcactgcaacctccacctcctagactcaagcgatcctcccacttcagcctcccatgtagctgggaacacaggtgcatgccaccacgcctggctaattttttgtgttttcggtagagacggggtttcaccatgttgcccaggctggtcttgaacttctgagctgaggtgatcctcctgccttggcctcccctagttctgggattacaggcgtgagccatcttgccctggcctaggcagtgttttctaaaatgtttaggaaagtagaaataatacttaagtattcgtttgtagtttaatcgaaaagaatgaaattttgatgtcaatctattcataaaaaaacttagtattagaatttattcctttgtaagaaaccacattgtctttgcatgaataattcagatttgagaaatttcagtgcttaatatatgcagatttttatataattaaaacttaaaatgttcaataataagtagccatataactttccatgaagcagagtaagcattttgtagtgctcttttaaaataagaagtaatttttaatctttcagtggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccagtaagtaaatgttctcaaacgcattgtaattgttaaatttattgtccttattttttatgatgttctaattgcttacattattttctttgtggtgcagaatggacaaatgtttgttttcactggatttttaaatagtgtaaccgatattcatcaactttctttccttctgggccatgaaatagcacatgcagtacttgggcatgctgtaagtacctaaaatgaatgttcaggtttggaaaaactgctttgaagttaacaagttaaatcttttaaagaactgatttttttcaggttttttaaaaatgatagacttttagttttgggtaattgccttaatctgctacctgaaaaaaacgtgattggctaattttgagaatttttatggtctttagtatttgatactgaataatatttttcttaaatactatttttatcacctgtctcttttgctaaaacgtaattattctcaacccctaattatttcaaattaaattttaaactttctataattattaatatacttgtaatctagtcagaaaattaattgtagggaagtgatattactatttaagtgggtaaatcatctttcttttttattcattctcagaggatagcttggagcatctttgaaaatgtctagaatgatgtgtcatgtgtaattaatacagagtaataacaataccttgccattttacagtttactgagctttttagtatatgtggcttcccattcataattttaatacccaatgaggtatgtatttattattactattttatataagagaaaactaatgtttagaaaaacagtaacatgactaacctgacaaagtaaccgaactgggactttaacgtgggtcttctgtatgttagtccagtgtttcttcctttcactacagttacctggtttttagcagcgcttttcttatagatcatagaattcaagttgatgtatgctcctgtgaatacatgtctgttcatcttgatataagtccaggaaaaataacacatctgtttcacacattttttaaattgttattcatttaaaaatataaatggctcttttgtctacattagagaaagtattttttaaattgtaaacgcaaaggtacatagtgaagtgactgaaatgctaaatcagaaatacaagtaacattaacttcaaatggaaatgataatgattctaatccttctaagagtaatctcaaattctacctgttccttagactattaataagatgagatgggctaaattgtttttctgaaacactgaaagtaattatctccttgatttcttttgagttacaggaagattttaaaaacatttttcttgactgggtgcagtggcttatacctgtaatcccagcactttgagaggctgaggcaggagtattgcttgagcccaggagtttgagactggcctcggcaacatagactcagtctgtacagaaaaattttaaaaattagctgagcatggtggctcacacctgtagttccagctgttctggagcctgaggcaggaggattgcttgagcctgggagatcaaggctacagtgagccatgatcgcaccactgcactctagcctgggtgacagagtgagacactgtctcaaacaaaaaagtaagaaaaaaaatctttttttcttaaacaaatatacacaagaatacgtctaagcagtgttattatatgcactctaatatctttcaagtaatggcttcacaactgcaaaatcagttttggccattttagcatttgaaaggtgttactattcagtacatttgttttttaggcatctagttcagtgccttatattcagtgtattgtcatctctatcagtgcaagaacagtagtagatgaggtgtaaaaagcaaacagcagccttaaaaatagaacatagttattaatatgtttttgcagagatcttaaacattgtcagcacaatattttctcttttgggagtctcagttttgattttatctaggcgtttatgttttctttattctacaaatacaggtttttgtgtgtgtatttccagttttctaagactgtataatagcaattatattctttaataacaagggctttctcttctataacaacttccttattttgagtttcactttttcatgttaaaataatttcataattgggctgggcacagtggctcacccctgtaatcccagcactttgggaggctgaggtgggtggatcatgaggtcaggagttcaagaccagcctggccaacatggtgaaactccatctctgctaaaaatacaaaaaatagctgagcatggtggtgggtacctgtaatcacaggtactcgggaggctgaggcaggagaaacatttgaacctggaggcggaggttgcagtgagtcgagacctcgccactgcactccagcttgggcaacagggcaagactctgtctcaaaaaaaaaaagataaatccataattgtttttcaaaacacacatttgtgttttgaggcaaagtaatgaggcaaatataaggaggtaaagtatgttttgtgagggtacaatatttgttaagggacaatattctaagtcagtttttagttttcagtcatttttcatacattcaagtaatgactgctattttatcagtttcagcattacaacattaacatttactaatcacctttaatggcaaaccatgaacaatctagttcattaaacttagatattactactcaaaacaactattttatgaaaaatcttttttggtaactgatataagtaaatacaaaaattcatagaacctgattctttcatgataaatactagacttacaaatttacaaacttgtataaatgaataatatttcatatattaggtcttgaagatcagaatacttttatttaaaataaacttccagtctttttctgaattttttcttgttttaagtgcttcatatgttaggtagtgtttagtctttatccaaaaatattagtaaaataaaacatttacttgattttttaaaatgatgcaactatattaaaaactaaaactgaccgggtttgatttctggtccttttagtaatagctgtgcaaatctgggcaactcttaacctctctctatctcagtttcattatctataaatgtagggataattgtagctatttcacaagattattatgcctgttaatataagaaattgtaggtttatatcctctgactaatagtaagtggcttagtagatactagttaaatgaatgaataggtatataagtagataaaccaaggaagggaaaaacagacccggaaagaataagcaaaagaagaaaaagagaactctcagtcttaggtggagaaggtcaggtaattgtaacacatgatgaactagaaaatgtaagcatatactgtctcaatgtataaaatgtagtttttattattttgattattcttaggcagaaaaggctggcatggttcatttgttggatttcctaggtatgattttcctcacaatgatttgggccatttgtcctcgagatagcttggcacttttgtgccagtggatacagtctaaattgcaggaggtaagtctgagacaataacttgaattgatcatagcctctggtgaagatattttaatactactgtaaagcagcaaatccagagatgtttttacattttactatgaaatatgggtacgaatttttagtgtcttatgttttctcgtttttaggggatattcttatatatgaatatttaaattaaggaatactacatctctcaaatgatgggtatggagagttagaagggcttggcaacttttggctaataaaatttttgaaaatatatttattggttttacagagagaaaacccagccactgacccttcctttcgtagtaactgaatgactcccaaattcagctgtcccttggtatacaggacttcttgtggataccaaaatctgagtatgctcaagtccttgataaaaaatggcatggtattggccgggcgccgtggctcatgcctgtaatctcagcactttgggaggccaaggtgggtggatcacgaagtcaggagattgagaccatcctggctaacgtggtgaaaccctgtctctactaaaaatacaaaaaaattagcctggcgttgtggcgggcgcctgtagtctcagctacttgggaggctgaggcaggagaatggcgtgaacccaggaggcagagcttgctgtgagccgagattgcgccactgcactccagcctgggcgacagagtgagactacatctcaaaaaaaaataaaaataaaaataaaagcatggtgtttgcatgtaactatgcgcatcctctcatatactttaaatcatctctagattacttgtaattcaatgtaaatgctatgtaaatagttattttactatatatatttttaagttgtagttttttaaattgttttttcgtagatattttctatccaaattggttgaatctaccaggtgcataatccacagatatagagagccaactgtatttgggttttaatgcggcactgttaaaacctctgaactttaatgggcacagaattggctaaagctactttgccatccttccttgcttttcactctgttaaaatatcattgctttgaaaatgctgaaaggaaagtcttactaggtgtttgttaacttttgtttttagtgcttatgtataataatcatctcaaaaatgtattgagtgcctcattttgtccaaaacactgtaatactgaaagtaggtcttgcaatctttataactactttgttaaccataatttttttgttttacatctttctttgaatatttcctcttgtcccaggaggtttggttatttaggaacaatctgttatttgtttatttaatgatttgtggagttcccatcagagtgccatctgggtgctgtttaaatctaatgtgcaaaattctatgagacaaattgtttttgagattggataactaagtctattattcagtattaacatgtcatttggcttcatttatattgaagtaaaggttcttaaagagaaaataaaagattggttattccttaggttgtaggatctcatattttgaattttgtttctgtcactgacccgccaggaaattaaaagaattaatgtggttattttcctgatctatctatagattgcttttttttataatggaatcagcacagttggtcataagaaagataacatttatctatttctttcttgaaatacttgataaattctgccacttcactgtaattcgtcaatgaaaataaagtaggaatgattctatttgaattattttttcctaaatcaaggcccctcaataattttggtgacgaggagatgtttctctctagaaagttgctcactgtgattggagagcagagaggaatgttgatagtgaagtcattagggtgtgggaattgctgaggttcatctgttgtgaggaccgaatgacacatttaaagcaggatttctcaatctcagcactactcacactttggactggataattctttgttgtgggggagttgtcctgtgcactgtaggatgtttagtagcatttctgacccccattccctagatgtcagtagctctccctcctctcagttatgacagtaataaatatttccaaacatttgtaaatgtccctggaggacaaaatcacactaggtttagaatcattaatttaaagcacttagcacagtacctggcacaaatcagggctcaataaatatgagctgttatttttgttcatttaatcccctctgcagctctgtgagcttggaactgttactagcttcattttacatatgatactactgggtttagcagggttaaacaattagctcagggttaacaataagttaacagtatttggacttgaacttaagtttctctctttttaaagccacagttttaaatccttatgttatcaatagacttgacgggggcacatgcagcctgctcatggggagtgaaggcattatatgatatacatcattgacctaaaacagactgattgaaaaggaaggaagtcatttgtaatggtcacatactgtatatcagatttattatattatttcaggccatcacagacatgtggctacctttgaaagattgcttccccaattaatagctcttttctcaaaagtcctgcctattgattcatctcctacaaagttttagtacttactgaaaattagaatttaactggaaagcattcacataaatacaagtaattaggaaaattaaagttactgtatctatgtgtgttttttattgaagtcagaagaaaatttcattttcccaactaatcaatacttagaaaagaaaaaggaaattaagataatttatcaaagaaagagcattctgctatatggttaatttttttactgaaataaattgtctagtagtgtcattggatattatatgcctacgttttcttgattttcttttaaaactcaaggtcaaaatattccttgaccatattaaaaagccttcatcaataagctttcttagtgaatcctgtactcagtaggtggagactataattggaaaaatagaagtaaattccttatactacagactgtcaagaaatttataggcatgacttatatccttatcattttttaaagtatttctaatcagggaaataaaggctgtgtttatattttatatcatggagttattttaatgttagtagacagtataggaattttatcctagatactccatgaaactgttttttaaaaatctctctgtgttactccttttttcgtgaaataaattgtcttaatggagcttttctgtcatttcttcttagtatatgtttaatagaccatacagcagaaaattggaggccgaagctgacaaaattggactactgcttgctgcaaaggtaaagtgtttagtagttgagaatacataatgcccttcccaggctgaaagataaacgtgtgttattttaatgaggcttggcataagcagagaatgagagttggactgtattagccctttatgtaatttctgttaatctagaaatttgaagattatggaccttgaaagaatgtataactgaagagtctcaattcccttctatatttgaagctgtattatgccttagacagaatccataagattatagtaattatcaggttctattaaaagaaagtcagttcttgattggaaataattttttgcgtgtataaattttttgatcatagacatgaaacatacaaattgaaattttaaaacatttggttatgtaatgtgtcatcccctctggccttttaacatttgtccctctggaaagctaatgctatctctttattttactccagtactccaatattttaccccttgcttctctgatctaaggaggctttttgagtaaacaggttgataggtagttgttttcccccacttgaagataggttgatcctgttgtagctatgatcttggctaagcaaactgattttctaccatttaaataaacagtaggcgaacagacatttaggttatttttgttgtagcagatggcttttttttttttttttgctagccatagagagcagctctgggcctttacttttatttaagttgactttgttcctgtctacttaacagggcacctggcagctatttttaatcacctgtgataactgagtgttattagtagcatttaagattagaagtaaaactgcattttaaaaaaatgagtgaaagcaatgccacttcacatattaaattcaagttttaattgatcctttgttatgtttctggtagttattaaaactattaatcattttatttgaacctctcataagttttatggatttaatttcataaatcaaggtattactccttcacaaaagcaaaatcagttctttgaatgttaaataaatgtgattaagtgaattatcagactgcgtgcactaagaagttcccacataagggggccacagattggctgtattaagaatttcctaattttcatgtactccagtctgtcagattttccctatatgttaagtgtgttctgtgttctggttaggaaatctttgtttatctcagtaagttattcctgctttatttctaataaactttactatttttaaaatatataatatgaggaagagggcaacatcttttttttcccctatggatagctaatagactcagcactgtttatggaaaaaagtcacctttttttcaccagacttcagtgtctctttgtcataaaggtgggagtatatctggggtctctttctagacacactattctgttccattggcttgtttatgtttcagccagtaccatattatcactataactttgtagtaagtgttgatacctgaagcttctgtcctccagtgttgttctgcagaattgatttgactcttcttggatctttgcatttctatatacattttagaaatagcttattaaattatacatacatagaaaaacacatggggttttgattggaattgcattgcatttatacatgaatttggggacacttgactagtgtctgtagtattgattcttcccatccataaatatgatatattttccagtttgtttagatgtttaatttttctcgatgttttgaaatttttttgtatgtaggaattacacatcttttgttagatttattgctaagtgtttgatgtcatgataaatagtgtcatttttaaagtaaattgcttgtatataaaaatacaattgattttataattgaccttgtacccagcaacctttatttcttcctttccaatctgtatacagttgactcttgaacagcatgtttttgagctgtgtagatccacttatacataggatttttttcaataaatatattggaaggttttttggaaatgtgcaacaatttgaaaaaactcacaggtgaaccatgtagcttagaaatattgaaaaaattaagaaaaggatatgtcatgaatgcataaaatacatgtagatattagtcttctataattttttaccataaaacacaaatcggttatgaaaatttatcaaaacgtgtgcctacacagaccatacatggtgccatttgcagttgagagaaatgtaaacaaacagaaagatgcagtattaaatcataactgcatagaattaactgtggtacctatggtactactcttatagttttgtattcacttcctgttgctaatgcagtgatctcaaatattgtgaatatctacttaaaacaccagaagacactaatcatctccatgtgagcagctttctctccagtaaattgagtatcttagtaaatggtctcttgcagttcttgcatatttttcattgtgtttagtgcaatactgtaaacaccttgagtaataccatgagacccatatgagttgctgctagtgatactggaaatgttcccaggaagtaaactcatgatattacaagaaaaagttgagttgcttgatatatactgtagattgaggtctgcagctgtggttgcctgccatttcaacataaacgaatccagaataaggaccgttgaaaaaaggaaaagaaaatttgtgaagtcatagctgcaactctaccagcaagcatgaaaaccttgcactttttgcaaaagacttttatcttgtatagaagatgcaccttttatgtgggtgcaggattgccataagaaaggcctatctatagactctaatatgattcaagaaaaagcaaagtcattatattacaacttaaaaggaagatgaaagatctaaagctggagaatttaatgccagcgaaggatggtttgatagttttagagatttggcttaaaaatgtcaagataacaggagaagcagcttctgctgaccaagaggcagcagatgcattcccagatgctttaagaaaatcgttaaggagaaagaatagctgccggaacaggtttttaatgcagatgaaagtgtgctattctggaaaaaagataatgccataaaggacatttattaatgagcatcaagatttaaggcagaagggatatgctaactctactgttttgcggaaatggagttggatttgtaagtactttccttatctataaagctggtaacccctgagcctctaaggaaaaagataataccagctgccagtcttttggttgtaaagcaaaaaggcctgctacacaatgagaacgctttttctggattggttccatccatgctttgttcctaaagttaagaattatcttgccagtaaaggctgccagttctttttttctttttttgagatggagtctcgctctgtcacccaggctggagtgcagtggtgtgatctcggctcactgcaagctctgcctcccagcttcacaccattctcctgcctcagcctcccgagtagctggaattacaggcacccaccaccatgcccggctaattttttgtgtttttagtagagatggggtttcaccgtgttagccaggatggtctcgatctcctgacctcgtgatccgccctccttggcctcccaaagtgctgggattacaggtgtgagccactgcgcccggccaggactgccagttctttttacattctcaattcctctggtcacctggaaccccatgagttcaacactgaaggcgtccaaatggtctacttgcccccaaacacaacattcctagttgagtctcagatcagagggccataaggacctttaaggctcagtacaacagggtactttagggaaaggttgttactgctattgaagagaaccccgatagaacattatgaaagtctgtaaggtttacaccactgaagattccatcattgttatagaaaaagccatgaaagccaccaagcctgaaataataaattgttgatgaagcaaactatccagatgttgtgcgtgaccacacagagccagtcaaggaaatgatgaaaagattatggatatggcaaaaaaggtggggagtgaagggtttcaatatacagatcttagagaaattcaagagctaatagaaacaccttatcaggggaattaaccgtggatgacttgatggagatgagtgcttccaaaatggtgccaggtagaaaagacatagtagtgccagaaaacaaattgacattagacaatctagcagaaggattctgattattcaagactacttttgacttattttacaacagaaattacaaagtatctccattaagttacactgattatgcctgcctttcctgtctcccgttctacctctgccacccctggaactgcaagaccaactctcctcttccttctcagtctactcagtgtgaagataaggatggagacatttatgatgatccacttccacttaatgaatagtaaatatattttctcttccttatggttttcttaataacattttcctttctctagcttattttattgtaagaatacagtatataatacatataacatacaaaacatgttaatttactgtgttactggcaaggtcaacagtaggctattagtagttaggttttgggggagtcaaatgttacatgtggatttttgactgcacagaggggtcagtgcccttaacctccatgttgttcaagggtcaactgtactttttaatttttgctttattgcaatagccaaaaactttagtacaaagttggtgatgggcaactttgtatctccctgatcttaggggcaagaaagcattcagtatttcaccattatgatgtttgttgtaagctttttatagatacttttttatcaaatgaaagagtttctcttccatttctaatatcctaagatttaaaaaaattatgtatatatattaaattttatcaaatgcattttctgcactttttcttcaactttaaagttccagggtacatgtgcagatgtgcaggtttgttacattaataaatatgtgtcacagtggtttgctgcacagatcaactcatcacctaggtattaagcccagcatccattagctattcttcctgatgttctccttccccctgcattttctgcctgtattgagatgattatatgatttttctcctttaatctgttattgggcaaattacattaattttttttaaagttaagttgcatttttggggaaatatacctaattttgtcaattatcccttaatatattgctagaattggtttaatgcttagtttagaatgtttatcctatgttcaaaggagatagtcgcctagaattttcttttcttgtaatgtcctgtcaggttttggaatcaaagttatgctggcctcataaaattgatcagggaagtgttcttcattttctcttctccagaagagtttttgtaagattagctatatttattttttaaacgtttggagaattcctgggtaaagccatatgggcctgaagatttcttcatgagtttgtctttaattatggattcagtctctttaatagatatagaactattcagatttttctatttcttgtttcagtttttgtagtttttctaggaatttttgtttaattttcaaaatcattggcatgaagttgttttaatatactcttattatattttaatgtctgaaggatacctgttattttacatgtatcttttaaatgtcccctttgttaatattggtgctctttgtcttgtcttttttttgctagattttatcactttcatcaatcttttcaaaaccatcttttgggtttgcttattgtctctattatataattgttttctgttatgtcggttaccattttttttcattattttattctgcattcattttttgggtttcatatgtggttctttccctaacttaagatgaatactactatcatttattttaaactctttttttttttctagtacatacatttaaggccgtacattttgctctgagagcatctttacttgtcatgttgcaagggttgatatgttattttttcttcagtttaaaatgtattcttgttttcgctgtggtttcttctttgacccatgggttatttagaagtatattgcttagtttttgaacatttgatgattttaaagttaccttttgttttcgatttctagcttagttacactctgattggataatatactgaatgactggaatcctttgaaaagggttgggtcttgctttgtggctcaggatgtgatcaattttgtcaaaatgacgtgcacttgaaagtggatcctgccattgcgggtggtgttctgtggatgtcagttttgccaagtgtgtcaattttgttgtttcagatcttctatattcttgctgattttttttccttttttttgtagttatcaagagaggtttggtaatatttcattatggttgtagatttttcttttttccttttagggctattaatttttgccgtgtacatcttaaaagtatctttaatatacatacttgttagattgttagattttcctagtggattggtccttttcttgcaataaaatcactgtctctagtaatacttcttgcctaatgtccactttttccttttagtattgttatttcagctttctttcagttagtgcttgcatggtaaatctttaatattctgattttcaaacctcctgtgttcttgtgtgtgtagcccttgtaaacagaacattgctgttgtttttatctttgcccttttttggggaaaagttagtctatttgtttaatttgcatttcttatttgtaattatttatataatgtggaacatttttatgtgtctattggcacttcatttatattcctttgtgaattatcttctcagatatttttcccattttcaaattgggcaaggaagtttgtgttcttattcttgagttgtaggagtttttcacataagtgctaggtgcaagttctttgtcagatatgtgtcttgcaagtgttttctttcattctgtggcttgctcttttattttttatttttttcaacgtttaggttccagggtacacgtgcaggtctgttacgtgggtaaattgcacgttgctaagatttggtgtacaaatgatcctctccccgaggtagtgagcatggtacccaaaaggtggtttttcaacccttgctcccctccttcccccttccctctggtagttgccagtgtctgttgttcccatctttgtgtccatgtgtagtcaatgtttagctcccccttatgagtgagaacatgcaataggctaatcacttaacctctgactgtccatgtatcagaatgtgttttccactacctatcttgaagttcattaatcttatttttagctgtatttgttctacattaaattcgtatttgagttttaaatttcagttactttgtcttttcattccagaatatccctttgatgctcttttataaatttcacttctctggtgaaattctccattttgtcatatgtttctttgtttatattttcttgaatatgttaatcatatatttttttaaaaattcatgtttcttaactctaatctctgtattatagctgggtccgtttctgttgtctgtttttggctttggtcttgtttgttggcatcgttgcttatttttgattgaatgctggatgtttcatataaacagttctgttggctctgaatgatatattttttttttccatcagaggtattctctgtgctaagtggtcacttagagcatagcagatctcttcactcattcagagcctgaggtgagtttgcataggctgggatgatgagctctactgtaagattgtaggacagcgatctagctctttctttggggaagcttcccatagaatatatattggcctttcctctgtggtcattcacgtgtctgcagatgaatcctgtaaaaactggctgttggatgtaccccatttaccctgatgtgattactatacatttcatgcctctatcaaaatatctcatgtaacccctaaatatataacctaccaagtgcccacaaaaataaaaaacaagtaaactggtttgtcagtgtttgaggattggcagtggaaaagggagtagggttttcccattcattgtggagacttttaaaaattctctgttatgacccttatacctcaacctttctttcttggaagtcaaatactaaacctttctggggtctctgcagtgtggggtaatcaatcaattgccaaagaagcgagcaataagtgtagagataatgcatgaactctggaaccatactgccaagtttgagaatctgctttcccagagagagtactagctgtgtgattatgatcaagttatttatcctttttgtgcctcaacttttctcatctgtaggataggaacagtattggacctatctcatacacttaatataattaaaattcttagagctcgtgtcttttaatcatttatcttaaaaggactgtctgctatctcctcttctttatttcacagatacattatctcaaacccagtatgttcaatattaaattcttaatttctccctacatgtgtttttcttctggtctcccttttcccaatgaatatactaccctctattcagttgcttttggaaaaaaaaccctggagtcctccagggtttatagataaagatattcgttctttatcatttactcttaattttttcaccaagtcctggcagttctatctataaaatatatctcagtatgttcccatctccagtactagcatcttttacctaaacttctgtagcaggctcatgatagctttcattgactccagtcctactcccctccattccattctccaccctgccacaagtaagaaacagatccagtaagctatgatgatattctcttttcttttttcttttcttttcttcccttctcttctcttcccttaccttctcttctcttatcttctcttctcttnnnnnnnnnnnnnnnnnnnncaatgacgagttatatttagaaagcaggggaaagaaccgcacacaaaagggacacaaaggcgcgaacgccaagaaaaacgcgaaaaagagagaaaaaagagcgctagaagaagaggggcaaagggaaagaggggggaagaaagggcaccatctcccctatcccctctcccctctcctcttttctttctgacagaatttcacttttgttgcccaggctggagtgcaatggcgcgatctcagctcacagcaaccaccacctcctgtgttcaagcgattctcctgcctcagcctcctgagtagctgggattacaggcatgtgccaccatgcctagctaattttgtatttttagttgagacggggtttctccatgttgggcaggctggtctcgaactcccaacctcaggtgacccacccactttggcctcctaaagtgctgggattacaggtgtgagccactgtgcccggcctgatactcactttcttaagataaggctttaagaagacattgaccagaattttcctccagacttttccctttctcacctgaccaatcccctactttggattgacatttaacattaatacaatcagaagacagtttgatcttacagacctaggtgctagctcttctctgatccattatgatgattttcatttattaattgaatgtaattaacttccagattatagggatacataatatcttcatgacattagaattcaagagacagaaatttaataaataattttaacaaagtttgaagtattatgaattggagatacaggaaacattcattccatgggagaatgtagcagagatgtaacttgagggatctctcaagttacatcaaattacataggaaaacttagtcttgggattagactgagaaagaaatagataaaatggagatctgaaagataaatagtaattatcctgatgaagatgttgataggtgtagtgtttggcatggtgtgttcaaaggcaagagaaacaatggcttattccaggaattgaaaatttgttgtggttaaaatgtcaacagaattcaagagcaccaatggcaacagataaaactgaaggataggcagaaacttctttattagcaattttaaggattttacaccttgtctagcataggggtcaggactttgggttcagtagtccagatgtgtgtttgagctcttgtctcctccacatgactgtagcaaatcacttaacctcttcaaatctgttttgtagtctgactagtgagaatcatgatagtacttccatcaaagagttattttgggtatcctggacttgattcttatttgtggcttgtatcctttttttggaccttgatgcatcagactcccttgacttcttgccattgtagcattcaaatcatgtcaacataatcctccttttcctaattctctccttcctaggcaaccttctgattacagcctggcttcctctgtagcatgcctaaaagggagagaaagtcctgacccaaggacatagatgcatgtgctcttgctggtttgggcagctgtagttatctctgtaaattaagaagttggcattctgattttatgtcaatcttgtgagcttggttactgggaactatttctgagagatggttctattggtcatatgcagtcccattggatttatgaggtttcaacgtgcaaaattcacaaaaacgatgttactcatgaagcctctttcaaagtaggcagcccactttccctagggttctctgctgctcctctgctactggctatgagtgattttattgtgcaaatttatgtttttataggagttcttttaatttttcatttggaaggcatttgtcgttatataaattatcagaatgattaatatagaattaataatcactggtaagaccaacatgtaaattaagcatagaataacaagctgttcagtcttcagctgacaaaagaggtcctgttaagtatttgatcttttggggtatgaatattcatttgtcactgtaaagagcttttgacactttgcagtcattatagaaatgactttttaaaaatttcacaagcaactaaactatcagttttaattttttcgtaacagtttcttaagtttggaaaagaaaactgatattcttttagtggttctgaactgggctagccttctaggatgacatggtgtatgattgtttttgattgtcatagttattggggaagtggggggaattattgatgtttaatgtgagggaaaaggggataataaatatcctatagtggcctggaaagcactcactgggagtaatccccaaagcctgttaagtggcccttttgggaaacgtggcctgctagtttcctcaagtaacctgagataactgtgccaatagcaccatctagtgagggcattaggtaataagcaaaatctatttttcatcacagaaatgagaaaatttcaaattctaaactttatttaaaatagtaccttgtagaatcatagacttttagagcaggaaagaaaattggagctaatttaatctaccttctcattttacagataagaaaaccagagtctaaagatgtaaagtgatttatctaataacctatacctagttagtaggaagacccttagttcttatttttcaggttagtattctgagctttcatcacagcaaagtatctttgcgttttatttgggttactgttttaggttctttgcttaatgattcttttaagaaagaaaagaatcagtaagtaaggagaccatcttatttaataggtatgttgtaaagtaactttcataatgcatacattatttggaacttaattttatcacccagaaaaatgagacaggcttgtgtgtattcatctgatttttcattgctatgatttcagctgttgagtcttatgataaaactttacctaagatagagggaaaaaagtaacatgaaaatttattaaaacttaatttattatattgattggtgaaatgacctgctggcaatcaaaagatgcagaaaattgagcaaaaaattaagattaaatgaccaacatatgtctttcatttttatgttggagcacatgaagtatttttgataagttttctcttggtgtgagggattggcaaatgctgagaatggcttagctgaaattatctcaagattatgttgcatttagttggaaaagagcaattttaaattatttcctggaaaaatgttgtttagagaataagtgggttacaaaataaaatgagctttaagaagtgatgccatcagcaatattggaaaatgatgaacctgtggaggtatgtgagactgaaatgaactagtttctggtagatgatgacaatgatgattgtagtgtataataatcaataacatttttaatgtgctgggcactgtcctgagtgtattacatgtatttattcttttgatcttcataacaaccctgtgaggtataggtaaacctgagggatggaggagttaagtaacttggcaaagctctcatagacagtaaggtttccctctcccaaagtggaggtacattcatttctgaaagggaactttccatcttatatttgcctgctggaaacaattttggttttctgcagtattgcttctaaaataatgatcatttttatatctgttttggtccctttacatcttataacagcctcagtgtatttttctagctgtaggagcccagctccccctgccacaatcctttgtagtattgtctcagatgattattttacctatcacatgtctatgtggaatacaggagaggatgctacaatgactgggacaagtgtagggtgttaatggtttcctaaaaaaagattcagattcattcagtgtcaggatttacctttggaagggggtgatggctaacaggagctttgttggagtgtctagtgaatacagacagcaaaattcagagatacttttcatctttgcatttctaatgaaaacgttggctacaggtaacggtacagttaggcttttacttggtctagatctatttatacatatttctctagtattgttttggcattgggaaatggtgaaattataagaacaatttttatactgctgtattctttatgaatatcatatcccactgaatttataatttaatagtagcaaattctttctcaatatgttccttaatgcatattcatatacatttatattctctggattgtactagaaccttcttgtaaattcatgacatcatcacttaggaccaaacatagcattttgcaattaccataggcctccagttgctcaccaggggaaaggaaggtagaaatagtgtccactatgttctgagtcctggaatggctgctttgcaagaattatcacattttaacttgacaattcactgctttaatttagttttacagatgcatctgagactcctagagactaaattattgacccaggggcaaaaactctgtcaccagactacttgtgttcaaattatggctctgtcacttactagctgtttgagctttgtcaagttatgtagtcaccatggatcttggtttcttcatctaatctgtaaagtgagggtcataacagtacttaccacatgaagttgttatgaggattaaatgagttaatataatgtgttaatatttgtaatacacttaaaacaatgcctggcatgtggtgtcatataagtgactgttaataaataaaataatcagtattttgaacccagatatttctgattctaaaacctgtagtctctccattatcttagtttacagtctcaaaaaatattctaggaccaaagtatttcactgacacatattttcttatgtttctctggccagcggtagccattattagttctgtttttaagaaggaaaggttacctagagtctaattctttcttcgtgtacttacagttgcttaataagttatttagttcagttcaataattttattgaagcaatgagttagactgaattagttgctgtattagtccattttcacagtgctgtaaagaaatacccaagactgggtaatttataaaggaaagaggtttaattgactcacagttctccatggctggggaggcctcaggaaacttataatcatggtggaaggggaagcaggtatgtcttacatagcagaagagaggaagagtgtgtaagagcagggaaaactgccttttaaaaccatcagatcccatgagaactcactcagtatcacgagaacagcatgggggaactgctgtcatgatccagtcacctcctaccaagtccctccctcgacacatggggattacagtttggatgacagttgttgacgagatttgggtggggacacagccaaaccatatcagttgcttaataagttcttagttttctataatacttttcttgaagcaaaagaattagacttgtgataaactgagtatttattttaaaaatgcctttattttggtctatcgttactttttttctcttttttagtaagtacatttaacatgagatctaccctcttaaatttataattttacaacacatacttaactataggcacatgctgtatatcagatctctagatcttattcattttgcagaactgagactttatatccattgaatagcaactcctcatttcctcctacttccactccctgacaaacactattctattctctacttctacaagcttgctactttagatacataccacatgtaagtggaatcgtctcgtatttgtccatttgtgactggcttatttcacttagcttaatgtcctcaaggtttatccgtattgttgcatatgacaggatttccttttttaaggccaaataatattttgatgtatgtttataccacattttcttaatctgttcattcgctgatgaacattcaggttgtttccacatcttggctattgtgaataatgctgcaatgaatgtggagtgcaaatccctttgagatcctgatttcaactcttggataaatatccagaagtaggatttctgaatcataatgatagtactttttaaaaattttttgagtaatcttcatattgtttttcataaagtccacaccattttatgttctcactgacagtgtacaagagttccagtttcttcacatccttgccaacacttagatgtctctttttttcaatgatagataacctaacaggtgtaaggtaatatttcattgtgattccagtttgcattgccctgatgattagtgatattgaacattttttctaatacttgttacctacttttgaatgtcttttttgaagaaatgtctattgagatcctttgcctattttttaaattgggttttttgctattgagttgtagaaattctttatatattttagaaattaactgtttatcagttatttggtatacaaatggtttttcccattctgtagattgcctttcactctgtttccttagctgtgcagagctttttggtagttccacctgtctatttttgccttttgtttcccgtgcttttggtgtcatattcacaaaatcattgccaagaccaaagtcatgaaacttttcccttatattttcttctaggagttttatagttttaggtcttacgtttaaatctttaatccatttttagttggtttttgtgtgtagcgtaagataagggtccagtttcattcttttgcatgtgaatattcagtttttctagcaccatttgttgaagagactgctctttcctcattgtggggtttgtgtgtgtgtgtgtgttcgtttttgagacagggtcttgctctgttacccaggctagagtgcagtgatgtgatcacagcttactctagcctcgacttcccaggctcaggtgatcctcccacctcagcctcttggtgcacaggtgtgtaccatcacacctgcctaattttttgtagagatggtttcaccatgttgcccaggttggtcttggactcctggtctcaagcaatccatgtgcctcagcctcccaaactgctgggatcacagatatgaaccaccatacctggcctcccattgtatatttttggtaccctcatcaaagatctgtatttgtgtgggcttaattttgggctctctcttctgttccattcatttaacggttatctttctgctaatactatactgttttaattactgtagctttgtaatatattttgaaatcaggaagcatgatgcctctagtcttactctttttcaagattgctttggcgatttggggttagttgtggttccatgtgaattttaggatcgttttttctgtttctataagaaaagtgccaatgggattttcatagagatctcattgaatctgtagatcaccttgggtggtatggatattttaacgatattaagtcttacaatccatgaacatgggatgtctttccatttatttgagttgtctttaatttctttcatcagtttttttttagatactttttagtgtagaaggctttcacctccttagtttggtttaataagtattttattctttttaattttcctgtaagtggaattgtttcttaatttcctgtttggatagtttgttgttagtgtgtagaacataactgacttttgtatgctgatttttgtatactaactttactgaatttatttattagttctagcagggtttttttttgtgtgtgtggagtctttagttttctacttataagatcatatcatctgcaaatcattttacttctttctttctgatttaaatgccttttatttctttctcttgcctcattgccctggctaggactcccagtgctgtattgaagagaagtggcaagattggtcattcttgccttgttcctagacttagaggaaaaaatttttgtttttcaccatgaagtgtgatgctagttgtgggcttttcatatatagctataattatgtcgagataatttttttctatttctagtgtttgagagtttttattatgaaaggatgtttaattttgtcaagtgctttttctgcatctattgagatgatcatgtgtttttttattctgttaatgtggtatatcacattaattgatttttgtgtgttgaaccattcttgattaccaggaagaaatcctccttggtcatgaggtgtgatccttttaatatgatcttgaatttggcttgctagtattttgttaagaatttttgtatttatgttcatcagggatattggcccgtaatttttttttgtagtgtctttggcataggtatcagggtaatggctggcctcataaaatgagtttggaagtgttttctcctcctcaattttttggaagactttgagagtcattgacattaattctttaaatgtttttggtggcattcaccagtgaggtcatctggttctgggcttttctttgttgggaggttttttataattgactcaatctcattagttatagatttgttcatatttcctatttctttttcagtcttagtgggttgtatatttcttggagtttatccatttcttctaggttatccagtttgtgggcatataattgttcagagtagtctcttatgatcctttgtatggtatcagttacaatggtatgctgtaatgtgtcctcttttgtttctgattttgttcacttaagtctttttttttcttactctaacgacttgtcagttttgtaaatctttccccaaaaagctcttagttttaatttttttctatttttttattctctgttttctttatttatgctctaatctttattatttccctccttctgtaaactttgggcttagtccttttttttttttcttttttggtagatcttacaggtataaagttagtttatttgcttgctttcttctttttttttttaatgtaggtgtttatcattataaaccatcctcttagaactgcctttgctgtatcccatcagttttgttatattgtgttttcattttcatttgtctcaaaatcattttctttttggtttttttttccttgacccataggctgttcaggagtatgttgtttaggagtgtgcttcagaatttctgtttagtacttttttacattttctgtgtctttgttgaaattctcactttgttcgtacattgttctgacctctttgagtgtctttatgatggttattttgaattctcttgttagataagtaatatatttctctttcattagggtcagtttctgaagatttatcttcatcctttggtacatatttctctgtttatttttttcactcttattgttgatatctacacattaggaaaaaacagcaacctcttagcctttacagactgtctttgtacaggagaagatcttcaccagtcagcacagcagagattcccagaacctctcaaaccttcatgctagtccaaagtgctgtctttgttcttagtggtgcctaggtgtctagggtcctgtctggtccatctggtccatatgctgggtcctatcagtgctacaagacagatgagacagaagccagtcccttggacagccctcagaaatgttagaatgttggacacgtgatctacctctttcccgagccctgccccaggagaagctgggctctggagtttctctccaactcatttcatgctgagcttcagggagtggtcatggcaactgcttgtgtgcttgttcaaacttctgtcacattatcactggcccctagatatctagggcgttttagattccatcagtgctacaaggctggcaagacagaagccagttcctagggcagctcttagaaaagttggaatgttagatacacaagccaagtttttccttccccaaggagtggtggggagctgcaggtgttcttatgatcatatggtgctgtattgggggtacataattgctctcgcagattatggcaagagggtgtctccagtcttctaccaggtttgatgttgttcatttcgtacttgtgcaggtgcagaagcattgcacctagtttcaggatttctcacaaagggaattcgtatattatcgttgaatcagtgtgttcatgtggggaaggagggtttagggcgtcctattcttccatcttgctgatgtcaacctgttacttatttttcctaaattggaaaaatgtaaataaaatactcattttggaaacaaaattatctgactttagtggctctttgaactgggtttgagaagtacagacaaactcaacactcttatcttaacattaaagtagatatctcaagtccccttttaatacttttagcttggaatactttctagtctgtagggataattaatttctttttctatttctgcatatcaaatattgctttaaagattcccttcagctgtgttacttagagattgaatagggaaatattttgtcttttgattaacagttttaggctaaaaaaattagataagtatgcctttggtttgtgtagcagacaaacttcatgttagataattcgtgaatttgtagtccattcaaatgtttatcttccagttttcagaggggttttttgtttgtgttagaattctttcaagtcattttatatttttatgaattatttgagaagaatacttgttaatctcagcctgtatttttattgtgaatgtgattacctattattgaggggcatagtcctctgggtgtttctaattcagcatcaaataattatttctttatagatacatatgttacatacatattttacacataagcacacacacatcttgcatatatagatatgtatttatatgtgtataaacatgaataatatttatgtttgttatatacatttatcttgtatattcctgtttatatacatataaacatgtatatccatatctgtgcagtagtgtataaagtaccttgaattcttttcaacttagaatactcagaggtcttaaggaattatatttctttaaatattgaataagatttacttgaatttaaaattttttattttgctaacatttggaaatgctttaatggtatttgttaagaaatgatgtagcatggttgttgactagcatgcagtgttctattaatatatttgccttttggggtttcacaattacactattataaatctttttgagagtacattttagtcagtatagtatatatattttttcttagttttaatcaaaaataaaatcattgggaaatataaccacttgttttccagttacttattatagaaagaataagttaagaaatgtgaataaattgaacaaattaataaaatatttgttaataatccaccttatggaggatttaaaaataattttaattataaaataatgtattttaatatagttcagaaataaaagtgttgctccctctccactatcagatacctcaggtacattcttagggtagttaacagcttcttaaatagcttctcagatatgttctgtgcatatacaagtatatacgtatgagtatgtatatgagtgtatgatggaattgtacatacacaagatctacatatattcttttaaaaagtactaatgtacttttatattgtacttttataaggtattgtgttttataaggtatatgaattaaatatattgtccatatacattgagaaaattgggtaaattgatgtgcataataaacatgtcatctctttatgtttatttgaagtttttttctgattgttctagtggcatagaagtaaagtttctttaatacagtttaataacattatattttaaaactttatgaaaacagaatttttaatttgtgtaaaagattttacccttaatacatgttcttaatatccatcatactgaaaatagtgggctatctttggttagcagggttattgtgaatgttgtatatgggaagggcaggcattctgttatttcagtactgtgataccatgttgtttgaggtgggtctttttctaagcaatgggcatgttctacttttattaaagtgatgatagaaaatgactttaaagcatgtagtgacataaagttgttaggagatataactaatgctaaatgacgagttaatgggtacagcacaccaacatggcacatgtatacgtatgtaacaaacctgcacgttgtgcacatgtaccctaaaacttaaagtataattataatagaattaaaaaaaaataaagtagtagtttttaaaaaatcctcaaaactgagctcattgtgtggttttactaattttggttttaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcaggtgagctgacaccgtagaaggcgggacattatttttactgtatcatttatttttaatgctgtcacttcttttgcttagtaaaagagagttctagcctattaactattttgattactataattatggattatcagttgtcacagaatttgactgaaaagcaaaattctgcttgtccacaagtcttggagaataaattactatgtacagttgacttttcttaatagtgaaggtttaactcctttagtatgagactttaattttaactgacttgatgaaagtttaaaactcaaggcatattaagttttttaaacatgttgatgataatttaatctttccttggtgatttaagctttttgttaaaaataccagttaatgagttgtacagaagttttgggtcaagtggatattaattgtagtagtggtactggaatttgtttttttaggaaaaaaaatcttcatgtttgtttctggttatttatttctttatgaagataagagtgaagcatttgctctctggcttttctttctgtagaattcataagtgggtcaagctgaggcggctttctgccaagtagttttcagtatcctctgaaaatcttttgatttgttgacatcattcagaatgtttttatggtttccatatcaggacaaaatggatgttaggcatctctgagccacgttacacgctctcttctatctcacttgtattaaatttggtggcttgttatgaaagcggaacattttttagcaatttaagaattggtactgggccatgtgctaaggcatagcacaacagatccaggtgtattatagaagtatctttctcatgcctgttatcccagcattttgggaggctgaggtgggtggatcacctgaggtcaggagttcgagaccagcctggccaacggggtgaaaccctgtctctactgaaaatacaaaattaggcgggcgtggtggcatgcgcctgtaatcccagctactcgggagattgaggcaggggaatcgcttgaaccctggaggcagaagttgtagtgagccgagatcgtgccactgcactctagtcagcgacagggtgagactctgtctcaaaaaaaaaaaagaagtatctttcagtatgacttcaaattcagcccaacaaatacggagtacctcttaaaagaaagaaatgatgctagatgtgggggatacaaagaggaataagatatggttcttgatatttacaggatgctaagatacataaaaaatgattattagtacaaggatatgatttatcataagaaaaataaaaacggtatgcagtttgaaggaagatgaatctgcttctagtttgggataagaaactctagtgcaagatttattcattcattaggtagatcgatatttattgatacttattgattaatctactattctgtgttctattgctggggaatgagcaaggaacaaaacagtctgttttcttggagttaacattctagttaggtaatgcaaataagaaacaaacatatagtatgccaagcaataataagtaccttgggaaaaaataaagcagattaaaggtattagagaggggtgggcagcagagaaggggtactagtctatgttcggttgtcaaggaaggcctcactaatcagaatccggaaggaagcacgggagcaagtcctttagctgtgtggagggagagagagccttttaggctgaggaagcagctgatgcagagaacctaaagtcagcgtatgtttgatgtgttcaaggaatagcaaggaagacattggggctgaatggagtaagggaagggaagaacagttcaagatgaggtgaaaggggaccagaccacgcaggatcttctaagccattgtaaggacttgactttcacttcaagtgataggagaagctagttgaggatattgagcagaggagtgacttgatttgactcatgttttattgtgatcactggcattattgtgtggagtagactagtggggcaacggtggagtcagggagactttttaggagactctcataatcctggtaggagatgatggtggcttggaccaagatatctggtagcagaaaatggggaaagaatcagtcagattctggatatattttgaaaggagtgatgacaggatttgttggtaatttaggcatacttcgtgccttttgtgagcattgaggacagccaagcatggcttcttaacacctattttagtttgttcaggttgcaataataaaaataccatagactgggtggcttataaacaacagaaacttacttctcacagtttggaaggctgtgaaatcttagatccaatttccaacagatttggtgtctggtgagggcccacttcccagctcataaacagccatcttctccttgtaacctcacatggtagaaggggcaagggagctctcaaaagcctcttttataaaagggtgctaacccattcatgagggctccacccttatgacaatcgcctcccaaaggcgcttacctcctgataccatcacattgggagttggaatttcaacatataaattttgacaggacacagacattcactctatatcagcagctatcttaactagatttcatttgtattcttaatttgaaaaaaaaatttgagaaagaaatagcagtgaaatttacctgatataatatgtagtaattattcctcttaaaagggtagtataggcatgggacattatgtatttcttcagtaactgacttgtactgaggatcactgactataagagggtcctttgtgctatccaaggcccctgggactttatcgcaccctgggaggcctgggcctgtctctaaagcaatgataacaatatgattttctcttgaattttttttctttttattttcgctcaatgaaattctaaaaatatgtggtttgtttaattggataataaattctgttagccaacttttcatgtgaagactcctaaattctgagttgtcatttcatcatcaaattactgagcatcttcggagaggtaaaaactgtgctttagagatgtctttaaaataataatgaattgattagtgagtaggaagaaaaatggctagagaaacaaattttatttgggagcaaatgatgaagacaaagacgtgagacatttttcttctaaaaataaactatcctagttcagaaacttaatttgaaaacctcatataatttcttatattccccaccccaagtgattaaattcaatttgaaagtaataaaactctattgcaatattgggaataactcagtggttgaagtgaaactgatagtacaagggtatattgttaattagaatatacagtcataactcaaagattggaattccctattattgtagtctaatttctgacatataatgaaagaaggcagtttctcaggcagtatatagaattatgtgagtctgtatactactactacattttgaaattatattttatgtagcatgctctagtgagtatgttatgttctacctaaggttcctgtcctttgacatctctagcagtatggtgaagttatgttcccctcaaaggcagttgagaatacagcactagagagcacagacaaatccaggccagagatgaagatttcagagtttcagagtcatctaaaaagaagtgatagttgaagcaatgagaatggatgagttcacgtaggaagtgattagagaaaaagatcaaagtaacagtattgcatattttccacatttaatgggtgggaggaagacagagcctgtgttggatcagattcataggaaatcaagaaagcaaataggaaaccaagaaagcaggattctgtgggtctgtgattagaacacaaattttgatcattttgatttttaaactttagcttattgaagattgtatatttttatttcttattggatcccttgcatatcatcacaaaaatgtattgtttcttactgtagcttatcaacttttaaaatgttttaaatttacactttatgcattcaacaagtatttatcagtcatctgttatatgccaggttgtaggtgatgtgaaataaatagacaaaaatccctgtcctcatgaagcttattctgcagtaaagggagacagataataaatttggtgctgggggcgggagtggggggcagtgaggagggagaggcagctctcttatgtctctttttataaagctactaatcctattcgatcagggccccacccttcagacctcattaaaccttagttacctccttttaggccttatttccaaatacagttacactggaggttgggacttcaaaatatgaattttagaggaacacatgagtccttagcacacagttatgtgtgagcagagatgggaggggtgcaggaatagcagtgtaaaatggggtccttcagcagtcaaagaaggtttcattgagaagctgacacttgaacacagatttgaaataagtgaaggaaccaggcttgtggctgtcttggggaagagtacaaggctgtggggcaggagcaacaagaagaaaaccagtgtgggtggaatggggtgagcaagggaagggggagggcgtgggccttatcgcccctgtaaggactttggcttttgttcacagagatgggacaatagtggagggatttgagcagaggactggaggagtgacaaggtcacttatgtttgaaaatgatgtgatctacagctcctgcaaaacagtaccataatataattttggatcattttagcataatatattgttcagaaaatagatgagttcctttcttgctttaagtcaagataacccatcacattagaaaaaaaagcaaacctttgcttttttaaatgtgaatttcaagataaaacatgtataaattgcctaaatataatcttgtgatccattagcatttaaaaaggataaatacaggtttgtagcaatattacttgtagttaataagctgatatgttataattctatttacttgaaataatcagttaaacacatattccacatattttggttatcataacaacttgggtgaaaaaatgaagagcagatgttgtatcaatttgttgatgtttaatagtatgacagttttaaaattatagttacactgttcagactttatgtatattataatttgtcgttgaaagagacaccttatttaacttttttctatgaagattgttataaaatatgaatagatgtgaataagagaaatctgcttcaaagatttattttaaaactgaaaacatttagactgaatttcttattctccacttcacttaccaaccctgtttctctccaccatcccctctttgttgggtgaagggtatggagaatgatagaatgtataggaaaaatatttaatttgaacttactcattgtttatggttatgtttatagtcataatttgaataggatatatttttaaatgtttttagagctttcaatactggctttattcagaaacttaaaaaaatctttatcaaattcacttcattcaatttttagatatcagaatcacttggtggctgcattcatattaatctcattttattttgaatcctttatactttcaggaagctaggggtttgaactcgtgtaaatcattcttacacgtttataattggacaaagtaaatgaataaatcattaatattatacatctcatgagcagaaaacatgagtgtttaacattgaagtgaaatgtcgttgttggccagtgtacacaaacatacactgttcaccttacagaatttcattttgtctgacatagagagtgttgaggaaaaggcaaatatcatagcagctgctgtaattgaattggcttctgaatcatataaagccaggaagcctgacagtaacattgtctaaacccttaaaaaaaatattatggtgcatgtgatgtgtatctacttgaggctgaaatgaatgggctattagaaaaaattgcttttgaggggaaaggggaaagtaatgatattttagaaaaacatgctaaaaatagaggtgatttttttccctcttgaaatgtcttgctttctgttttcaaaggaagcttttaatccagtcgtgaagactctctggcattaatttttgtccatttttttcttctttttttaaacttacttttactttttgtgaataagtagttgatgttttacttgatatgtaatacctgtcagaatactgatgtgtattagcagttgtttcataaatactttagttgttactgggaataaatatagccagtttttttttcaatacaagtgtttattttttatttactttaactaatttttaaaattttttatatatttatggagtccagcatgatgtttcaatatctgtatacattgtgtaatggttaaatcaaaccaactaagatattaatcacctcacatacttactttttgtggcaagaatgtttaaaatctattctcttagcaattttcaaatatacagtacatttttattaactgtagtaacaatgctgtgtagtagatctccagaagctacttttcctgactgaaagtttatactttttaatatctatctatctatctatctatctatctatctatctatctatctatagtctggctttgttccctaggctggagtgcagtggtggaatcatagttcactgcagctttgaagtcctgggctaaagcaattttcccacttcagcctccagagtagctaggactataggaatgtaccacaatgcctggcctttttttttttttttttttttttgtagagatgtggtcttgctgtgttgccctggctggcaaaacttcatactttttgaccaacacctcctgattcctactccccgatccccagcctgtggtaatcattattctactcacaatttctctgagttggacttttttagattccatatataagtgagactgtatagtatttttctttctgtacctggcttatttcacttagcataatgtcctccagatttatccatactgttacaaatggtaggattttatcatgttcatattttaggaatggttgattataaaatgtttttataggtttgtttgaaaaccttttctaattattttatcattccagaggataattgtcctatgtcaaggtggccttaatttttaattttttgtatttactttaaattatttacgtcagttatttatacttatttactttagaacacttcaaaaactagtcagaatccaatttccattgcagtgtttgtgaaaggaaatgaaatgaattaaagaataatttttttaaaagatgaaatcatgaatcattcaaatataaaatgaacacatctctgagattttatttaactcattaatgagggaaactgtaatatgttacaactagttcaaaagagaattcaagaaacatagttatataggcaagaaggaatgctgaaatgtcttagagatttcctttatagagtttttgttctgttaataagtagccatataggcattatccttgttgtatttcttttctgtcttttaaagtagttacccactattctctctaatttctgttaaatctattgcatagtgagtctttggattagggccattgacacctaactccttaggccttcttaaaagtatatgcttgcttttagaaattaagggagagagttggaaatagaggtggtagtaaagggactagtttcattttccaggagaaatatttaaaatttaaacctctcatgagccatttagaactaaaaacagttgtaaaatcaagggtgaagttataggaatgcaaaaatggtagaggagaatggaagacaatggaaaaagttgttttttttttttaacttttagttttaccattattataaatgtttaaaatacatgtcaagatagagaataatttgaatagcttaatgagcccctatttttcacccactgatattgaacagtataatccttttatacacttgcttcatctgtcccatctctgtttttctcagaagtattttgatataaagcccagatatcagggccttataggggaggagaaaataattttctctctatgcttcatagttcttagttgagatgaacccctgtattaaaagacagattaacaagagggaaatggaagctttttaacatgtatacttcctgtatacctgggagatacccatggaatgaataattctccaagaggtggctttgagttcaggtgtaaataccatcttcaactgaaactaagacagaaaggtgcagggaaagccgccacgttgtagagaggtggtcaggaaaagcagtgagcaagggtaaggtttgttatgtagattgtaccttctttgttgataagagtttccagtgatttagagtcatccttctctttctggtacagagagggagacatacttgcaaattagagatttccttcgtagatacatatttctctgagaaaacggtaacttcttcttcctgttttcagaacttcccctatgtctgctattgcccaaaataattagtagaaaataactcttatgctaaagaggcatatttggggtggcatagtctggtctcctggagtcttattttggaatgatatgtcctgaactccatcaactttagtatgcatttcagaaagtagtatcattttcttccataatcataacattatcatgcctaaggaaactcatagtaattccttaaaattaaatattctgtctacatcagatttctgtatctcagcagtgttacagttggcctgtttaaattaggatacttcatgatccacacattgcatttggtccttacgtccctaaagtccttttgactttaggacagtacccccctcccttttgttttgtttgttttaaaacttgtcattgaattggtgagtacatataatcccacattgtagattctggattaacttgattgcttcttcgtggtatttctaacttgtttctatatatacctgtaaatagagattaaattttgggaaggatattttataggtgatgcaactaagcttcatagtgctttgcattggaagtctcttaatacctggctgccccacatctggtgatgctgaaggccatcagtgggttggatggtgatggcctggttctttgtttgcaaaggtggttttcttccttgtggccagcaagtgattgtggggtgataatttagcaccaccctgcaaataatcagttttcaaacaacctgagaaatgtgtcttcacgagaaatctatgtagaatctatttagaactcagaccagccaaattaaccctaatggaataaaagatgttgcagacacttttatcttattcaggaatagacttaagaggtaggtaagagagacttttaaaaaatcagaacggtaagtgtacaagagttggaaaaacagagttgaaaggaaaaatgaggataatcttatttaaaagattattgaatgtctaagtgcctttaataactccacaaggaccctcatgtaaacaaaattcagcaatagcaacaaaacaaagcctctgaaatgctcattgttccccagtgagataagctttaaagagcagaaatacgaaaaacaaaaccaaatctcaagtcaaacttaaaaatgttactttatgggagaggacaggcaaggcggcaagaacatagaagcagtgccacctgaagctggcatgataaggttgatttaactgcactgaaagtgacagaatctgaaagaacgactttacaaatgtaagataaatccatttcagaaaattgttaaacttgtgaattcaacagagaagctgtaaaactttcggtggaggctgtaaagagcagaattgatacctcagagcaaagactcattgatgcggaagatagaggaacatagcacaaccaaattaaaatgcccaaagccaaaaaaaaaaagtctaaaaaaatgaaagaatattgaaaaggcaccaggaaatccaagctgcatataacaatgggaaagatacatttgtacatgtcttcatttctttgattgtggtttctatatcatatttttttatttagttaacatttctcaagatgggtttttaggagattcccagagtatcatccatgggaagccctgaaatgacaagcttagatatttaaacttatgaagtgtttaatcttcattgcaaagacaggcttttacaagctacctaggtaaaaaggcatacaagagtaagaatgactctggacctttcttttcataagcataaggaagatatttctttcctcctaagttcttatacttcttgctgttggaggaagtgtaagagttttggaggaaagaaacaaaacaaaaaacagtggaactaatacactttggtatgatatctacaaaaactaactttttttttttttatggtggaagatccttagcaaatgaaacacataggacaatatgtcagtgaagttcttggttgcaacagtgctctttccagaatctactgacaatcaggaattagataaaatatacagttttgtttgtttaaatataattgtaactagcttgcaccctgccattgttagaaaaccacagatcaagtaaggaactaccaaaaaattcagctgaataatatgaaaaataaaatttaagtggcatgagaaactaaatcctaaaaaaaggaatgtattattattattattatactttaagttttagggtacatgtgcacaacatgcaggtgtgttacatatatatacatgtgccatgttggtgtgctgcacccattaactcgtcatttaacattaggtatatctcctaatgctatccctccctcctcctcccaccccacaacagacccctgtgtgtgatgttccccttcctgtgtccatgtgttctcattgttctgttcccacctatgagtgagaacctgcggtgtttagttttttgtccttgcaatagtttgctgagaatgatggtttccagctttatccatgtccctacaaaggacatgaactcatccttttttatggctgcatagtattccatgctgtatatgtgccacattttcttaatccagtctatcattgttggacgtttgggttggttccaagtctttgctattgtgaatagtgctgcaataaacatacgtgtgcatgtgtctttatagcagcatgatttataatcctttaggtatatacccagtaatgcgatggctgggtcaaatggtatttctagttctagatccctgaggaatcgccacactgacttccacaatgtttgaactagtttacagtcccaccaacagtgtaaaggtgttcctatttctccacatcctctccagcacctgtagtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagttgagtagattgcaaaaattttctcccattctgtaggttgcctgttcactctgatggtagtttcttttgctgtgcagaagctctttagtttaattagatcccatttatcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaattttagtataaggtgtaaggaagggatccagtttcagctttctccatatggctagccagttttcccagcaccatttattaaagagggaatcctttccccatttcttatttttgtcaggtttgtcaaagatcagatagttgtagacatgtggcattatttctgagggctctgttctgttccaatggtctatatctctgttttggtaccagtaccatgctgttttggttactgtagccttgtagtatagtttgaagtcaggtagcatgatgcctccagctttgttctttttgcttaggattgacttggcaatgagggctcttttttggttccatatgaactttaaagtagttttttccaattctgtgaagaaagtcattggtagcttgatggggatggcattgaatctataaattaccttgggcagtatggccattttcaccatattgattcttcctacccatgagcatggaatgttcttccatttgtttgtatcctcttttatttccttgagcagtggtttgtagttctccttgaagaggtccttcacatcccttgtaaggtggattcctagctattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttctttctcttgcctgattgccctggccagaacttccaacactatgttgaataggagtggtgagagagggcatccctgtcttgtgccagttttcaaagggaatgcttccaatttttgcccattcagtatgatattggctgtgagtttgtcataaatagctcttactattttgagatacgtcccatcaatacctaatttattgagagtttttagcatgaagggctgttgaattttgtcaaaggccttttctgcatctattgagataatcatgtggtttttctcgttggttctgtttatatgctggattacgtttattgatttgcgtatgttgaaccagccttgcatcccagggatgaagcccacttgatcatggtggataagcttttcgatgtgctgctggatttggtttgccagtattttattgaggatttttgcattgatgttcatcagggatattggtctaaaattctctttttttgttgtgtctctgccaggctttggtatcaggatgatgctggcctcataaaatgagttagggaggattctctctttttctgttgattggaatagtttcagaaggaatggtaccagctccttcttgtacctctggtagaattcggctgtgaatccatctggtcctggactttttttggttggtaagctattaattattgccccaatttcagatcctgttattggtctcttcagagattcaacttcttcctggtttagtcttgggagactgtatgtgtccaggaatttatccatttcttccagattttctagtttatttgtgtagaggtgtttatagtattctctgatggtagtttgtatttctgtgggatcggtggtgatatcccctttatcattttttattgtgtctatttgattcttctctcttttcctgtttattagtcttgctagtggtctatcaattttgttgatcttttcaaaaaaccaactcctggattcattgattttttgaagggttttttgtgtctctatttccttcagttctgctctgatcttagttattttcttgccttctgctagcttttgaatgtgtttgctcttgcttctctagttcttttaattgtgatgttagggtgtcaattttagatctttcctgctttcttttgtgagcatttagtgctataaatttccctctacacactgctttgaatgtgtctcagagattctggtatgttgtgtctttgttctcgttggtttcaaagaacatctttatttctgccttcatttcgttatgtacccagtagtcattcaggagcatgttgttcagtttccatgtggttgagtggttttgagtgggtttcttaatcctgagttctagtttgattgcactgtggtctgagagacagtttgttatactttctgttcttttaatttgctgaggagtgctttacttccaactatgtggtcaattttggaataggtgtggtgtggtgctgaaaagaatgtatattctgttgatttggggtggagagttctgtagatgtctattaggtccacttggtgcagagctgagttcaattcctggatatccttgttaactttttgtctcattgatctgtctaatgttaacagtggggtgttaaagtctcccattattattgtgtgggagtctaagtcactttgtaggtctctaaggacttgctttatgaatctgggtgctcctgtattgggtgcatatatatttaggatagttagctcttcttgttgaatggatccctttaccattatgtagtggccttctttgtctcttttgatctttgttggtttaaagtctgttttatcagagactaggattgcaacccctgcctttttttgttttccatttgcttggtagatcttcctccatccttttattttgaacctatgtgtgtctctgcacgtgagatgggtttcctgaatacagcacactgatgggtcttgactctttatccaatttgccagtctgtgtcttttgattggaacatttagcccatttacatttaaggttaatattgttatgtgtgaatttgatcctgtcattatgatgttagctggttattttgctcgtgagttgatgcagtttcttcctagccttgatggtctttacaatttggcatgtttttgctgcggctggtaccggttgttcctttccatgtttagtgcttccttcaggagctcttgtagggcaggcctggtggtgacaaaatctctgagcatttgcttgtctgtaaagtattttatttctccttcacttatgaagcttagtttggctggatatgaaattctgggttgaaaattcttttctttaagtatgttgaagggccgggtgcagtggttcacgcctgtaatctcagcactttgggaggctgtggtgggtggatcacgaggtcaggagattgagaccatcctggctaacatggtgaaaccccgtctctactaaaaatacaaaaaaatttagccgggcttggtagcgggtgcctgtagtcccagctactcggaaggctgaggcaggagaatggtgtgaacccaggaggcagagcttgctgtgagccgagatcgcgccactgcactccagcctgggcgagagcgagagtccgtctcaaaaaaaaaaaaaaaaaaaaaaaaaaaaatgttgactattggcccccactctcttctggcttgtagagtttctgctgagagatccgctgttagtctgatgggcttccctttgtgggtaacccgacctttctctctagctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcttggataatatcctgcagagtgttttccaacttggttccattctccctgtcactttcaggtacaccaatcagatgtagatttggtcttttcacatagtcccatatttcttggaggctttgttcatttctttttattcttttttctctaaccttctcttcttgcttcatttcattaatttcatcttccatcactgataccttttcttccagttgatcgaatcggctactgaggcttgtgcattcgtcacgtagttcttgtgccatggttttcagctccatcaggtcctttaaggacttctctgcattggttattctagttagtcattcgtctaatcttttttcaagatttttaacttctttgccatgggttcgaacttcctcctttagctcagagtagtttgatcgtctgaagcattcttctctcaactcgtcaaagtcattctgcgtccagctttgttctgttgctggtgacgagctgtgttcctttggaggaggagaggcactctgatttttagaattttcagtttttctgctctgttttttccccatctttatggttttatctacctttggtctttgatgatggtgacgtacagatggggttttggtgtggatgtcctttctgtttgttagttttccttctaacagtcaggaccctcagctgcaggtctgttggagtttgctggaggaccactccagaccctgtttgcctggatatcagcagcggaggctgcagaacagcggatattggtgaacagccaatgttgctgcctcatcattcctctggaagttttgtctcagaggagtacccggccctgtgaggtgtcagtctgcccctactggggggtgcctcccagttaggctactcaggggtcagggacccacttgaggaggcagtctgtctgttctcagatctcaagctgcatgctgggagaaccactactctcttctaagctgtcagacagggacatttaagtctgcagaggtttctgctgccttttgtttggctatgccctgcccccagaggtggagtctacacaggcaggcaggcctccttgagctgcagtgggctccacccagttcgagcttcccagctgctttgtttacctactcaagcctcggcaatggcaggcacccctcccccagcctcgctgccaccttgcagtttgatctcagactgctgtgctagtaatgagcgaggctctgtgggcgtaggaccctttgagccaggcgtgggatataatctcctggtgtgccgtttgctaagaccgtcggaaaattgcagtattagggtgggagtgacccaattttccaggtgccgtctgttacccctttccttggctaggaaagggaattccctgacccgttgcacttcccgggtgacacgatgccttgccctacttcggctcacgctcggtgcgctgcaccgactgtcctgcacccactggccaacaatccccagtgagatgcacccagtacctcagttggaaatggagaaatcgttcgtcttctgcgtcgctgacgctgggagctgtagactggagctgttcctatttggccatcttggctccagcaggaatatattttcaagtacacatctttcatgaaaatattgatcataaaacttggacaaaaatatctgtacataatataaaaatgttatgttctcactgataagtgggagctaagctatgaggatgcaaaggcataagacgtatacagtggactttgggggctcaggggaaacagtgagaagtgggtgagggtaaaagactacacactggggctgggcgtggtggctcacgcctgtaatcccagcacttttggaggccgaggcaggagatacctgaggtcgggagttcaagaccagcctgaccaacatggagaaaccctgtctctactaaaaatacaaaaattagcgagacatggtggctcatgcctgtaatcccagctactcaggaggctgacacaggagaattgcttgaacctgggaggcagaggttgcagtgatctgagatcgcgccattgcactccagtgtgagctacaagagtgaaactctgtctcaaaaaaaaagactacacattgggtacagtgtacactgcttgagtgatgggtgtaccagaatctcagaagtcaccatttaagaactttttcacgtaactgaacactgcctgttccccaaaaacctattgaaataataaataaataaataaaacaaagttatggttccaatcatcagaacatagtatagtaaaattaatataacaaaaattaaaagatggataaccacatgaaaattaaaattccgcacatgtaaagcaaaagagaaatctataaacaataagaggatggcttgtaatcaatgaactttataatgatgtagttatattttcatgagtttttactaaatctgtatttaaagaaaactttatcagtttaaatgtctatattagaaaaagagaaaagaaatatagaactataaatgtctcaaatagggaaaatataattaataaaattaagcagaaataagcaaaatgacagtagttgattctttgggaaatttagtcaaagtcataatcattagattagttagacaaagtaaaatgtaaataggatcaggagaagaggtacggtaacatgcaagaaaactgaaatatttgggagaatgttatttttagttagataatgttaattaatagctcaggtcaaaatcagaagtaattaaagtatatgtgtgttgaggggggaggggaattgctagagtggatgcagctaggagtagaaattatagctagaatgaagcttctcaaattactaatttacaaattacaaattactaaattactttagaaagaagtaaggtataaataaatcaaatttaaaaaactattagaacccatagagtcataataaattagcaaagaaaaggacgcctagccctgatgggatttaatttggagaattttttcagaagttcagagaacaattgcctagttactaattagttctaccttcaaaatgtagaaaggtatgttattaagtttctgattcattttacaagcataaatgattttgttttgacaatttgataaaaacaataactttaaaagaatttatggactggggtcattaattgacaatacgatattatattacagtaattatttactgtgagcaagttaattatcctcaaatgcatgagcagcatcataaaagaaaagctattaaaacagaagaggaaatttaggactcatcttcagttcctctttccttcacttctgtgtcctattcatgaaaaaatcttgactgctttaacaagtacattaagaatctgtgggcttctcaacttcgccactgctcctttcctagtaaaagtcaccatcatctcctcccaagttaccgcagtcatttcctgttgtcacttttcacctcacgatgtcacgtttcacctcaactcctaacaacctattttcaatatgtagccagagtgatcattgtaatgtcctttccttggttaaaaccctctagtggcttctcatctaacttagaataaaaatccagactcttcctatgtcttccaggcacgtaatttggccactgcctagctctccaacttcaccacatgcccctttccttaggctttccttggtttaggaaacatacaagaccagggtatgtcccccattaagctagtgtcctccttacagctcttctacttgctgatttctctgtctgaaacattcttccctcagttctttaggcaaatgtcactgtcctggggaggctttctctgatcccataatcttaaatcgcttcccttccatgtactcattgtccgtccaacacacctcactctttagtttcttcatgtacttaactaaaattaccttatttgtttattggcttttaccctagtgtgtaaggcctttgtacactgctgtatccatagtacctatgagaagttgagatgattagtgaatatttgttaaatgattgcatgatgtgtaataataggcaggataagcaatataatagtgggtgaaaaatagaaaaattggcagtagaattgaacagtccttccactcccttatagaaatttagcatgtaggacattaatagttggtaacgggagaaagatggtcgcaggaaatagtaatataaagataacagtggtcttaggagtcttcggttttaattctgactcagccatgtaacttggagaaagttacctaatccaacctttagttttcttcatatgtgaaatcaggatagcaatatctcctagatgttggatgtacatacttgtgcatttctgtaggtaaggtcctgctgtcttctttgccttgtccccctctctttggcatagacattttaatgataagtattttatgtcaggcccaagatttcaaaagtggttcaaattccaatgtcaatttagatgtgtaaaatacctcacgcagtgaaaggcacatagaaagtgaacagtagatgttagtttctttcactcatagttgtagtctttaggctggctaattctatatttaacttcaaatcttcctcaggattctcagaaccatatattcttgctattaaaatacattcctgctttttcttaaaccataaactcctaagagtattttctctatgacatttatcataatgatttattcatagctggtgttctataaatgtttgtttaaaatttagcatgcgtttgttaagtgcctgttatgtgcagtgcgtggagttaaacacagaaaacaaagtaaaggaagtggaaagacatattctagctatatggtaggaaaattttgctcacttttgaagagatgaagatatatttaataagatagattagaatttataaaaataaaaagacattggcgccctgaaatatataaaatgaatatggaaaggaaaggaaaaaagaaaaaataagttaccaagacatccaatagaatcttactatgcaaagtagatgaagatttgatagaaatatgtatggtcataacaggattctgcttgatagatatttggggaggagaaacagttcacacatgaagaagtagtgatagaaaacctgtatgaagaacatatagtgtttctagcaattaaagaaacctagctcagacatctccaaagtacatttattcagtaaaaaatttactcaagaaatatcatgtgatacaaaaaagcatgagcacaaaaagcatgtagagcaaaagcggtagaaacaaaacaggttctaaacccagcttttttacttccaggccagtttttttttttttttttttttttttttttaagtagtagactcttttatttttagactctaaagcttcaacttttaattgagtagaaggtatagagatttcccttatacatctgtccccgcatactcacagcctcccataccatcaaaatcccatgccagagtgataatattagttacaattgatgaacctatgttgacccatcattatcacccaaagtccattagggttcactcttggtgctgtacattcagtgcattttgacaaatgtataatgacatgtatccaccattatagcatcatgcagagtagtttcactgccataaaaatacactctgtgcctactcattcctccctccccctagcccctggcaaccactgatctttttactgtctccatagttgtgccttttccagaatatcatatagttggaatcatgtagccttttcagattggcttttttctcttagcaatatacgtttaaggttcctcatatcttttcatggcttgatagctaatttcttcttagatctgaataatattcttttgtctggatatcccacagtttatccattcacctatcgaaggaaatcttggttatttccaagttttagcaaataaagctgttaaaaacatttaccaagccagctttttgttccttgcccggcatttaacttctctgagactcagtttcctcatctgtaaaattgagctgatattttctaaggattctgaggtttgaaattatgtaattatctatataaaagtcatgaaatgttatgtgaataactgtgaataactcaagtatgcctgtattactggtgacattaaaggttgataaagcctttctggtagaaagcagtttggtcctatataacaaaaagtataatctacctgtgcttactctttgatcagatcattctattttgggtgttagacttcacatatctccaaatggaggtgagaaaagatttttttaaagaaaagtttttatagcagggtaatttataaaagccaaatagacacaactgtgggaacaattctaatgcccagtaacggagaaatacaaagtaaattacatgagggcagggaccatgactattctgaccaatgtgtacctagcaccttactcactgtggtgttctaaatatttgttgtattaaaaagactgaataagcgaatttaaggataagagaagagtttttactgaatacacaaagatcttaggggatggcatcctattcctctctttgttgctttgcatctctcattgccacactcagctgtgccagttgttacctgctggactccatactctccccctttactgatgccagtgcagtgcttaaacataggcactacactgatatagcagccatgacaggtaaacttctcacttgggaaagaaaattaacatcattgtaaaggaactaatgcaagagtgaccgtacgtcccaattttgcagagacagtcatggctcatgcctgatgtctcagtgcaaatcttgctagcatctcatttcattctcaaaggtatcccagtttggacagtaggtcaccgtttagctgaggatctgactttctgtttacttaagtgctgtaagtgctatagttgggaaacattttcttgttgtgtcaattcagtttacttaaacatttacttaacactcactagatataaggaaatcttaaatctgctgtgaaatacaaagaaaaataagacaagaccactgccactgaagaatttcacgttaagtaatgttttttcaactctccagcttaccttggtaactcagagcctaatcagagctagaagtgctcctagacccaagcttctgccctgaccccattcacttagagaacgtctatctggctcgcatctgactacaagtccctctctcctgtgggactcaatgaaatgttagcatacaagaacctgtgcccctaccataccccactcagggtatctggaataatggaattccttgcccagatatgtttgagcctgctttcagggcccatctggacctcttccttgaacacattcacacaaggccctttacagtgccagataagctagggctgggagagggggcagatggcaggctagtggcaagagctacacagtaagctccctgcaatcttacatgttctgaaattcaagaattctagttttgtacctggacttccaggtaatttcgaatgtgtattcttcaaagtaggagaatagaacagattttaagtagtagtgtattagcttgacttactgcttttaggtgtttagagacatggtatctgggcctccattttcattctttccatggaccccacaaatattagaggcaggctgtttagagtaaaacttaaaatccttagcatgacctgtgaggtcctacataatctgctcctgccctccaccctgctccactcggctgtacctgcttcttcactgttccaaaacaccccaggcacgctcccatctcccttgtactcgcagctccctcttggaatgatttttccctaggttgccacatggtctctttcctcatgtccttcaggtctgtccccctcttgacccccaaagtcattatcctatcagtgaggccttgcctggatagtctttctaagattttaccagtccctcaaacactgtctcctttactgccttatttacttcccttaagacacatcagtatcagaaagccagaagtcgtaaaaaactgaattagctttttcccctaaatgtctttcttttaaaactcctaaatattaagaccatttatccttaaaaattattttggctcttatatcttaaaattatccatatacccactttgaagagttaaatagttctaaggctagttacttaaatcagcagccagtccctcaaccctgccatcagtttcaggggtaactatttccaattctattggacgattcttttagtatttcccattgtgtctaaataacatgcttatgttgctacattctaacttcaattttgggccttaattattttccaccttacaggatgagacgtaagccctctctttccagtgtcacaccctgtgcatgtgcacacacatgcagctctccccttctcagtatgatgaaattgtactttttggtttcatcaagatttggtattttaaactgtaagcactagtcatagctgagccccatagtacactgtgattacttttccttcctttgcaatgttttatttctcctggagttaaaaattgtcatgattttgatttgtttacttttctaagtatattagtccattctcatgctgctaatgaaacatacctgagactaggtaatttatgaaggaaagaggtttaattgacttacagttccatatggctgaggatggcctcacaatcatggtggaaggcgaatgaggagaaaagtcatgtcttacatggcggcagtcaagagagcatatgcagggggaactgccctttataaaaccatcagatctcgtgagacttaatcactatcatgagaacagcacgggaaacacccacctccatgattcagttacctcccatgacatgtgggaattatgggaactgcaattcaagatgagatttgggtggagacatatgcaaaccatatcactaggttattatcatcaattttacccaagactgtatcagttatgtatatcttttttcagtatattcagtcatctatgttctgcagtttttcttgaaaaaaatctctcatagagcctttttaaatctgaatgattctccggtctgctagagtttaactgaaaccatagatgtatctctaagatttgtttaccctcaaaacagcattagggcagttgttacagattattaatactattgttgttgtttttaaaataatactatttgaccaaatcatgaaaacaactgttcactgtagatttttcagtggttctcttttatgtgttataatcaagataccttttattaaaaaaataacaatacattctttgttttacatggagcatattagggattactgaaacaatctgaatacattgatgtatatatatagtatttttttattttattatttctttataggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttgaattaaaatttatgagacacaagatatatgaagaatgttgcagtccttatcattttatgttactttttaaaaaatgatgtttgaagtgaaaaaaaaaaggatattcagggtcaaatcatgtacattacagatattatctaaattcttctagaatttatttttcatgaaatattgatgtattttaatctatgttaaaatatcttcaatgaggaaaatgtcacagaataaatttatattacacattttactctgtcttctacttgcttttgatttagaaggcagacccctagtggatgagaaatgagcccatacggtagtttttatagtagagaatgtttcaactgagcctaaactggatttctaagtctgggtcgttatgatgaagggggaaacagtctgaaggtatctgtttgcaggaaatagtttgcattggggtgggattatgtggaaaagggggcctcaggatagagaatttccttgtcttcacctgtggatgactggagaaaatgctactggcagaagccattttcatagggaggcaaaagaagtacagtttgtggttcagatgacaaagcaagaaacagaattgggggagagggcatttccacagagatacagcgtgttcctggtgcactgaaatcttaacagaagtttatgtcatttggttgctccatgagattaccatttgggaatctcgggttcccagagaagaaaaagaggcaaaggcaaggcactgtccctcaaaagaggctgaggcaaggcactgtccccaagttgaccttcctgagcagcagatatcaacaagacgactggaggaaaacgacaagagaagcagcacaagacatacccccagtggtgcccagaaattgctgcattatataaatgtggaaatacgagttatttaatatttgtattcccaaactagtgaagtctagtgatgcttaggttatatttctaagaagggcatttttcttgaaatacattatattaaataaatattttcttagagaattaaagaggaaagggactactttgtattgtgaatctactatgaactgggccctatatttatctttattccataaccctactaggttttattattctcactttacaatgacaaataggcttcgagaagttacataatatatccaatatctctcacctagatagaacaaagctgagtctatctgactacaaatctgtccatttttttacaactctcagatatctaagactaagctatcaagacaaggaacaaagtattctcagttgttcattagcttccccacatatggcttcaatataagtaaaaatctcatcattatgaaatcagggaccacttgtgttttctgtaggttgattttataggttcttctctcagacccttctatcaaaattgacatgaaaagcatagatgaggcagtgtaggagagtagaacctctccccctgcctgtgaaagcctgtgaaatctcatttgggatgtgtcctgacattattaaatcttcttggacaaaatatctagttgttaagaagataagttcagaggctgtttatgtttctcagggattattatacattacttgtaaggaatttcctgatctgcacacgagacaacattggtcatgaagaggttcatattaactattctccatataatcattttttacactccttgtgattggagtattgtaaaaggcactccataacatataaagacacttggagaatgtcacctaaaggtaaacagtaaaacacagcattagattttcctgcagatttcctaggaaaataatgtagcaacggcctactttttcttccattcccattgtcacttctaattgtgttgttcatacttgctagaaacatatataagttgacaccatgtcagaaagagcagagataatatctttatagtatatgaaaaagattttttttaaccagtggaattaaatgtaaaagaaatgttacagttcagctcaatgctttagaagaaattaaatagcagttgaaatacaagatgtatatatatactttaaattttatatggaaataagctgtatgttctacacttagttgcagaactactttgttcctgtcaatacttttcatgtgcctataggatttagatgataggctggttaacttagttgttaggagcatgatgctaataaatccaaggcacaaactcaacccgatcttttctataattcagatagggtgagactatcctctaaaactaaaggacagtgtgtatatttactgctatatacttataatgctttgcacattataggcattcaattaacattgacactgtacaataattatctgttcaaaggattgaaaaaaaggagaaacaatcatactctgtaaaatctgcttctgtagttgtggaaccctggacaagtcatgcaaactctctaaccctcatttcttaattgtaaaatggggacaaaaaaaatcctcctaggttgaccaatgaccaagtgaaatgatatacttaaagcatttaacacaaagtctagagctgcaaatgtaataaaaattgttaccatatactgaatgcatactttgtactattagtccattttcacactgctataaagacatacccgagactaggtaatttataaagaaaagggatttaattgactcacagttctacatggctggggaggcttcaggaatctcacaatcatggcggaagggtaagaggcatgtctcacgtggtggcaggcaagagagagtgagtaagagcagggaaaactgccccataaaaccatcagatatggtgagaagtcactcactatcaggagaacagcatggaggaaactgcccccatgattcaatcacttacctttcttgtcacatggggattacaatttgaaatgagatttgggtggggacacagagtcaaaccatatcatttatgtgtggtgctaagcatttttcaagcactgttgaaccccacagtgaccctatttatggtaggcattctattctactatgccctattatagatcacggaactgaagtttagaggggtaatggaagttactcaagggtacatggtgtatttcttaaggtttttttacttgtaagaacagaggaaccaacacaaacccaaccaagaaaattcgttgcctcaaactgacagaaaagcccagcagtgtgctgcttcaggcacagtttaatccaggggatcatgatattatcagagcaagggctcttttttctttgcagtctttctcacctgttccctggtgatatccagatggttgccagtagctcccagggttgcatgctttcacatccagctggatgtgtgactgactcacaccacaactattgaaacaaagcctttaacactctaactgcacccttgaagcaatcaccatggcaggggatggcattatcttgattggcttggacctatcaggatccaacattcaagctgaggatgggtatgagtcaacaccacccaaacagaatggctactgcgtgttaggagagatgcaaccacggggcttacgaagtaagtggcagaactagaattaaaacctaatgtttatcctttcagcaggcaaataaacaagatgattcgttgacaattttatctgaaatgacatttaatctgataaaaaagtagcttaaattttatattgatatgatagcaaattttcattagcatatttgctttagcgtttacaaggtttttttgttttgttttgtcttgttttgtactgaattatatcctcaaaaccagcctatgagattggaaggacaaatggcatcatttactcgtaggggagaaaactaaagcttggagaattaggcaagtggtccaagtatgcattcaagtaaatggctgaactgggattggaactaaagaattcactgatttgtaatccagtgttcttttggcaatactgcagtctttggaaagggagctgttacctccacttacctggagaccgaagctcaaaaatattagtcaatgtgtgtccagcagtactcaactctcaatgacagaactggttcaaaccctcccatcttctgactccaaagtccgtcctcttcctccatgtactgccacttacatgaacaaatctcatataggaagtgaggatgaaaaatgtccatttcccttcacccttcacttgtgaacagcagggccaacaccttttccctgatttaaaagcacccattttaatagtctatgacagatggtaaaaatatccattttaagcgtatgtatacatgtgagggatgaaatttctgttaatcacctcataacatgtttttgtgagagcctagagaattctttaatctgtagtgagatgagataaatctcccacttcattactgggaagaaaactctgtcagtgttctacccatctacactttgccccctaacttccatcagaaaagttaggccagtggctcgctcccagcctctgaatcacccagacctccttttacattaactggctctgcgtgcaaggggttttacaccactaagttctgtcttgaagggttggtgtgtctagactcatgcccaggtgttctcaccacactagctgtttaggagactgcagagcatggggcataagtcacagtgcagctctgtttccaggtcttaggatgtctctgatatcatcaaagaccaagcagggcctttgatcatcacgtgatctctggtgttatcaaagttccagccaaaagaaaaaaaaaattattttaattagtttgagtacctaattatgtgagagaaaatataaaatttttagttaagctctttgaaatattaaacatagctgacaggttcctaataccatcttcatagaccacaagaggcccgggaccttgtcctgggcagcattggtctaaaatcagatttgtttttttcttccttcagaatattaaagttaacttgttaattttgaccaatatattaaagtataatcatattttcataggttagaaatggtggatgttctacttaaggattctgttattctatacttaaggttgtatttttttaagtaactattgcttttgcacagaaatattgagtttagttttttccaaattattcctttctgatgttatggtagccttgaaagtattaagggcaacatcactagtctcatttatttatttgggaaaataggatagtaatatttgccctgcccaattcccagaattattatgggtttaaatatagtaacgtgtatatgctttactgaacatcccaagtgctgcattgtgctgattcttgttaatatattctaacatgtcttcatctgggctgtgagattattagttaagagaggtcacttccaaaagtttggctctgatctgctacagctcagaagtgatgatgatgtcttcctacctgagtgtgagaagaaaggaaacttttatttgtggcacgttttgttttagtctgattcgtgtgtgtgtgtgtgtgtgtgtgtgtgtttaattaacctaattcagccaggcacagtggctcattcctgtaatcccaacactttgggaggctgaggcaggtagatcacttgaggtcaggagtttcagaccagcctggccaacatggtgaaaccttgtctctactaaaaatacaaaaattagccagatgtggttgtggtggcaggtgcctgtaattccagttactcgggaggctgagacaggagtatcgcttgagcccaggaggcagaggttacagtgagccgagatcgtgccactgcactccagcctgagtgacagagcaagactcagtttcaatactactactactaataattaatctaattctattaatccattacggctcttgtctggagagtgctcctgatttccatcaatttctacattctaatgtttaaatctggagaaataaggccagtcttttcctggaatcaccaatccattcgccagatgatgggctgggaaaatgggaattagtatttgttgagccctattaaggcaagattctacaaccttcctctccttttaatcttcacagcaaccccgtgaggcatgttttattctcctaatttacagataagaaaatgagggttcacaggactgtgtaactttaccgaggtcacacagtaatccaggagtttagctaggtctgtgagactcaaaggctttcactgtctttaatatgcttcccttcacacacaagaagtgagaacaattggcagggcaacgagggaaacaattatttgggatctttgctttgtttgaatgcctagagcatttctcctgctccatagtccctgaaactttccatgatctcatcgctcaacaccagctccctttgcaatgagccaatcagctaactaaaaggtattcatgaaaaaggcccagcagcctcaggaacatacagttgacccttggcaacacaggagttagggtactttttggaccctaacaggtacccaaagtcacatgggccaccagctttgacctgagcttatcacaatgaaccaactccttctctcaggggaacaattaggttggtgcaaaagtagttgctttttttttttcattacttttaaatggcaaattttaaaaggcaattacttttgcacaaacctatagtttaggaaaccactgaggattcaaggtcagaagatctgagttcacatcctgccttccttaccagctgtgagatccagcaagtaactaagcctctcgaaagctcagtttatcctcacctgtatgttgtggccatgtaaagagctctattactgcacctatcccattgtgctgcaagctggctattggcctgaaagctccttgagggcaggagctctggcatcctcatctttttcatccacactccacaggaatgcttgatgctttattggtgattcctaggctctggattgggaatgaccctaatagccaccatgaagtagaagtttgactcggaaatcaaagtccaggcataaagtgatatttacgtgcatgtgacagcttgtccgggaagagaagtttattgaacagccagaacagattgcagagttaacgctcaacagcttcatccagaacacagaaatctgtcggagttgaaatgtgaaggaaacgcaggctaggaagacacaccagtcttgggaagtgtgcttggcggtgctcagactttctctgcagagcgttcttgggtcagactgttctggagatggggtcattagggcttggtaagatcaagtccctaacaataagagcagtaacaagagcaataataatggctagcattcattattgagacctcttacaaaccaagctctgaaatacatgcagtagcttgcttgactccctcaacaattctatgaggcagataaaattgtcccatgttatttatttatttatttatttatttatttatttattttttatttttttgagacggagtcttgctctgtcgcccaggctggagtgcagtggcacaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccccatgttatttatgaatgaggaaattgagcccagagagtctgagtgacttgactcagacctcccaggtaagacttaccttggccttgcaagctcttgggtctcagatgaaatgctatttggaagcattaagcattgggaggttggctctggctggttggatggtttgtaaagcatgacaatacagtgtggtgcggggaaatgtcgtttaaattactttgttttcctgggaccacttcctctcttaacaaatcttctataacacctgcccatagaacaccctgagaaggcagtgggtttattcctttaggggcctggcacatggtgagtggccactgctggctgctcctctttccctctcgctttgtggtgtatgctccacctacttccacacgtgatttataaaggaaaattttggagccaaagcctgagagcaggatctcttctttccaggactccatttatttaagagattcttttgtaaggcagagaacttcaagagacaagtgtaagaaggggttttcatcggtcttttgttttctactcaagatagctttaagtaataaccagccattacccaccttggattttctgtcctctactggtgaggtctctttctttgaactatttcaaatgtcccagcagagctggggaggccccctccccacagccccactgacttaagaagaacagatagagcacccatggtcaagctcaggggccacaatttgtcactgactcacttgaagggaaccgcttctccctcttttacccacgatgttgaaaagaggttgattcaggctgtttctaagcaagacttatgaaaagtgctaatgacaaaaataaaacaaaataaaaactataaagttatatcaggaccaaatataccaaggacaaggggaggccacatctcagataaaatgaaatagtgaagacagatgaggaagaactattttactcctattcaggactgaggctaacagtcacacctccatagggtacattccctagagtaacatgtgagtagcactccatgggattagacaataagatagccctacctagggtgtctttttcttccaaggagcatgactatcaaggtagggcataattgaaggtgaacagaagtcctaagtgggaaaagagatgatcagagggaccctggttactttttatgaaagtttatcattatagtaggcaatagtaatagttaacatttatgaagcagaaggtgttgggaactctactaaacactttgcatatattatccaattttgcactcactataatgctgttgttgcccagctgtattagtctgttcttgaattgctaaaataaatacctgagactaatttctaaagaaaacagatttaattggcttatggttctgcaggctgtacaggaagcatggtggcatcagcttctgggaaggcctcagggaacttaaaatcatggcagaagtgcaaaggggagcaaagcacctcagatggcaggagcaggaggggtggggaggtgctacacacttttaaaacaaccagatcttgtgataactcactcactatcacgagaacagcacagaggggatagtgctaaaccactcatcagaacctgccccatgatccaatcacctctcactgggccccacctccaaaaaggggattggggattacatacaattcgacatgagatttggatggggacacagatccaaaccatatcaccagccaatagccacttttcctcttctttttctgcaaaccttcattttgtttaggtggcagtattccctgcccgagacatcatgaatgtctaagtcaattatgtaatgctgttcacctaagccagggccaggtctaggaacaggtgtgtaactagatctgatgaaaaagaaagagaacaaagtcaagtactttccaaggatagtgaatattttcctccctgagaagagagaggccacagaaaagtctgttttgcttgtttgtttttacctatgtcttttatccctgccttccaagtgttgtgtcaagatatcatggcccaggaaatcctggggataccaacataggaccccagaactccagtggcactgggttgctaggacaatgctggcactgtctgcctcaaaactttttgtgaagtgagatattaaatgtctttattatttatgccaccattaattgggtattctcttacttgcacctaaaagtattcctactgataaaatagtattggttccattttataattgagaaaaccaggacttaaaaaaattaaatcccttcccctctgtcacacagc

SEQ ID NO: 563 - DNA, 2163 bp, Homo sapiens
cttctgcttgagtcagtcctcacggtgacgcttttccccagcttttccgagtacccgcccttatccgcggctccgctttcagagcagggtttctcacccgcggggcttcgggctcctcacccggcacctctgccagaggggaccgcctcccggcgcgtcgggcattcgtctctttcaccccttccctcttcaggagaaactgaacacgttttccagcctaaactcggcagggcaaaccagaacattccccgtctaagcagttccggggagttttaacaatttcctcgtaaactcgtctacagaactcactgtatactgtttaaatgtcgcctgtgtgtggagcaacagttttattgtgccgtgcaatcctcaacaagaaattgtagtccagggagatgaaaatcccttatttggcattcaggcgttgatcaaggtcgtgcaaccctcgctaaaaggatttaggttcatctccgtcattctcagccggggtgaaggggtgtagtctgacatttggaagcttaagaaccaagtctgctgccgtccaattcttttttaaagccttccatcatgtgtgtatcaagtgaaaaaatgagcttcatctgtggattgcagtctgctgctagaaaccatgttttcttccgatttaattcactgtctaactggagaaaatgtaacacattagcatccacctcacggggctgtcatcaagtacaagttaaccatatagtaaataagtatcagggactgggagtaaatcagtgtgacaggtggagttttctgcctggaaactttcatttttatagtacttttaacaacaaaagaacaggaggcctctcaagtaccaaaagtaaggaaatttggaggattaccagcaaatgtactgtatggaatgatgctttttcaagacagctgctaataaaagaagttacagcagtccctagtctgtcagtattgcatcctctaagccctgcttccataagagctattaggaatttccatacttctccacggtttcaagctgctccggttcctctcttgttgatgattcttaaaccagtacagaagttatttgcaatcattgtaggcaggggcataaggaaatggtggcaggcacttcctcctaacaagaaggaagtagttaaagaaaatataaggaagaataaatggaagctattccttggtttgagtagttttggattgctctttgtggtgttttattttactcacctggaagtaagtccaatcacaggaaggagcaagctactattattggggaaagaacagttcagacttttatcggaactggaatatgaagcatggatggaagaatttaaaaatgatatgctaactgagaaagatgcccgatacctggctgttaaagaagtgctttgtcatctaattgaatgcaataaagatgttccagggatctctcagatcaattgggttattcatgtggttgattccccaattattaatgccttcgtgcttccaaatggacaaatgtttgttttcactggatttttaaatagtgtaaccgatattcatcaactttctttccttctgggccatgaaatagcacatgcagtacttgggcatgctgcagaaaaggctggcatggttcatttgttggatttcctaggtatgattttcctcacaatgatttgggccatttgtcctcgagatagcttggcacttttgtgccagtggatacagtctaaattgcaggagtatatgtttaatagaccatacagcagaaaattggaggccgaagctgacaaaattggactactgcttgctgcaaaggcttgtgcagacataagagccagttcagtgttttggcagcaaatggagttcgttgatagcctgcatggccaacccaagatgccagaatggttatctacacacccttctcatggcaatcgagttgagtacttggatagacttatacctcaggctctcaaaattagagagatgtgtaattgtccaccactgtctaatccagaccctcgattactattcaaactcagcacgaagcattttcttgaagaatcagagaaagaagacctaaatatcacgaagaaacagaaaatggatactcttcctattcaaaaacaggagcaaataccattaacatacatagttgagaaaagaacgggcagttga

SEQ ID NO: 564 - protein, 531 aa, Homo sapiens
MCVSSEKMSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQALKIREMCNCPPLSNPDPRLLFKLSTKHFLEESEKEDLNITKKQKMDTLPIQKQEQIPLTYIVEKRTGS
